(12) United States Patent
Fotin-Mleczek et al.

(10) Patent No.: US 10,293,058 B2
(45) Date of Patent: May 21, 2019

(54) RNA CONTAINING COMPOSITION FOR TREATMENT OF TUMOR DISEASES

(71) Applicant: CureVac AG, Tübingen (DE)

(72) Inventors: Mariola Fotin-Mleczek, Sindelfingen (DE); Aleksandra Kowalczyk, Stuttgart (DE); Regina Heidenreich, Tübingen (DE); Patrick Baumhof, Dusslingen (DE); Jochen Probst, Wolfschlugen (DE); Karl-Josef Kallen, Königsdorf (DE)

(73) Assignee: CureVac AG, Tübingen (DE)

( * ) Notice: Subject to any disclaimer, the term of this patent is extended or adjusted under 35 U.S.C. 154(b) by 0 days.

(21) Appl. No.: 15/136,295

(22) Filed: Apr. 22, 2016

(65) Prior Publication Data
US 2016/0331844 A1    Nov. 17, 2016

(30) Foreign Application Priority Data

Apr. 22, 2015    (EP) ..................................... 15001191

(51) Int. Cl.
| | | |
|---|---|---|
| *C07H 21/02* | (2006.01) | |
| *C07H 21/04* | (2006.01) | |
| *A61K 48/00* | (2006.01) | |
| *A61K 38/19* | (2006.01) | |
| *A61K 38/20* | (2006.01) | |
| *C12N 15/117* | (2010.01) | |
| *A61K 9/00* | (2006.01) | |
| *A61K 38/17* | (2006.01) | |
| *A61K 39/145* | (2006.01) | |
| *A61K 39/39* | (2006.01) | |
| *A61K 39/395* | (2006.01) | |
| *A61K 45/06* | (2006.01) | |
| *C07K 16/28* | (2006.01) | |
| *C07K 16/30* | (2006.01) | |
| *C12N 7/00* | (2006.01) | |
| *C07K 16/34* | (2006.01) | |
| *A61K 39/12* | (2006.01) | |
| *A61K 39/00* | (2006.01) | |

(52) U.S. Cl.
CPC .......... *A61K 48/005* (2013.01); *A61K 9/0019* (2013.01); *A61K 38/177* (2013.01); *A61K 38/1774* (2013.01); *A61K 38/19* (2013.01); *A61K 38/208* (2013.01); *A61K 39/12* (2013.01); *A61K 39/145* (2013.01); *A61K 39/39* (2013.01); *A61K 39/3955* (2013.01); *A61K 39/39558* (2013.01); *A61K 45/06* (2013.01); *A61K 48/0041* (2013.01); *C07K 16/2818* (2013.01); *C07K 16/2878* (2013.01); *C07K 16/2896* (2013.01); *C07K 16/30* (2013.01); *C07K 16/34* (2013.01); *C12N 7/00* (2013.01); *C12N 15/117* (2013.01); *A61K 2039/53* (2013.01); *A61K 2039/54* (2013.01); *A61K 2039/55511* (2013.01); *A61K 2039/55522* (2013.01); *A61K 2039/55538* (2013.01); *A61K 2039/55561* (2013.01); *A61K 2039/585* (2013.01); *C07K 2317/75* (2013.01); *C07K 2317/76* (2013.01); *C12N 2310/17* (2013.01); *C12N 2320/30* (2013.01); *C12N 2760/16034* (2013.01); *C12N 2760/16134* (2013.01); *Y02A 50/386* (2018.01); *Y02A 50/388* (2018.01); *Y02A 50/39* (2018.01); *Y02A 50/394* (2018.01); *Y02A 50/397* (2018.01)

(58) Field of Classification Search
CPC ........................... A61K 31/713; C12N 15/111
See application file for complete search history.

(56) References Cited

U.S. PATENT DOCUMENTS

| | | |
|---|---|---|
| 8,715,964 B2 | 5/2014 | Felber et al. |
| 9,872,909 B2 | 1/2018 | Traber et al. |
| 2005/0032730 A1 | 2/2005 | Von der Mulbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |

(Continued)

FOREIGN PATENT DOCUMENTS

| | | |
|---|---|---|
| EP | 1718149 | † 11/2006 |
| EP | 2 623 121 | 8/2013 |

(Continued)

OTHER PUBLICATIONS

Ammi et al., "Poly (I:C) as cancer vaccine adjuvant: Knocking on the door of medical breakthroughs," *Pharmacology and Therapeutics*, 146:120-131, 2015.

(Continued)

*Primary Examiner* — Amy H Bowman
(74) *Attorney, Agent, or Firm* — Parker Highlander PLLC

(57) ABSTRACT

The present invention relates to RNA containing compositions for use in the treatment or prophylaxis of tumor and/or cancer diseases, to a pharmaceutical composition, to a kit and to uses of the RNA containing compositions for the treatment or prophylaxis of tumor and/or cancer diseases.

16 Claims, 10 Drawing Sheets

Specification includes a Sequence Listing.

(56) References Cited

U.S. PATENT DOCUMENTS

| | | |
|---|---|---|
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1* | 2/2015 | Butler-Ransohoff et al. ............... C12N 15/113 |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2018/0085472 A1 | 3/2018 | Masteller et al. |

FOREIGN PATENT DOCUMENTS

| | | | |
|---|---|---|---|
| WO | WO 2016-048903 | 3/1916 | |
| WO | WO 2016-070075 | 5/1916 | |
| WO | WO 2016/170176 | 10/1916 | |
| WO | WO 1996/009378 | 3/1996 | |
| WO | WO 1998/012207 | 3/1998 | |
| WO | WO 2001-052874 | 7/2001 | |
| WO | WO 2001/062274 | 8/2001 | |
| WO | WO 2002-060485 | 8/2002 | |
| WO | WO 2002/064799 | 8/2002 | |
| WO | WO 2002/098443 | 12/2002 | |
| WO | WO 2003-045431 | 6/2003 | |
| WO | WO 2005/111057 A2 * | 11/2005 | ........... C12N 15/111 |
| WO | WO 2006/024518 | 3/2006 | |
| WO | WO 2006-062723 | 6/2006 | |
| WO | 2007/031322 A1 † | 3/2007 | |
| WO | WO 2007-063421 | 6/2007 | |
| WO | WO 2007-084364 | 7/2007 | |
| WO | WO 2007-119895 | 10/2007 | |
| WO | WO 2009-034172 | 3/2009 | |
| WO | WO 2009-095226 | 8/2009 | |
| WO | WO 2009-149539 | 12/2009 | |
| WO | WO 2010/042189 | 4/2010 | |
| WO | WO 2011-061487 | 5/2011 | |
| WO | WO 2012-013326 | 2/2012 | |
| WO | WO 2012-062218 | 5/2012 | |
| WO | WO 2012/113513 | 8/2012 | |
| WO | WO 2013-053775 | 4/2013 | |
| WO | WO 2013-090296 | 6/2013 | |
| WO | WO 2013/143555 | 10/2013 | |
| WO | WO 2014/127917 | 8/2014 | |
| WO | WO 2015/062738 | 5/2015 | |
| WO | WO 2015-095249 | 6/2015 | |
| WO | WO 2015/101414 | 7/2015 | |
| WO | WO 2015/101415 | 7/2015 | |
| WO | WO 2015/101416 | 7/2015 | |
| WO | WO 2015/135558 | 9/2015 | |
| WO | WO 2015/149944 | 10/2015 | |

OTHER PUBLICATIONS

Amos et al., "Adoptive immunotherapy combined with intratumoral TLR agonist delivery eradicates established melanoma in mice," *Cancer Immunology and Immunotherapy*, 60(5):671-683, 2011.

Bontkes et al., "Tumor associated antigen and interleukin-12 mRNA transfected dendritic cells enhance effector function of natural killer cells and antigen specific T-cells," *Clinical Immunology*, 127(3):375-384, 2008.

Fotin-Mleczek et al., "Highly potent mRNA based cancer vaccines represent an attractive platform for combination therapies supporting an improved therapeutic effect," *Journal of Gene Medicine*, 14(6):428-439, 2012.

Pardoll, "The blockade of immune checkpoints in cancer immunotherapy," *Nature Reviews Cancer*, 12(4):252-264, 2012.

Pützer et al., "Interleukin 12 and B7-1 costimulatory molecule expressed by an adenovirus vector act synergistically to facilitate tumor regression," Proceedings of the National Academy of Sciences USA, 94(20):10889-10894, 1997.

Ruiz et al., "Potential of oncolytic vesicular stomatitis virus coding for B7-H1 (PD-L1) blockade antibody as systemic therapy for multiple myeloma," $8^{th}$ *International Conference on Oncolytic Virus Therapeutics 2014, Human Gene Therapy*, 25(12):A19-A20, Abstract 39, 2014.

Sayour et al., "Bridging infectious disease vaccines with cancer immunotherapy: a role for targeted RNA based immunotherapeutics," *Journal for Immunotherapy of Cancer*, 3:13, 2015.

Schirrmacher et al., "Intra-pinna anti-tumor vaccination with self-replicating infectious RNA or with DNA encoding a model tumor antigen and a cytokine," *Gene Therapy*, 7(13):1137-1147, 2000.

Tugues et al., "New insights into IL-12-mediated tumor suppression," *Cell Death and Differentiation*, 22(2):237-246, 2015.

Weber, "Immune Checkpoint Proteins: A New Therapeutic Paradigm for Cancer-Preclinical Background: CTLA-4 and PD-1 Blockade," *Seminars in Oncology*, 37(5):430-439, 2010.

Wilgenhof et al., "A phase IB study on intravenous synthetic mRNA electroporated dentritic cell immunotherapy in pretreated advanced melanoma patients," *Annals of Oncology*, 24(10):2686-2693, 2013.

Liu et al., "In situ adenoviral interleukin 12 gene transfer confers potent and long lasting cytotoxic immunity in glioma," *Cancer Gene Ther.*, 9:9-15, 2002.

Extended European Search Report issued in corresponding European Application No. 17196250.9, dated Apr. 9, 2018.

Heidenreich et al., "A novel RNA-based adjuvant combines strong immunostimulatory capacities with a favorable safety profile: RNAdjuvant promotes anti-tumor responses of protein and peptide vaccines," *Int. J. Cancer*, 137(2):37-384, 2014.

Marabelle et al., "Intratumoral immunization: a new paradigm for cancer therapy," *Clin. Cancer Res.*, 20(7):1747-1756, 2014.

Van der Jeught et al., "Intratumoral 1-20 delivery of mRNA: Overcoming obstacles for effective immunotherapy," *Oncoimmunology*, 4(5):e1005504, 2015.

Daniel et al., "ATGme: open-source web application for rare codon identification and custom DNA sequence optimization," *BMC Bioinformatics*, 16:303, 2015.

Gaspar et al., "mRNA secondary structure optimization using a correlated stem-loop prediction," *Nucleic Acids Research*, 41(6):e73, 2013.

Jung and McDonald, "Visual gene developer: a fully programmable bioinformatics software for synthetic gene optimization," *BMC Bioinformatics*, 12:340, 2011.

Swainston et al.,"GeneGenie: optimized oligomer design for directed evolution," *Nucleic Acids Research*, 42:W395-W400, 2014.

Andarini et al., "Adenovirus vector-mediated in vivo gene transfer of OX40 ligand to tumor cells enhances antitumor immunity of tumor-bearing hosts," *Cancer Res.*, 64:3281-3287, 2004.

Bald et al., "Immune Cell-Poor Melanomas Benefit from PD-1 Blockade after Targeted Type I IFN Activation," *Cancer Discov.*, 4(6):1-14, 2014.

Hornig et al., "Evaluating combinations of costimulatory antibody—ligand fusion proteins for targeted cancer immunotherapy," *Cancer Immunol. Immunother.*, 62:1369-1380, 2013.

Pruitt et al., "Enhancement of anti-tumor immunity through local modulation of CTLA-4 and GITR by dendritic cells," *Eur. J. Immunol.*, 41:3553-3563, 2011.

Scheel et al., "Therapeutic anti-tumor immunity triggered by injections of immunostimulating single-stranded RNA," *Eur. J. Immunol.*, 36:2807-2816, 2006.

(56) References Cited

OTHER PUBLICATIONS

Khairuddin, et al. In vivo comparison of local versus systemic delivery of immunostimulating siRNA in HPV-driven tumours. 2014 Immunol Cell Biol 92(2):156-163.†

* cited by examiner
† cited by third party

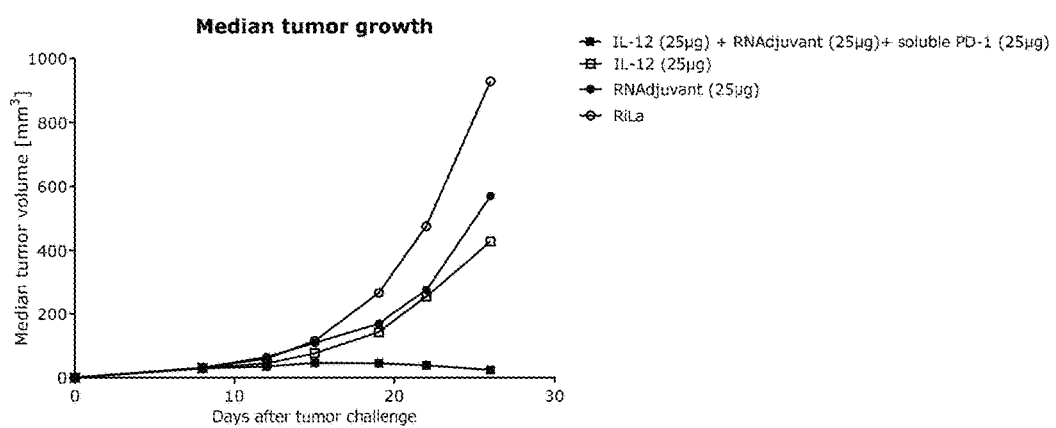
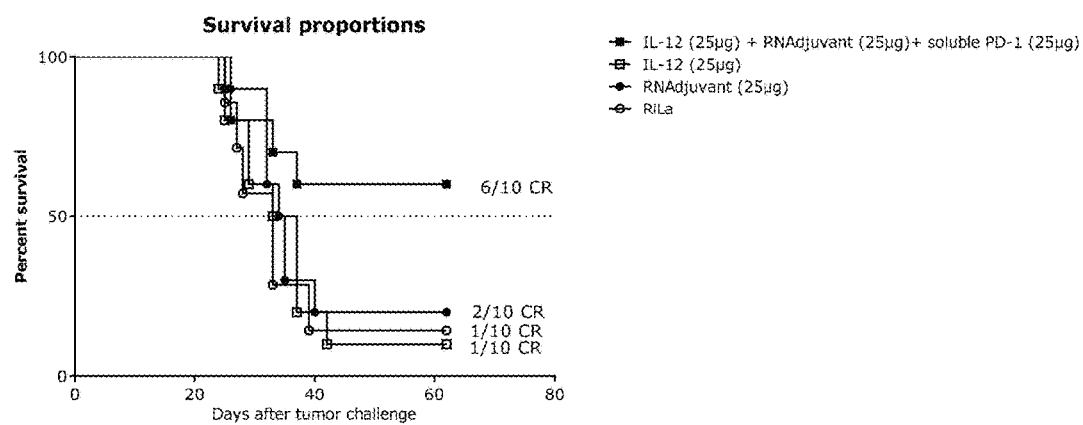
Figs. 5A-B mRNA sequence encoding murine CD40L (R3571)

GGGGCGCUGCCUACGGAGGUGGCAGCCAUCUCCUUCUCGGCAUCAAGCUUACCAUGAUCG
AGACCUACAGCCAGCCCUCCCCGCGGAGCGUGGCCACCGGCCUGCCCGCCUCCAUGAAGA
UCUUCAUGUACCUCCUGACGGUCUUCCUGAUCACCCAGAUGAUCGGGAGCGUGCUCUUCG
CGGUGUACCUGCACCGCCGGCUGGACAAGGUCGAGGAGGAGGUGAACCUCCACGAGGACU
UCGUGUUCAUCAAGAAGCUGAAGCGCUGCAACAAGGGCGAGGGGUCCCUGAGCCUCCUGA
ACUGCGAGGAGAUGCGGCGCCAGUUCGAGGACCUGGUCAAGGACAUCACCCUCAACAAGG
AGGAGAAGAAGGAGAACUCCUUCGAGAUGCAGCGGGGCGACGAGGACCCCCAGAUCGCCG
CCCACGUGGUGAGCGAGGCCAACUCCAACGCCGCGAGCGUCCUGCAGUGGGCCAAGAAGG
GGUACUACACCAUGAAGUCCAACCUGGUGAUGCUCGAGAACGGCAAGCAGCUGACGGUGA
AGCGCGAGGGCCUGUACUACGUCUACACCCAGGUGACCUUCUGCAGCAACCGGGAGCCCU
CCAGCCAGCGCCCGUUCAUCGUGGGGCUCUGGCUGAAGCCCUCCAGCGGCUCCGAGCGGA
UCCUGCUCAAGGCCGCCAACACCCACAGCUCCAGCCAGCUGUGCGAGCAGCAGAGCGUCC
ACCUGGGCGGCGUGUUCGAGCUCCAGGCGGGGGCCUCCGUGUUCGUCAACGUGACGGAGG
CCAGCCAGGUGAUCCACCGCGUCGGGUUCUCCAGCUUCGGCCUGCUGAAGCUCUGAGGAC
UAGUGCAUCACAUUUAAAAGCAUCUCAGCCUACCAUGAGAAUAAGAGAAAGAAAAUGAAG
AUCAAUAGCUUAUUCAUCUCUUUUUCUUUUUCGUUGGUGUAAAGCCAACACCCUGUCUAA
AAAACAUAAAUUUCUUUAAUCAUUUUGCCUCUUUUCUCUGUGCUUCAAUUAAUAAAAAAU
GGAAAGAACCUAGAUCUAAAAAAAAAAAAAAAAAAAAAAAAAAAAAAAAAAAAAAAAAAA
AAAAAAAAAAAAAAAAAAAAUGCAUCCCCCCCCCCCCCCCCCCCCCCCCCCCCCCCCAAA
GGCUCUUUUCAGAGCCACCAGAAUU

Fig. 10

RNA CONTAINING COMPOSITION FOR TREATMENT OF TUMOR DISEASES

This application claims the priority of European Application No. 15001191.4, filed Apr. 22, 2015, the entirety of which is incorporated herein by reference.

The sequence listing that is contained in the file named "CRVCP0175US.txt", which is 18,426 KB (as measured in Microsoft Windows) and was created on Apr. 22, 2016, is filed herewith by electronic submission and is incorporated herein by reference.

INTRODUCTION

The present invention relates to RNA containing compositions for use in the treatment or prophylaxis of tumor and/or cancer diseases, to a pharmaceutical composition, to a kit and to uses of the RNA containing compositions for the treatment or prophylaxis of tumor and/or cancer diseases.

Cancer, also known as malignant tumor, describes a group of diseases involving abnormal cell growth with the potential to invade or spread to other parts of the body. In 2012, about 14.1 million new cases of cancer occurred globally (not including skin cancer other than melanoma).

The standard treatments of cancer include chemotherapy, radiation and surgery, wherein these treatments are applied individually or in combination. Other treatments apply cancer immunotherapy which is focused on stimulating the immune system through vaccination or adoptive cellular immunotherapy to elicit an anti-tumor response.

Some approaches use gene therapy and genetic vaccination for treatment of cancer or other tumor diseases. Gene therapy and genetic vaccination are molecular medicine methods which are based on the introduction of nucleic acids into cells or into tissues of a patient. Subsequently the information coded by the nucleic acids introduced is processed in the organism, i.e. resulting in expression of a therapeutic peptide or protein or expression of an antigen which is coded by the nucleic acids.

Conventional gene therapeutic methods, including gene therapy and genetic vaccination are based on the use of DNA molecules in order to transfer the desired genetic information into the cell. Various methods have been developed for introducing DNA into cells, such as calcium phosphate transfection, polybrene transfection, protoplast fusion, electroporation, microinjection and lipofection. DNA viruses may likewise be used as a DNA vehicle achieving a very high transfection rate. The use of DNA entails the risk of the DNA being inserted into an intact gene of the host cell's genome by e.g. recombination. In this case the affected gene may be mutated and inactivated or may give rise to misinformation. Another risk of using DNA as a pharmaceutical agent is the risk of inducing pathogenic anti-drug antibodies (anti-DNA antibodies) in the patient, which may result in a (possibly fatal) immune response.

The use of RNA as a gene therapeutic agent or genetic vaccine is substantially safer, because RNA does not involve the risk of being integrated into the genome inducing an undesired pathogenic induction of anti-drug antibodies.

Thus RNA expression systems have considerable advantages over DNA expression systems in gene therapy and in genetic vaccination although it is known in the prior art or rather assumed for a long time that the instability of mRNA or of RNA in general may be problem in the application of medical methods based on RNA expression systems.

The instability of RNA is in particular due to RNA-degrading enzymes (ribonucleases-RNases). There are also many further processes which destabilize RNA, wherein interaction between the RNA and proteins often appears to play a crucial role. Some measures for increasing the stability of RNA have been proposed, so enabling the use thereof as a gene therapy agent or RNA vaccine.

For solving the problem of ex vivo RNA stability the European patent application EP 1 083 232 A1 describes a method for introducing RNA, in particular mRNA, into cells and organisms, in which the RNA forms a complex with a cationic peptide or protein.

The application of mRNA is known for the treatment and/or prophylaxis of cancer. For example the international patent application WO 03/051401 A2 describes a pharmaceutical composition comprising at least one mRNA, which contains at least one region that codes for an antigen from a tumor, combined with an aqueous solvent and preferably with a cytokine e.g. GM-CSF. The pharmaceutical composition is proposed to be used for therapy and/or prophylaxis against cancer.

The international patent application WO 2006/008154 A1 discloses an mRNA mixture for vaccinating against tumor diseases, wherein at least one type of mRNA contains at least one tumor antigen-coding region. At least one other mRNA contains at least one type of an immunogenic protein-coding region.

Nevertheless there is still a need for an effective treatment of tumor diseases and especially for the treatment of cancer. Therefore it is the object of the underlying invention to provide an approach for effective treatment of tumor diseases wherein tumor tissue and cancer cells are specifically destroyed.

This object is solved by the subject matter of the claims. Particularly, the object underlying the present invention is solved according to a first aspect by an RNA containing composition for use in the treatment or prophylaxis of tumor and/or cancer diseases. According to further aspects of the invention the object is solved by a pharmaceutical composition, by a kit or kit of parts, and by a method of treatment of tumor or cancer diseases.

DEFINITIONS

For the sake of clarity and readability the following scientific background information and definitions are provided. Any technical features disclosed thereby can be part of each and every embodiment of the invention. Additional definitions and explanations can be provided in the context of this disclosure.

Immune system: The immune system may protect organisms from infection. If a pathogen breaks through a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts contains so called humoral and cellular components.

Immune response: An immune response may typically either be a specific reaction of the adaptive immune system to a particular antigen (so called specific or adaptive immune response) or an unspecific reaction of the innate immune system (so called unspecific or innate immune response).

Adaptive immune system: The adaptive immune system is composed of highly specialized, systemic cells and processes that eliminate or prevent pathogenic growth. The adaptive immune response provides the vertebrate immune system with the ability to recognize and remember specific pathogens (to generate immunity), and to mount stronger attacks each time the pathogen is encountered. The system is highly adaptable because of somatic hypermutation (a process of increased frequency of somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of that cell will then inherit genes encoding the same receptor specificity, including the Memory B cells and Memory T cells that are the keys to long-lived specific immunity. Immune network theory is a theory of how the adaptive immune system works, that is based on interactions between the variable regions of the receptors of T cells, B cells and of molecules made by T cells and B cells that have variable regions.

Adaptive immune response: The adaptive immune response is typically understood to be antigen-specific. Antigen specificity allows for the generation of responses that are tailored to specific antigens, pathogens or pathogen-infected cells. The ability to mount these tailored responses is maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. Cell types that can serve as antigen-presenting cells are inter alia dendritic cells, macrophages, and B cells. Each of these cells has a distinct function in eliciting immune responses. Dendritic cells take up antigens by phagocytosis and macropinocytosis and are stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. Presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind antigen directly, but instead recognize short peptide fragments e.g. of pathogen-derived protein antigens, which are bound to MHC molecules on the surfaces of other cells.

Cellular immunity/cellular immune response: Cellular immunity relates typically to the activation of macrophages, natural killer cells (NK), antigen-specific cytotoxic T-lymphocytes, and the release of various cytokines in response to an antigen. In a more general way, cellular immunity is not related to antibodies but to the activation of cells of the immune system. A cellular immune response is characterized e.g. by activating antigen-specific cytotoxic T-lymphocytes that are able to induce apoptosis in body cells displaying epitopes of an antigen on their surface, such as virus-infected cells, cells with intracellular bacteria, and cancer cells displaying tumor antigens; activating macrophages and natural killer cells, enabling them to destroy pathogens; and stimulating cells to secrete a variety of cytokines that influence the function of other cells involved in adaptive immune responses and innate immune responses.

Humoral immunity/humoral immune response: Humoral immunity refers typically to antibody production and the accessory processes that may accompany it. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Innate immune system: The innate immune system, also known as non-specific immune system, comprises the cells and mechanisms that defend the host from infection by other organisms in a non-specific manner. This means that the cells of the innate system recognize and respond to pathogens in a generic way, but unlike the adaptive immune system, it does not confer long-lasting or protective immunity to the host. The innate immune system may be e.g. activated by ligands of pathogen-associated molecular patterns (PAMP) receptors, e.g. Toll-like receptors (TLRs) or other auxiliary substances such as lipopolysaccharides, TNF-alpha, CD40 ligand, or cytokines, monokines, lymphokines, interleukins or chemokines, immunostimulatory nucleic acids, immunostimulatory RNA (isRNA), CpG-DNA, antibacterial agents, or anti-viral agents. Typically a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system through a process known as antigen presentation; and/or acting as a physical and chemical barrier to infectious agents.

Adjuvant/adjuvant component: An adjuvant or an adjuvant component in the broadest sense is typically a (e.g. pharmacological or immunological) agent or composition that may modify, e.g. enhance, the efficacy of other agents, such as a drug or vaccine. Conventionally the term refers in the context of the invention to a compound or composition that serves as a carrier or auxiliary substance for immunogens and/or other pharmaceutically active compounds. It is to be interpreted in a broad sense and refers to a broad spectrum of substances that are able to increase the immunogenicity of antigens incorporated into or co-administered with an adjuvant in question. In the context of the present invention an adjuvant will preferably enhance the specific immunogenic effect of the active agents of the present invention. Typically, "adjuvant" or "adjuvant component" has the same meaning and can be used mutually. Adjuvants may be divided, e.g., into immuno potentiators, antigenic delivery systems or even combinations thereof.

The term "adjuvant" is typically understood not to comprise agents which confer immunity by themselves. An adjuvant assists the immune system unspecifically to enhance the antigen-specific immune response by e.g. promoting presentation of an antigen to the immune system or induction of an unspecific innate immune response. Furthermore, an adjuvant may preferably e.g. modulate the antigen-specific immune response by e.g. shifting the dominating Th2-based antigen specific response to a more Th1-based antigen specific response or vice versa. Accordingly, an adjuvant may favourably modulate cytokine expression/secretion, antigen presentation, type of immune response etc.

Immunostimulatory/immunostimulating RNA: An immunostimulatory/immunostimulating RNA (isRNA) in the context of the invention may typically be a RNA that is able to induce an innate immune response itself. It usually does not have an open reading frame and thus does not provide a peptide-antigen or immunogen but elicits an innate immune response e.g. by binding to a specific kind of Toll-like-receptor (TLR) or other suitable receptors. Therefore immunostimulatory/immunostimulating RNAs are preferably non-coding RNAs. However, of course also mRNAs having an open reading frame and coding for a peptide/protein (e.g. an antigenic function) may induce an innate immune response.

Antigen: The term "antigen" refers typically to a substance which may be recognized by the immune system and may be capable of triggering an antigen-specific immune response, e.g. by formation of antibodies or antigen-specific T-cells as part of an adaptive immune response. An antigen may be a protein or peptide. In this context, the first step of an adaptive immune response is the activation of naïve antigen-specific T cells by antigen-presenting cells. This occurs in the lymphoid tissues and organs through which naïve T cells are constantly passing. The three cell types that can serve as antigen-presenting cells are dendritic cells, macrophages, and B cells. Each of these cells has a distinct function in eliciting immune responses. Tissue dendritic cells take up antigens by phagocytosis and macropinocytosis and are stimulated by infection to migrate to the local lymphoid tissue, where they differentiate into mature dendritic cells. Macrophages ingest particulate antigens such as bacteria and are induced by infectious agents to express MHC class II molecules. The unique ability of B cells to bind and internalize soluble protein antigens via their receptors may be important to induce T cells. By presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which does not recognize and bind antigen directly, but instead recognize short peptide fragments e.g. of pathogens' protein antigens, which are bound to MHC molecules on the surfaces of other cells.

T cells fall into two major classes that have different effector functions. The two classes are distinguished by the expression of the cell-surface proteins CD4 and CD8. These two types of T cells differ in the class of MHC molecule that they recognize. There are two classes of MHC molecules—MHC class I and MHC class II molecules—which differ in their structure and expression pattern on tissues of the body. CD4+ T cells bind to a MHC class II molecule and CD8+ T cells to a MHC class I molecule. MHC class I and MHC class II molecules have distinct distributions among cells that reflect the different effector functions of the T cells that recognize them. MHC class I molecules present peptides of cytosolic and nuclear origin e.g. from pathogens, commonly viruses, to CD8+ T cells, which differentiate into cytotoxic T cells that are specialized to kill any cell that they specifically recognize. Almost all cells express MHC class I molecules, although the level of constitutive expression varies from one cell type to the next. But not only pathogenic peptides from viruses are presented by MHC class I molecules, also self-antigens like tumor antigens are presented by them. MHC class I molecules bind peptides from proteins degraded in the cytosol and transported in the endoplasmic reticulum. The CD8+ T cells that recognize MHC class I:peptide complexes at the surface of infected cells are specialized to kill any cells displaying foreign peptides and so rid the body of cells infected with viruses and other cytosolic pathogens. The main function of CD4+ T cells (CD4+ helper T cells) that recognize MHC class II molecules is to activate other effector cells of the immune system. Thus MHC class II molecules are normally found on B lymphocytes, dendritic cells, and macrophages, cells that participate in immune responses, but not on other tissue cells. Macrophages, for example, are activated to kill the intravesicular pathogens they harbour, and B cells to secrete immunoglobulins against foreign molecules. MHC class II molecules are prevented from binding to peptides in the endoplasmic reticulum and thus MHC class II molecules bind peptides from proteins which are degraded in endosomes. They can capture peptides from pathogens that have entered the vesicular system of macrophages, or from antigens internalized by immature dendritic cells or the immunoglobulin receptors of B cells. Pathogens that accumulate in large numbers inside macrophage and dendritic cell vesicles tend to stimulate the differentiation of Th1 cells, whereas extracellular antigens tend to stimulate the production of Th2 cells. Th1 cells activate the microbicidal properties of macrophages and induce B cells to make IgG antibodies that are very effective of opsonising extracellular pathogens for ingestion by phagocytic cells, whereas Th2 cells initiate the humoral response by activating naïve B cells to secrete IgM, and induce the production of weakly opsonising antibodies such as IgG1 and IgG3 (mouse) and IgG2 and IgG4 (human) as well as IgA and IgE (mouse and human).

Epitope (also called "antigen determinant"): T cell epitopes may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule. B cell epitopes are typically fragments located on the outer surface of (native) protein or peptide antigens.

Vaccine: A vaccine is typically understood to be a prophylactic or therapeutic material providing at least one antigen or antigenic function. The antigen or antigenic function may stimulate the body's adaptive immune system to provide an adaptive immune response.

Antigen-providing mRNA: An antigen-providing mRNA may typically be an mRNA, having at least one open reading frame that can be translated by a cell or an organism provided with that mRNA. The product of this translation is a peptide or protein that may act as an antigen, preferably as an immunogen. The product may also be a fusion protein composed of more than one immunogen, e.g. a fusion protein that consist of two or more epitopes, peptides or proteins, wherein the epitopes, peptides or proteins may be linked by linker sequences.

Bi-/multicistronic mRNA: An bi-/multicistronic mRNA typically may have two (bicistronic) or more (multicistronic) coding sequences (cds) (also often referred to as open reading frames (ORF)). A coding sequence/an open reading frame in this context is a sequence of several nucleotide triplets (codons) that can be translated into a peptide or protein. Translation of such an mRNA yields two (bicistronic) or more (multicistronic) distinct translation products (provided the coding sequences/ORFs are not identical). For expression in eukaryotes such mRNAs may for example comprise an internal ribosomal entry site (IRES) sequence.

5'-CAP-Structure: A 5'-CAP is typically a modified nucleotide (CAP analogue), particularly a guanine nucleotide, added to the 5' end of an mRNA molecule. Preferably, the 5'-CAP is added using a 5'-5'-triphosphate linkage (also named m7GpppN). Further examples of 5'-CAP structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-CAP structures may be used in the context of the present invention to modify the mRNA sequence of the inventive composition. Further modified 5'-CAP structures which may be used in the context of the present invention are CAP1 (additional methylation of the ribose of the adjacent nucleotide of m7GpppN), CAP2 (additional methylation of the ribose of the $2^{nd}$ nucleotide downstream of the m7GpppN), CAP3 (additional methylation of the ribose of the $3^{rd}$ nucleotide downstream of the m7GpppN), CAP4 (additional methylation of the ribose of the $4^{th}$ nucleotide downstream of the m7GpppN), ARCA (anti-reverse CAP analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

In the context of the present invention, a 5' cap structure may also be formed in chemical RNA synthesis or RNA in vitro transcription (co-transcriptional capping) using cap analogues, or a cap structure may be formed in vitro using capping enzymes (e.g., commercially available capping kits)

Cap analogue: A cap analogue refers to a non-polymerizable di-nucleotide that has cap functionality in that it facilitates translation or localization, and/or prevents degradation of the RNA molecule when incorporated at the 5' end of the RNA molecule. Non-polymerizable means that the cap analogue will be incorporated only at the 5'terminus because it does not have a 5' triphosphate and therefore cannot be extended in the 3' direction by a template-dependent RNA polymerase.

Cap analogues include, but are not limited to, a chemical structure selected from the group consisting of m7GpppG, m7GpppA, m7GpppC; unmethylated cap analogues (e.g., GpppG); dimethylated cap analogue (e.g., m2,7GpppG), trimethylated cap analogue (e.g., m2,2,7GpppG), dimethylated symmetrical cap analogues (e.g., m7Gpppm7G), or anti reverse cap analogues (e.g., ARCA; m7,2'OmeGpppG, m7,2'dGpppG, m7,3'OmeGpppG, m7,3'dGpppG and their tetraphosphate derivatives) (Stepinski et al., 2001. RNA 7(10):1486-95).

Further cap analogues have been described previously (U.S. Pat. No. 7,074,596, WO 2008/016473, WO 2008/157688, WO 2009/149253, WO 2011/015347, and WO 2013/059475). The synthesis of $N^7$-(4-chlorophenoxyethyl) substituted dinucleotide cap analogues has been described recently (Kore et al. (2013) Bioorg. Med. Chem. 21(15): 4570-4).

Fragments of proteins: "Fragments" of proteins or peptides in the context of the present invention may, typically, comprise a sequence of a protein or peptide as defined herein, which is, with regard to its amino acid sequence (or its encoded nucleic acid molecule), N-terminally and/or C-terminally truncated compared to the amino acid sequence of the original (native) protein (or its encoded nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. In the context of antigens such fragment may have a length of about 6 to about 20 or even more amino acids, e.g. fragments as processed and presented by MHC class I molecules, preferably having a length of about 8 to about 10 amino acids, e.g. 8, 9, or 10, (or even 6, 7, 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides (e.g. in the context of antigens) may comprise at least one epitope of those proteins or peptides. Furthermore also domains of a protein, like the extracellular domain, the intracellular domain or the transmembrane domain and shortened or truncated versions of a protein may be understood to comprise a fragment of a protein. Preferably, a fragment of a protein comprises a functional fragment of the protein, which means that the fragment exerts the same effect or functionality as the whole protein it is derived from.

Variants of proteins: "Variants" of proteins or peptides as defined in the context of the present invention may be generated, having an amino acid sequence which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam).

A "variant" of a protein or peptide may have at least 70%, 75%, 80%, 85%, 90%, 95%, 98% or 99% amino acid identity over a stretch of 10, 20, 30, 50, 75 or 100 amino acids of such protein or peptide. Furthermore, variants of proteins or peptides as defined herein, which may be encoded by a nucleic acid molecule, may also comprise those sequences, wherein nucleotides of the encoding nucleic acid sequence are exchanged according to the degeneration of the genetic code, without leading to an alteration of the respective amino acid sequence of the protein or peptide, i.e. the amino acid sequence or at least part thereof may not differ from the original sequence within the above meaning. Preferably, a variant of a protein comprises a functional variant of the protein, which means that the variant exerts the same effect or functionality as the protein it is derived from.

Identity of a sequence: In order to determine the percentage to which two sequences are identical, e.g. nucleic acid sequences or amino acid sequences as defined herein, preferably the amino acid sequences encoded by a nucleic acid sequence of the polymeric carrier as defined herein or the amino acid sequences themselves, the sequences can be aligned in order to be subsequently compared to one another. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Monocistronic mRNA: A monocistronic mRNA may typically be an mRNA, that comprises only one coding sequence (open reading frame). A coding sequence/open reading frame in this context is a sequence of several nucleotide triplets (codons) that can be translated into a peptide or protein.

Nucleic acid: The term nucleic acid means any DNA or RNA molecule and is used synonymous with polynucleotide. Wherever herein reference is made to a nucleic acid or nucleic acid sequence encoding a particular protein and/or peptide, said nucleic acid or nucleic acid sequence, respectively, preferably also comprises regulatory sequences allowing in a suitable host, e.g. a human being, its expression, i.e. transcription and/or translation of the nucleic acid sequence encoding the particular protein or peptide.

Peptide: A peptide is a polymer of amino acid monomers. Usually the monomers are linked by peptide bonds. The term "peptide" does not limit the length of the polymer chain of amino acids. In some embodiments of the present invention a peptide may for example contain less than 50 monomer units. Longer peptides are also called polypeptides, typically having 50 to 600 monomeric units, more specifically 50 to 300 monomeric units.

Pharmaceutically effective amount: A pharmaceutically effective amount in the context of the invention is typically understood to be an amount that is sufficient to induce an immune response or to trigger the desired therapeutical effect.

Protein: A protein typically consists of one or more peptides and/or polypeptides folded into 3-dimensional form, facilitating a biological function.

Poly(C) sequence: A poly(C) sequence is typically a long sequence of cytosine nucleotides, typically about 10 to about 200 cytosine nucleotides, preferably about 10 to about 100 cytosine nucleotides, more preferably about 10 to about 70 cytosine nucleotides or even more, preferably about 20 to about 50, or even about 20 to about 30 cytosine nucleotides. A poly(C) sequence may preferably be located 3' of the coding region comprised by a nucleic acid.

Poly(A) tail: A poly(A) tail also called "3'-poly(A) tail" or "Poly(A) sequence" is typically a long homopolymeric sequence of adenosine nucleotides of up to about 400 adenosine nucleotides, e.g. from about 25 to about 400, preferably from about 50 to about 400, more preferably from about 50 to about 300, even more preferably from about 50 to about 250, most preferably from about 60 to about 250 adenosine nucleotides, added to the 3' end of an mRNA. In the context of the present invention, the poly(A) tail of an mRNA is preferably derived from a DNA template by RNA in vitro transcription. Alternatively, the poly(A) sequence may also be obtained in vitro by common methods of chemical synthesis without being necessarily transcribed from a DNA-progenitor. Moreover, poly(A) sequences, or poly(A) tails may be generated by enzymatic polyadenylation of the RNA.

Stabilized nucleic acid: A stabilized nucleic acid, typically, exhibits a modification increasing resistance to in vivo degradation (e.g. degradation by an exo- or endo-nuclease) and/or ex vivo degradation (e.g. by the manufacturing process prior to vaccine administration, e.g. in the course of the preparation of the vaccine solution to be administered). Stabilization of RNA can, e.g., be achieved by providing a 5'-CAP-Structure, a poly(A) tail, or any other UTR-modification. It can also be achieved by backbone-modification or modification of the G/C-content or the C-content of the nucleic acid. Various other methods are known in the art and conceivable in the context of the invention.

Carrier/polymeric carrier: A carrier in the context of the invention may typically be a compound that facilitates transport and/or complexation of another compound. Said carrier may form a complex with said other compound. A polymeric carrier is a carrier that is formed of a polymer.

Cationic component: The term "cationic component" typically refers to a charged molecule, which is positively charged (cation) at a pH value of typically about 1 to 9, preferably of a pH value of or below 9 (e.g. 5 to 9), of or below 8 (e.g. 5 to 8), of or below 7 (e.g. 5 to 7), most preferably at physiological pH values, e.g. about 7.3 to 7.4. Accordingly, a cationic peptide, protein or polymer according to the present invention is positively charged under physiological conditions, particularly under physiological salt conditions of the cell in vivo. A cationic peptide or protein preferably contains a larger number of cationic amino acids, e.g. a larger number of Arg, His, Lys or Orn than other amino acid residues (in particular more cationic amino acids than anionic amino acid residues like Asp or Glu) or contains blocks predominantly formed by cationic amino acid residues. The definition "cationic" may also refer to "polycationic" components.

Vehicle: A vehicle is an agent, e.g. a carrier, that may typically be used within a pharmaceutical composition or vaccine for facilitating administering of the components of the pharmaceutical composition or vaccine to an individual.

3'-untranslated region (3'-UTR): A 3'-UTR is typically the part of an mRNA which is located between the protein coding region (i.e. the open reading frame) and the poly(A) sequence of the mRNA. A 3'-UTR of the mRNA is not translated into an amino acid sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-capping, splicing the pre-mature mRNA to excise optional introns and modifications of the 3'-end, such as polyadenylation of the 3'-end of the pre-mature mRNA and optional endo- or exonuclease cleavages etc. In the context of the present invention, a 3'-UTR corresponds to the sequence of a mature mRNA which is located 3' to the stop codon of the protein coding region, preferably immediately 3' to the stop codon of the protein coding region, and which extends to the 5'-side of the poly(A) sequence, preferably to the nucleotide immediately 5' to the poly(A) sequence. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", such as "a 3'-UTR of an albumin gene", is the sequence which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites or a 5'-Terminal Oligopyrimidine Tract. The 5'-UTR may be posttranscriptionally modified, for example by addition of a 5'-CAP. In the context of the present invention, a 5'UTR corresponds to the sequence of a mature mRNA which is located between the 5'-CAP and the start codon. Preferably, the 5'-UTR corresponds to the sequence which extends from a nucleotide located 3' to the 5'-CAP, preferably from the nucleotide located immediately 3' to the 5'-CAP, to a nucleotide located 5' to the start codon of the protein coding region, preferably to the nucleotide located immediately 5' to the start codon of the protein coding region. The nucleotide located immediately 3' to the 5'-CAP of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene", such as "a 5'-UTR of a TOP gene", is the sequence which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR.

5' Terminal Oligopyrimidine Tract (TOP): The 5' terminal oligopyrimidine tract (TOP) is typically a stretch of pyrimidine nucleotides located at the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. mRNA that contains a 5' terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5' TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5' end with a cytosine nucleotide. In TOP genes and TOP mRNAs, the TOP-motif preferably starts at its 5' end with the transcriptional start site and ends one nucleotide 5' to the first purine residue in said gene or mRNA. A TOP motif in the sense of the present invention is preferably located at the 5'end of a sequence which represents a 5'-UTR or at the 5' end of a sequence which codes for a 5'-UTR. Thus, preferably, a stretch of 3 or more pyrimidine nucleotides is called "TOP motif" in the sense of the present invention if this stretch is located at the 5' end of a respective sequence, such as the inventive mRNA, the 5'-UTR element of the inventive mRNA, or the nucleic acid sequence which is derived from the 5'-UTR of a TOP gene as described herein. In other words, a stretch of 3 or more pyrimidine nucleotides which is not located at the 5'-end of a 5'-UTR or a 5'-UTR element but anywhere within a 5'-UTR or a 5'-UTR element is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-CAP to the nucleotide located 5' to the start codon. A 5'-UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID Nos. 1-1363, SEQ ID NO. 1395, SEQ ID NO. 1421 and SEQ ID NO. 1422 of the international patent application WO2013/143700 or homologs or variants thereof, whose disclosure is incorporated herewith by reference. In this context a particularly preferred fragment of a 5'UTR of a TOP gene is a 5'-UTR of a TOP gene lacking the 5' TOP motif. The term '5'UTR of a TOP gene' preferably refers to the 5'-UTR of a naturally occurring TOP gene.

Chemical synthesis of RNA: Chemical synthesis of relatively short fragments of oligonucleotides with defined chemical structure provides a rapid and inexpensive access to custom-made oligonucleotides of any desired sequence. Whereas enzymes synthesize DNA and RNA only in the 5' to 3' direction, chemical oligonucleotide synthesis does not have this limitation, although it is most often carried out in the opposite, i.e. the 3' to 5' direction. Currently, the process is implemented as solid-phase synthesis using the phosphoramidite method and phosphoramidite building blocks derived from protected nucleosides (A, C, G, and U), or chemically modified nucleosides.

To obtain the desired oligonucleotide, the building blocks are sequentially coupled to the growing oligonucleotide chain on a solid phase in the order required by the sequence of the product in a fully automated process. Upon the completion of the chain assembly, the product is released from the solid phase to the solution, deprotected, and collected. The occurrence of side reactions sets practical limits for the length of synthetic oligonucleotides (up to about 200 nucleotide residues), because the number of errors increases with the length of the oligonucleotide being synthesized. Products are often isolated by HPLC to obtain the desired oligonucleotides in high purity.

Chemically synthesized oligonucleotides find a variety of applications in molecular biology and medicine. They are most commonly used as antisense oligonucleotides, small interfering RNA, primers for DNA sequencing and amplification, probes for detecting complementary DNA or RNA via molecular hybridization, tools for the targeted introduction of mutations and restriction sites, and for the synthesis of artificial genes.

RNA In vitro transcription: The terms "RNA in vitro transcription" or "in vitro transcription" relate to a process wherein RNA is synthesized in a cell-free system (in vitro). DNA, particularly plasmid DNA, is used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Methods for in vitro transcription are known in the art (see, e.g., Geall et al. (2013) Semin. Immunol. 25(2): 152-159; Brunelle et al. (2013) Methods Enzymol. 530:101-14). Reagents used in said method typically include:

1) a linearized DNA template with a promoter sequence that has a high binding affinity for its respective RNA polymerase such as bacteriophage-encoded RNA polymerases;

2) ribonucleoside triphosphates (NTPs) for the four bases (adenine, cytosine, guanine and uracil);

3) optionally a cap analogue as defined above (e.g. m7G(5')ppp(5')G (m7G));

4) a DNA-dependent RNA polymerase capable of binding to the promoter sequence within the linearized DNA template (e.g. T7, T3 or SP6 RNA polymerase);

5) optionally a ribonuclease (RNase) inhibitor to inactivate any contaminating RNase;

6) optionally a pyrophosphatase to degrade pyrophosphate, which may inhibit transcription;

7) $MgCl_2$, which supplies $Mg^{2+}$ ions as a co-factor for the polymerase;

8) a buffer to maintain a suitable pH value, which can also contain antioxidants (e.g. DTT), and/or polyamines such as spermidine at optimal concentrations.

RNA, mRNA: RNA is the usual abbreviation for ribonucleic acid. It is a nucleic acid molecule, i.e. a polymer consisting of nucleotide monomers. These nucleotides are usually adenosine monophosphate (AMP), uridine monophosphate (UMP), guanosine monophosphate (GMP) and cytidine monophosphate (CMP) monomers or analogues thereof, which are connected to each other along a so-called backbone. The backbone is formed by phosphodiester bonds between the sugar, i.e. ribose, of a first and a phosphate moiety of a second, adjacent monomer. The specific order of the monomers, i.e. the order of the bases linked to the sugar/phosphate-backbone, is called the RNA sequence. Usually RNA may be obtainable by transcription of a DNA sequence, e.g., inside a cell. In eukaryotic cells, transcription is typically performed inside the nucleus or the mitochondria. In vivo, transcription of DNA usually results in the so-called premature RNA (also called pre-mRNA, precursor mRNA or heterogeneous nuclear RNA) which has to be processed into so-called messenger RNA, usually abbreviated as mRNA. Processing of the premature RNA, e.g. in eukaryotic organisms, comprises a variety of different post-transcriptional modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino acid sequence of a particular peptide or protein. Typically, a mature mRNA comprises a 5'-cap, optionally a 5'UTR, an open reading frame, optionally a 3'UTR and a poly(A) tail.

In addition to messenger RNA, several non-coding types of RNA exist which may be involved in regulation of transcription and/or translation, and immunostimulation. Within the present invention the term "RNA" further encompasses any type of single stranded (ssRNA) or double stranded RNA (d5RNA) molecule known in the art, such as viral RNA, retroviral RNA and replicon RNA, small interfering RNA (siRNA), antisense RNA (asRNA), circular RNA (circRNA), ribozymes, aptamers, riboswitches, immunostimulating/immunostimulatory RNA, transfer RNA (tRNA), ribosomal RNA (rRNA), small nuclear RNA (snRNA), small nucleolar RNA (snoRNA), microRNA (miRNA), and Piwi-interacting RNA (piRNA).

Fragment of a nucleic acid sequence, particularly an RNA: A fragment of a nucleic acid sequence consists of a continuous stretch of nucleotides corresponding to a continuous stretch of nucleotides in the full-length nucleic acid sequence which is the basis for the nucleic acid sequence of the fragment, which represents at least 20%, preferably at least 30%, more preferably at least 40%, more preferably at least 50%, even more preferably at least 60%, even more preferably at least 70%, even more preferably at least 80%, and most preferably at least 90% of the full-length nucleic acid sequence. Such a fragment, in the sense of the present invention, is preferably a functional fragment of the full-length nucleic acid sequence.

Variant of a nucleic acid sequence, particularly an RNA: A variant of a nucleic acid sequence refers to a variant of nucleic acid sequences which forms the basis of a nucleic acid sequence. For example, a variant nucleic acid sequence may exhibit one or more nucleotide deletions, insertions, additions and/or substitutions compared to the nucleic acid sequence from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 95%, 98% or 99% nucleotide identity over a stretch of 10, 20, 30, 50, 75 or 100 nucleotide of such nucleic acid sequence.

Intratumoral administration/application: The term "intratumoral administration/application" refers to the direct delivery of a pharmaceutical composition into or adjacent to a tumor or cancer and/or immediate vicinity of a tumor or cancer. Multiple injections into separate regions of the tumor or cancer are also included. Furthermore, intratumoral administration/application includes delivery of a pharmaceutical composition into one or more metastases.

Methods for intratumoral delivery of drugs are known in the art (Brincker, 1993. Crit. Rev. Oncol. Hematol. 15(2): 91-8; Celikoglu et al., 2008. Cancer Therapy 6, 545-552). For example, the pharmaceutical composition can be administered by conventional needle injection, needle-free jet injection or electroporation or combinations thereof into the tumor or cancer tissue. The pharmaceutical composition can be injected directly into the tumor or cancer (tissue) with great precision using computer tomograpy, ultrasound, gamma camera imaging, positron emission tomography, or magnetic resonance tumor imaging. Further procedures are selected from the group including, but not limited to, direct intratumoral injection by endoscopy, bronchoscopy, cystoscopy, colonoscopy, laparoscope and catheterization.

Decoy receptors: Decoy receptors recognize certain growth factors or cytokines with high affinity and specificity, but are structurally incapable of signaling or presenting the agonist to signaling receptor complexes. They act as a molecular trap for the agonist and for signaling receptor components. A decoy receptor, or sink receptor, is a receptor that binds a ligand, inhibiting it from binding to its normal receptor. For instance, the receptor VEGFR-1 can prevent vascular endothelial growth factor (VEGF) from binding to the VEGFR-2.

Dominant negative receptors: Dominant negative receptors are variants of the particular receptor comprising dominant-negative (DN) mutations as leading to mutant polypeptides that disrupt the activity of the wild-type receptor when overexpressed.

DETAILED DESCRIPTION OF THE INVENTION

The RNA containing composition according to the invention comprises at least one RNA and is particularly provided for use in the treatment or prophylaxis of tumor and/or cancer diseases, wherein the RNA containing composition is preferably applied/administered intratumorally. It is especially preferred that the RNA containing composition is injected directly into tumor tissue. Alternatively, it is especially preferred that the RNA containing composition is injected adjacent to or in close proximity to a tumor tissue and/or metastasis.

It has been found by the inventors that intratumoral application respectively administration of the RNA containing composition according to the invention is capable of effectively treating tumor and/or cancer diseases and related disorders. It has been shown that intratumoral application is surprisingly effective in decreasing tumor size. Moreover the application of the RNA containing composition according to the invention was able to increase survival in animal models.

The at least one RNA of the RNA containing composition may be selected from the group consisting of chemically modified or unmodified RNA, single-stranded or double-stranded RNA, coding or non-coding RNA, mRNA, oligoribonucleotide, viral RNA, retroviral RNA, replicon RNA, tRNA, rRNA, immunostimulatory RNA, microRNA, siRNA, small nuclear RNA (snRNA), small-hairpin (sh) RNA riboswitch, RNA aptamer, RNA decoy, antisense RNA, a ribozyme, or any combination thereof. In specific embodiments the at least one RNA of the RNA containing composition is selected from a coding RNA or a non-coding RNA.

Coding RNA:

According to a preferred embodiment of the invention the at least one RNA of the RNA containing composition comprises at least one coding region encoding at least one peptide or protein. Preferably, the coding RNA is selected from the group consisting of mRNA, viral RNA, retroviral RNA, and replicon RNA.

In preferred embodiments of the invention the at least one RNA of the RNA containing composition codes for at least one cytokine and/or for at least one chemokine and/or for at least one suicide gene product, and/or at least one immunogenic protein or peptide and/or for at least one cell death/apoptosis inducer and/or for at least one angiogenesis inhibitor and/or for at least one heat shock protein and/or for at least one tumor antigen and/or for at least one β-catenin inhibitor and/or for at least one activator of the STING (stimulator of interferon genes) pathway and/or at least one checkpoint modulator and/or at least one antibody, and/or at least one dominant negative receptor, and/or at least one decoy receptor, and/or at least one inhibitor of myeloid derived suppressor cells (MDSCs), and/or at least one IDO pathway inhibitor, and/or at least one protein or peptide that bind inhibitors of apoptosis, or fragments or variants thereof as will be outlined in more detail below.

1. Cytokines

In a preferred embodiment of the inventive RNA containing composition the RNA comprises at least one coding region that codes for at least one cytokine, or a fragment or variant thereof.

Preferably the cytokine is an interleukin (IL). One or more interleukins may be chosen e.g. from the following list: IL-1α, IL-1β, IL-1ra (antagonist), IL-2, IL-3, IL-4, IL-5, IL-6, IL-7, IL-8, IL-9, IL-10; IL-11, IL-12, IL-13, IL14, IL-15, IL-16, IL-17A, IL-17B, EL-17C, IL-17D, IL-17E, IL-17F, IL-18, IL-19, IL-20, IL-21, IL-22, IL-23, IL-24, IL-25, IL-26, IL-27, IL-28A/B, IL-29, IL-30, IL-31, IL-32, IL-33, IL-35. Moreover the cytokine may be one or more cytokines chosen from the TNF family, e.g. chosen from the following list: TNF, especially TNFα, LTα, LTβ, LIGHT, TWEAK, APRIL, BAFF, TL1A, GITRL, OX40L, CD40L (CD154), FASL, CD27L, CD30L, 4-1BBL, TRAIL, RANK ligand. Further examples of preferred cytokines may be chosen from the following list: FLT3 ligand, G-CSF, GM-CSF, IFNα/β/ω, IFNγ, LIF, M-CSF, MIF, OSM, Stem Cell Factor, TGFβ1, TGFβ2, TGFβ3, TSLP ligand.

Particularly preferred are cytokines chosen from the following list: IL-12, IL-15, IL-2, IFNγ, TNFα, IL-18, IFNα, IL-1β, IL-32, IL-7, IL-21, IL-8, GM-CSF.

In an especially preferred embodiment of the invention the RNA of the inventive composition codes for Interleukin-12 or CD40L. It has been shown by the inventors, that mRNA coding for this cytokines is especially effective when applied in the inventive approach. Particularly preferred are RNA sequences according to SEQ ID Nos. 1, 3, 4194, 4195, 4196, 4197, 4198, 4199, 4200 encoding IL-12. Furthermore RNA sequences according to SEQ ID Nos. 3898, 3899, 3900, 3901, 3902, 3903, 3904, 10073, encoding CD40L are particularly preferred.

According to preferred embodiments in the context of the present invention cytokines may be selected from any cytokine selected from the group consisting of 4-1BBL; Apo2L/TRAIL; APRIL; BAFF; CD27L; CD30L; CD40L_(CD154); CXCL8; EL-17C; FasL; FLT3_ligand; G-CSF; GITRL; GM-CSF; IFNalpha; IFNB; IFNG; IFNomega; IL-1_alpha; IL-1_beta; IL-10; IL-11; IL-12; IL-12A; IL-13; IL-14; IL-15; IL-16; IL-17A; IL-17B; IL-17D; IL-17F; IL-18; IL-19; IL-1ra_(antagonist); IL-2; IL-20; IL-21; IL-22; IL-23; IL-24; IL-25; IL-26; IL-27A; IL-27B; IL-28A; IL-28B; IL-29; IL-3; IL-31; IL-32; IL-33; IL-37; IL-4; IL-5; IL-6; IL-7; IL-9; LIF; LIGHT; LTalpha; LTbeta; M-CSF; MIF; OSM; OX40L; RANK_ligand; Stem_Cell_Factor; TGFbeta1; TGFbeta2; TGFbeta3; TL1A; TNF; TWEAK, preferably as disclosed in Table 1. Particularly preferred in this context are the RNA sequences encoding a cytokine according to Table 1.

TABLE 1

Cytokines:

| Gene Name | Protein Accession No. | Protein Sequence SEQ ID NO: | RNA Sequence wild type SEQ ID NO: | Optimized RNA Sequence SEQ ID NO: |
|---|---|---|---|---|
| 4-1BBL | UniProtKB: P41273 | 3849 | 3850 | 3851, 3852, 3853, 3854, 3855, 3856 |
| APRIL | UniProtKB: O75888 | 3857 | 3858 | 3859, 3860, 3861, 3862, 3863, 3864 |
| BAFF | UniProtKB: Q5H8V1 | 3865 | 3866 | 3867, 3868, 3869, 3870, 3871, 3872 |
| BAFF | UniProtKB: Q9Y275 | 3873 | 3874 | 3875, 3876, 3877, 3878, 3879, 3880 |
| CD27L | UniProtKB: P32970 | 3881 | 3882 | 3883, 3884, 3885, 3886, 3887, 3888 |
| CD30L | UniProtKB: P32971 | 3889 | 3890 | 3891, 3892, 3893, 3894, 3895, 3896 |
| CD40L_(CD154) | UniProtKB: P29965 | 3897 | 3898 | 3899, 3900, 3901, 3902, 3903, 3904 |
| EL-17C | UniProtKB: Q9P0M4 | 3905 | 3906 | 3907, 3908, 3909, 3910, 3911, 3912 |
| FLT3_ligand | Genbank: AAA90950.1 | 3913 | 3914 | 3915, 3916, 3917, 3918, 3919, 3920 |
| FLT3_ligand | UniProtKB: P49771 | 3921 | 3922 | 3923, 3924, 3925, 3926, 3927, 3928 |
| G-CSF | UniProtKB: P09919 | 3929 | 3930 | 3931, 3932, 3933, 3934, 3935, 3936 |

TABLE 1-continued

Cytokines:

| Gene Name | Protein Accession No. | Protein Sequence SEQ ID NO: | RNA Sequence wild type SEQ ID NO: | Optimized RNA Sequence SEQ ID NO: |
|---|---|---|---|---|
| GITRL | UniProtKB: Q9UNG2 | 3937 | 3938 | 3939, 3940, 3941, 3942, 3943, 3944 |
| GM-CSF | UniProtKB: P04141 | 3945 | 3946 | 3947, 3948, 3949, 3950, 3951, 3952 |
| IFNalpha | UniProtKB: G9JKF1 | 3953 | 3954 | 3955, 3956, 3957, 3958, 3959, 3960 |
| IFNalpha | UniProtKB: P01562 | 3961 | 3962 | 3963, 3964, 3965, 3966, 3967, 3968 |
| IFNalpha | UniProtKB: P01563 | 3969 | 3970 | 3971, 3972, 3973, 3974, 3975, 3976 |
| IFNalpha | UniProtKB: P01566 | 3977 | 3978 | 3979, 3980, 3981, 3982, 3983, 3984 |
| IFNalpha | UniProtKB: P01567 | 3985 | 3986 | 3987, 3988, 3989, 3990, 3991, 3992 |
| IFNalpha | UniProtKB: P01568 | 3993 | 3994 | 3995, 3996, 3997, 3998, 3999, 4000 |
| IFNalpha | UniProtKB: P01569 | 4001 | 4002 | 4003, 4004, 4005, 4006, 4007, 4008 |
| IFNalpha | UniProtKB: P01570 | 4009 | 4010 | 4011, 4012, 4013, 4014, 4015, 4016 |
| IFNalpha | UniProtKB: P01571 | 4017 | 4018 | 4019, 4020, 4021, 4022, 4023, 4024 |
| IFNalpha | UniProtKB: P05013 | 4025 | 4026 | 4027, 4028, 4029, 4030, 4031, 4032 |
| IFNalpha | UniProtKB: P05014 | 4033 | 4034 | 4035, 4036, 4037, 4038, 4039, 4040 |
| IFNalpha | UniProtKB: P05015 | 4041 | 4042 | 4043, 4044, 4045, 4046, 4047, 4048 |
| IFNalpha | UniProtKB: P32881 | 4049 | 4050 | 4051, 4052, 4053, 4054, 4055, 4056 |
| IFNalpha | UniProtKB: Q14618 | 4057 | 4058 | 4059, 4060, 4061, 4062, 4063, 4064 |
| IFNalpha | UniProtKB: Q86UP4 | 4065 | 4066 | 4067, 4068, 4069, 4070, 4071, 4072 |
| IFNB | UniProtKB: P01574 | 4073 | 4074 | 4075, 4076, 4077, 4078, 4079, 4080 |
| IFNB | UniProtKB: Q15943 | 4081 | 4082 | 4083, 4084, 4085, 4086, 4087, 4088 |
| IFNG | UniProtKB: P01579 | 4089 | 4090 | 4091, 4092, 4093, 4094, 4095, 4096 |
| IFNG | UniProtKB: Q14609 | 4097 | 4098 | 4099, 4100, 4101, 4102, 4103, 4104 |
| IFNG | UniProtKB: Q14610 | 4105 | 4106 | 4107, 4108, 4109, 4110, 4111, 4112 |
| IFNG | UniProtKB: Q14611 | 4113 | 4114 | 4115, 4116, 4117, 4118, 4119, 4120 |
| IFNG | UniProtKB: Q14612 | 4121 | 4122 | 4123, 4124, 4125, 4126, 4127, 4128 |
| IFNG | UniProtKB: Q14613 | 4129 | 4130 | 4131, 4132, 4133, 4134, 4135, 4136 |
| IFNG | UniProtKB: Q14614 | 4137 | 4138 | 4139, 4140, 4141, 4142, 4143, 4144 |
| IFNG | UniProtKB: Q14615 | 4145 | 4146 | 4147, 4148, 4149, 4150, 4151, 4152 |
| IFNG | UniProtKB: Q8NHY9 | 4153 | 4154 | 4155, 4156, 4157, 4158, 4159, 4160 |
| IFNomega | UniProtKB: P05000 | 4161 | 4162 | 4163, 4164, 4165, 4166, 4167, 4168 |
| IL-10 | UniProtKB: P22301 | 4169 | 4170 | 4171, 4172, 4173, 4174, 4175, 4176 |
| IL-11 | UniProtKB: P20809 | 4177 | 4178 | 4179, 4180, 4181, 4182, 4183, 4184 |
| IL-12A | UniProtKB: P29459 | 4185 | 4186 | 4187, 4188, 4189, 4190, 4191, 4192 |
| IL-12 | UniProtKB: P29460 | 4193 | 4194 | 4195, 4196, 4197, 4198, 4199, 4200 |
| IL-13 | UniProtKB: P35225 | 4201 | 4202 | 4203, 4204, 4205, 4206, 4207, 4208 |
| IL-14 | UniProtKB: P40222 | 4209 | 4210 | 4211, 4212, 4213, 4214, 4215, 4216 |
| IL-15 | UniProtKB: P40933 | 4217 | 4218 | 4219, 4220, 4221, 4222, 4223, 4224 |

TABLE 1-continued

Cytokines:

| Gene Name | Protein Accession No. | Protein Sequence SEQ ID NO: | RNA Sequence wild type SEQ ID NO: | Optimized RNA Sequence SEQ ID NO: |
|---|---|---|---|---|
| IL-16 | UniProtKB: Q14005 | 4225 | 4226 | 4227, 4228, 4229, 4230, 4231, 4232 |
| IL-17A | UniProtKB: Q16552 | 4233 | 4234 | 4235, 4236, 4237, 4238, 4239, 4240 |
| IL-17B | UniProtKB: Q9NRM6 | 4241 | 4242 | 4243, 4244, 4245, 4246, 4247, 4248 |
| IL-17B | UniProtKB: Q9UHF5 | 4249 | 4250 | 4251, 4252, 4253, 4254, 4255, 4256 |
| IL-17D | UniProtKB: Q8TAD2 | 4257 | 4258 | 4259, 4260, 4261, 4262, 4263, 4264 |
| IL-17F | UniProtKB: F1JZ09 | 4265 | 4266 | 4267, 4268, 4269, 4270, 4271, 4272 |
| IL-17F | UniProtKB: Q96PD4 | 4273 | 4274 | 4275, 4276, 4277, 4278, 4279, 4280 |
| IL-18 | UniProtKB: A0A024R3E0 | 4281 | 4282 | 4283, 4284, 4285, 4286, 4287, 4288 |
| IL-18 | UniProtKB: B0YJ28 | 4289 | 4290 | 4291, 4292, 4293, 4294, 4295, 4296 |
| IL-18 | UniProtKB: Q14116 | 4297 | 4298 | 4299, 4300, 4301, 4302, 4303, 4304 |
| IL-19 | UniProtKB: Q9UHD0 | 4305 | 4306 | 4307, 4308, 4309, 4310, 4311, 4312 |
| IL-1_alpha | UniProtKB: P01583 | 4313 | 4314 | 4315, 4316, 4317, 4318, 4319, 4320 |
| IL-1_beta | UniProtKB: P01584 | 4321 | 4322 | 4323, 4324, 4325, 4326, 4327, 4328 |
| IL-1ra_(antagonist) | UniProtKB: P18510-2 | 4329 | 4330 | 4331, 4332, 4333, 4334, 4335, 4336 |
| IL-1ra_(antagonist) | UniProtKB: P18510-3 | 4337 | 4338 | 4339, 4340, 4341, 4342, 4343, 4344 |
| IL-1ra_(antagonist) | UniProtKB: P18510 | 4345 | 4346 | 4347, 4348, 4349, 4350, 4351, 4352 |
| IL-20 | UniProtKB: Q9NYY1 | 4353 | 4354 | 4355, 4356, 4357, 4358, 4359, 4360 |
| IL-21 | RefSeq: NP_001193935.1 | 4361 | 4362 | 4363, 4364, 4365, 4366, 4367, 4368 |
| IL-21 | RefSeq: NP_068575.1 | 4369 | 4370 | 4371, 4372, 4373, 4374, 4375, 4376 |
| IL-22 | UniProtKB: Q9GZX6 | 4377 | 4378 | 4379, 4380, 4381, 4382, 4383, 4384 |
| IL-23 | UniProtKB: Q9NPF7 | 4385 | 4386 | 4387, 4388, 4389, 4390, 4391, 4392 |
| IL-24 | UniProtKB: Q13007 | 4393 | 4394 | 4395, 4396, 4397, 4398, 4399, 4400 |
| IL-24 | UniProtKB: Q2YHE6 | 4401 | 4402 | 4403, 4404, 4405, 4406, 4407, 4408 |
| IL-25 | UniProtKB: Q969H8 | 4409 | 4410 | 4411, 4412, 4413, 4414, 4415, 4416 |
| IL-25 | UniProtKB: Q9H293 | 4417 | 4418 | 4419, 4420, 4421, 4422, 4423, 4424 |
| IL-26 | UniProtKB: Q9NPH9 | 4425 | 4426 | 4427, 4428, 4429, 4430, 4431, 4432 |
| IL-27A | UniProtKB: Q8NEV9 | 4433 | 4434 | 4435, 4436, 4437, 4438, 4439, 4440 |
| IL-27B | UniProtKB: Q14213 | 4441 | 4442 | 4443, 4444, 4445, 4446, 4447, 4448 |
| IL-28A | UniProtKB: Q8IZJ0 | 4449 | 4450 | 4451, 4452, 4453, 4454, 4455, 4456 |
| IL-28B | UniProtKB: Q8IZI9 | 4457 | 4458 | 4459, 4460, 4461, 4462, 4463, 4464 |
| IL-29 | UniProtKB: Q8IU54 | 4465 | 4466 | 4467, 4468, 4469, 4470, 4471, 4472 |
| IL-2 | UniProtKB: P60568 | 4473 | 4474 | 4475, 4476, 4477, 4478, 4479, 4480 |
| IL-2 | UniProtKB: Q0GK43 | 4481 | 4482 | 4483, 4484, 4485, 4486, 4487, 4488 |
| IL-2 | UniProtKB: Q13169 | 4489 | 4490 | 4491, 4492, 4493, 4494, 4495, 4496 |
| IL-2 | UniProtKB: Q6NZ91 | 4497 | 4498 | 4499, 4500, 4501, 4502, 4503, 4504 |
| IL-2 | UniProtKB: Q6NZ93 | 4505 | 4506 | 4507, 4508, 4509, 4510, 4511, 4512 |

TABLE 1-continued

Cytokines:

| Gene Name | Protein Accession No. | Protein Sequence SEQ ID NO: | RNA Sequence wild type SEQ ID NO: | Optimized RNA Sequence SEQ ID NO: |
|---|---|---|---|---|
| IL-31 | UniProtKB: Q6EBC2 | 4513 | 4514 | 4515, 4516, 4517, 4518, 4519, 4520 |
| IL-32 | UniProtKB: P24001 | 4521 | 4522 | 4523, 4524, 4525, 4526, 4527, 4528 |
| IL-33 | UniProtKB: O95760 | 4529 | 4530 | 4531, 4532, 4533, 4534, 4535, 4536 |
| IL-37 | UniProtKB: Q9NZH6 | 4537 | 4538 | 4539, 4540, 4541, 4542, 4543, 4544 |
| IL-3 | UniProtKB: P08700 | 4545 | 4546 | 4547, 4548, 4549, 4550, 4551, 4552 |
| IL-3 | UniProtKB: Q6NZ78 | 4553 | 4554 | 4555, 4556, 4557, 4558, 4559, 4560 |
| IL-3 | UniProtKB: Q6NZ79 | 4561 | 4562 | 4563, 4564, 4565, 4566, 4567, 4568 |
| IL-4 | UniProtKB: P05112-2 | 4569 | 4570 | 4571, 4572, 4573, 4574, 4575, 4576 |
| IL-4 | UniProtKB: P05112 | 4577 | 4578 | 4579, 4580, 4581, 4582, 4583, 4584 |
| IL-5 | UniProtKB: P05113 | 4585 | 4586 | 4587, 4588, 4589, 4590, 4591, 4592 |
| IL-6 | UniProtKB: P05231 | 4593 | 4594 | 4595, 4596, 4597, 4598, 4599, 4600 |
| IL-7 | UniProtKB: A8K673 | 4601 | 4602 | 4603, 4604, 4605, 4606, 4607, 4608 |
| IL-7 | UniProtKB: P13232 | 4609 | 4610 | 4611, 4612, 4613, 4614, 4615, 4616 |
| IL-9 | UniProtKB: P15248 | 4617 | 4618 | 4619, 4620, 4621, 4622, 4623, 4624 |
| LIF | UniProtKB: P15018 | 4625 | 4626 | 4627, 4628, 4629, 4630, 4631, 4632 |
| LIGHT | UniProtKB: O43557 | 4633 | 4634 | 4635, 4636, 4637, 4638, 4639, 4640 |
| LTalpha | UniProtKB: B4DVZ8 | 4641 | 4642 | 4643, 4644, 4645, 4646, 4647, 4648 |
| LTalpha | UniProtKB: P01374 | 4649 | 4650 | 4651, 4652, 4653, 4654, 4655, 4656 |
| LTalpha | UniProtKB: P09960 | 4657 | 4658 | 4659, 4660, 4661, 4662, 4663, 4664 |
| LTalpha | UniProtKB: Q5ST95 | 4665 | 4666 | 4667, 4668, 4669, 4670, 4671, 4672 |
| LTalpha | UniProtKB: Q5STV3 | 4673 | 4674 | 4675, 4676, 4677, 4678, 4679, 4680 |
| LTalpha | UniProtKB: Q6FG55 | 4681 | 4682 | 4683, 4684, 4685, 4686, 4687, 4688 |
| LTbeta | UniProtKB: Q06643 | 4689 | 4690 | 4691, 4692, 4693, 4694, 4695, 4696 |
| LTbeta | UniProtKB: Q5STB2 | 4697 | 4698 | 4699, 4700, 4701, 4702, 4703, 4704 |
| M-CSF | UniProtKB: P09603 | 4705 | 4706 | 4707, 4708, 4709, 4710, 4711, 4712 |
| MIF | UniProtKB: A6MUU8 | 4713 | 4714 | 4715, 4716, 4717, 4718, 4719, 4720 |
| MIF | UniProtKB: P14174 | 4721 | 4722 | 4723, 4724, 4725, 4726, 4727, 4728 |
| OSM | UniProtKB: P13725 | 4729 | 4730 | 4731, 4732, 4733, 4734, 4735, 4736 |
| OX40L | UniProtKB: P23510 | 4737 | 4738 | 4739, 4740, 4741, 4742, 4743, 4744 |
| OX40L | UniProtKB: P43489 | 4745 | 4746 | 4747, 4748, 4749, 4750, 4751, 4752 |
| RANK_ligand | UniProtKB: O14788 | 4753 | 4754 | 4755, 4756, 4757, 4758, 4759, 4760 |
| Stem_Cell_Factor | UniProtKB: P21583-2 | 4761 | 4762 | 4763, 4764, 4765, 4766, 4767, 4768 |
| Stem_Cell_Factor | UniProtKB: P21583 | 4769 | 4770 | 4771, 4772, 4773, 4774, 4775, 4776 |
| TGFbeta1 | UniProtKB: A0A024R0P8 | 4777 | 4778 | 4779, 4780, 4781, 4782, 4783, 4784 |
| TGFbeta1 | UniProtKB: P01137 | 4785 | 4786 | 4787, 4788, 4789, 4790, 4791, 4792 |
| TGFbeta2 | UniProtKB: P61812 | 4793 | 4794 | 4795, 4796, 4797, 4798, 4799, 4800 |

TABLE 1-continued

Cytokines:

| Gene Name | Protein Accession No. | Protein Sequence SEQ ID NO: | RNA Sequence wild type SEQ ID NO: | Optimized RNA Sequence SEQ ID NO: |
|---|---|---|---|---|
| TGFbeta3 | UniProtKB: A5YM40 | 4801 | 4802 | 4803, 4804, 4805, 4806, 4807, 4808 |
| TGFbeta3 | UniProtKB: P10600 | 4809 | 4810 | 4811, 4812, 4813, 4814, 4815, 4816 |
| TL1A | UniProtKB: O95150 | 4817 | 4818 | 4819, 4820, 4821, 4822, 4823, 4824 |
| TWEAK | UniProtKB: Q4ACW9 | 4825 | 4826 | 4827, 4828, 4829, 4830, 4831, 4832 |
| CXCL8 | UniProtKB: P10145 | 5265 | 5266 | 5267, 5268, 5269, 5270, 5271, 5272 |
| Apo2L/TRAIL | UniProtKB: P50591 | 6897 | 6898 | 6899, 6900, 6901, 6902, 6903, 6904 |
| FasL | UniProtKB: P48023 | 7321 | 7322 | 7323, 7324, 7325, 7326, 7327, 7328 |
| TNF | UniProtKB: P01375 | 7369 | 7370 | 7371, 7372, 7373, 7374, 7375, 7376 |
| TNF | UniProtKB: Q5STB3 | 7377 | 7378 | 7379, 7380, 7381, 7382, 7383, 7384 |

According to the present invention, in a more preferred embodiment, the inventive composition comprises at least one RNA, preferably an mRNA comprising at least one coding region encoding at least one cytokine or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 1.

2. Chemokines:

In a further preferred embodiment of the inventive RNA containing composition the RNA comprises at least one coding region that codes for at least one chemokine, or a fragment or variant thereof.

Chemokines are chemotactic cytokines that control the migratory patterns and positioning of immune cells, as reviewed by Griffith et al., 2014. Annu. Rev. Immunol. 32:659-702 (PMID 24655300). Chemokine function is critical for all immune cell movement ranging from the migration required for immune cell development and homeostasis, to that required for the generation of primary and amnestic cellular and humoral immune responses, to the pathologic recruitment of immune cells in disease. Chemokines constitute the largest family of cytokines, consisting of approximately 50 endogenous chemokine ligands in humans and mice.

According to preferred embodiments in the context of the present invention chemokines may be selected from any chemokine selected from the group consisting of CCL1; CCL11; CCL12; CCL13; CCL14; CCL15; CCL16; CCL17; CCL18; CCL19; CCL2; CCL20; CCL21; CCL22; CCL24; CCL25; CCL26; CCL27; CCL28; CCL3; CCL4; CCL5; CCL6; CCL7; CCL8; CCL9; CX3CL1; CXCL1; CXCL10; CXCL11; CXCL12; CXCL13; CXCL14; CXCL15; CXCL2; CXCL3; CXCL4; CXCL5; CXCL6; CXCL7; CXCL8; CXCL9; XCL1; XCL2, preferably as disclosed in Table 2. Particularly preferred in this context are the RNA sequences encoding a chemokine according to Table 2.

TABLE 2

Chemokines

| Gene Name | Protein Accession No. | Protein Sequence SEQ ID NO: | RNA Sequence wild type SEQ ID NO: | RNA Sequence SEQ ID NO: |
|---|---|---|---|---|
| CCL11 | UniProtKB: P51671 | 4833 | 4834 | 4835, 4836, 4837, 4838, 4839, 4840 |
| CCL11 | UniProtKB: Q6I9T4 | 4841 | 4842 | 4843, 4844, 4845, 4846, 4847, 4848 |
| CCL12 | UniProtKB: Q62401 | 4849 | 4850 | 4851, 4852, 4853, 4854, 4855, 4856 |
| CCL13 | UniProtKB: Q99616 | 4857 | 4858 | 4859, 4860, 4861, 4862, 4863, 4864 |
| CCL14 | UniProtKB: Q16627 | 4865 | 4866 | 4867, 4868, 4869, 4870, 4871, 4872 |
| CCL15 | UniProtKB: Q16663 | 4873 | 4874 | 4875, 4876, 4877, 4878, 4879, 4880 |
| CCL16 | UniProtKB: O15467 | 4881 | 4882 | 4883, 4884, 4885, 4886, 4887, 4888 |

TABLE 2-continued

Chemokines

| Gene Name | Protein Accession No. | Protein Sequence SEQ ID NO: | RNA Sequence wild type SEQ ID NO: | RNA Sequence SEQ ID NO: |
|---|---|---|---|---|
| CCL17 | UniProtKB: Q92583 | 4889 | 4890 | 4891, 4892, 4893, 4894, 4895, 4896 |
| CCL18 | UniProtKB: P55774 | 4897 | 4898 | 4899, 4900, 4901, 4902, 4903, 4904 |
| CCL19 | UniProtKB: Q6IBD6 | 4905 | 4906 | 4907, 4908, 4909, 4910, 4911, 4912 |
| CCL19 | UniProtKB: Q99731 | 4913 | 4914 | 4915, 4916, 4917, 4918, 4919, 4920 |
| CCL1 | UniProtKB: P22362 | 4921 | 4922 | 4923, 4924, 4925, 4926, 4927, 4928 |
| CCL20 | UniProtKB: P78556 | 4929 | 4930 | 4931, 4932, 4933, 4934, 4935, 4936 |
| CCL21 | UniProtKB: O00585 | 4937 | 4938 | 4939, 4940, 4941, 4942, 4943, 4944 |
| CCL22 | UniProtKB: O00626 | 4945 | 4946 | 4947, 4948, 4949, 4950, 4951, 4952 |
| CCL24 | UniProtKB: O00175 | 4953 | 4954 | 4955, 4956, 4957, 4958, 4959, 4960 |
| CCL25 | UniProtKB: O15444 | 4961 | 4962 | 4963, 4964, 4965, 4966, 4967, 4968 |
| CCL26 | UniProtKB: Q9Y258 | 4969 | 4970 | 4971, 4972, 4973, 4974, 4975, 4976 |
| CCL27 | UniProtKB: Q5VZ77 | 4977 | 4978 | 4979, 4980, 4981, 4982, 4983, 4984 |
| CCL28 | UniProtKB: A0N0Q3 | 4985 | 4986 | 4987, 4988, 4989, 4990, 4991, 4992 |
| CCL28 | UniProtKB: Q9NRJ3 | 4993 | 4994 | 4995, 4996, 4997, 4998, 4999, 5000 |
| CCL2 | UniProtKB: P13500 | 5001 | 5002 | 5003, 5004, 5005, 5006, 5007, 5008 |
| CCL3 | UniProtKB: A0N0R1 | 5009 | 5010 | 5011, 5012, 5013, 5014, 5015, 5016 |
| CCL3 | UniProtKB: P10147 | 5017 | 5018 | 5019, 5020, 5021, 5022, 5023, 5024 |
| CCL4 | UniProtKB: P13236 | 5025 | 5026 | 5027, 5028, 5029, 5030, 5031, 5032 |
| CCL4 | UniProtKB: Q7M4M2 | 5033 | 5034 | 5035, 5036, 5037, 5038, 5039, 5040 |
| CCL5 | UniProtKB: D0EI67 | 5041 | 5042 | 5043, 5044, 5045, 5046, 5047, 5048 |
| CCL5 | UniProtKB: P13501 | 5049 | 5050 | 5051, 5052, 5053, 5054, 5055, 5056 |
| CCL6 | UniProtKB: P27784 | 5057 | 5058 | 5059, 5060, 5061, 5062, 5063, 5064 |
| CCL7 | UniProtKB: P80098 | 5065 | 5066 | 5067, 5068, 5069, 5070, 5071, 5072 |
| CCL7 | UniProtKB: Q7Z7Q8 | 5073 | 5074 | 5075, 5076, 5077, 5078, 5079, 5080 |
| CCL8 | UniProtKB: H0UIC7 | 5081 | 5082 | 5083, 5084, 5085, 5086, 5087, 5088 |
| CCL8 | UniProtKB: P80075 | 5089 | 5090 | 5091, 5092, 5093, 5094, 5095, 5096 |
| CCL9 | UniProtKB: P51670 | 5097 | 5098 | 5099, 5100, 5101, 5102, 5103, 5104 |
| CX3CL1 | UniProtKB: A0N0N7 | 5105 | 5106 | 5107, 5108, 5109, 5110, 5111, 5112 |
| CX3CL1 | UniProtKB: P78423 | 5113 | 5114 | 5115, 5116, 5117, 5118, 5119, 5120 |
| CX3CL1 | UniProtKB: Q6I9S9 | 5121 | 5122 | 5123, 5124, 5125, 5126, 5127, 5128 |
| CXCL10 | UniProtKB: A0A024RDA4 | 5129 | 5130 | 5131, 5132, 5133, 5134, 5135, 5136 |
| CXCL10 | UniProtKB: P02778 | 5137 | 5138 | 5139, 5140, 5141, 5142, 5143, 5144 |
| CXCL11 | UniProtKB: O14625 | 5145 | 5146 | 5147, 5148, 5149, 5150, 5151, 5152 |
| CXCL12 | UniProtKB: P48061 | 5153 | 5154 | 5155, 5156, 5157, 5158, 5159, 5160 |
| CXCL13 | UniProtKB: L8E878 | 5161 | 5162 | 5163, 5164, 5165, 5166, 5167, 5168 |
| CXCL13 | UniProtKB: O43927 | 5169 | 5170 | 5171, 5172, 5173, 5174, 5175, 5176 |

TABLE 2-continued

Chemokines

| Gene Name | Protein Accession No. | Protein Sequence SEQ ID NO: | RNA Sequence wild type SEQ ID NO: | RNA Sequence SEQ ID NO: |
|---|---|---|---|---|
| CXCL14 | UniProtKB: O95715 | 5177 | 5178 | 5179, 5180, 5181, 5182, 5183, 5184 |
| CXCL15 | UniProtKB: Q9WVL7 | 5185 | 5186 | 5187, 5188, 5189, 5190, 5191, 5192 |
| CXCL1 | UniProtKB: P09341 | 5193 | 5194 | 5195, 5196, 5197, 5198, 5199, 5200 |
| CXCL2 | UniProtKB: A0A024RDD9 | 5201 | 5202 | 5203, 5204, 5205, 5206, 5207, 5208 |
| CXCL2 | UniProtKB: P19875 | 5209 | 5210 | 5211, 5212, 5213, 5214, 5215, 5216 |
| CXCL3 | UniProtKB: P19876 | 5217 | 5218 | 5219, 5220, 5221, 5222, 5223, 5224 |
| CXCL4 | UniProtKB: P02776 | 5225 | 5226 | 5227, 5228, 5229, 5230, 5231, 5232 |
| CXCL5 | UniProtKB: P42830 | 5233 | 5234 | 5235, 5236, 5237, 5238, 5239, 5240 |
| CXCL5 | UniProtKB: Q6I9S7 | 5241 | 5242 | 5243, 5244, 5245, 5246, 5247, 5248 |
| CXCL6 | UniProtKB: P80162 | 5249 | 5250 | 5251, 5252, 5253, 5254, 5255, 5256 |
| CXCL7 | UniProtKB: P02775 | 5257 | 5258 | 5259, 5260, 5261, 5262, 5263, 5264 |
| CXCL8 | UniProtKB: P10145 | 5265 | 5266 | 5267, 5268, 5269, 5270, 5271, 5272 |
| CXCL9 | UniProtKB: L8E8X0 | 5273 | 5274 | 5275, 5276, 5277, 5278, 5279, 5280 |
| CXCL9 | UniProtKB: Q07325 | 5281 | 5282 | 5283, 5284, 5285, 5286, 5287, 5288 |
| XCL1 | UniProtKB: P47992 | 5289 | 5290 | 5291, 5292, 5293, 5294, 5295, 5296 |
| XCL2 | UniProtKB: Q9UBD3 | 5297 | 5298 | 5299, 5300, 5301, 5302, 5303, 5304 |

In this context particularly preferred are chemokines chosen from the following list: CXCL9, CXCL10, CCL5, XCL1, CCL20, CCL19, CCL21, CCL2, CCL3, CCL16, and CXCL12.

According to the present invention, in a more preferred embodiment, the inventive composition comprises at least one RNA, preferably an mRNA comprising at least one coding region encoding at least one chemokine or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 2.

3. Suicide Gene Products

In a further preferred embodiment of the inventive RNA containing composition the RNA codes for at least one so-called suicide gene product, especially for a suicide enzyme, preferably for a nucleotide metabolizing enzyme. Preferably the RNA is used in combination with a prodrug which is a substrate of the suicide gene product, especially the suicide enzyme, and which is converted to a cytotoxic compound by the suicide gene product. The appropriate prodrug may be added to the inventive RNA composition or it may be administered separately to the patient.

One or more preferred suicide enzymes may be chosen from the following list: thymidine kinase, preferably a viral thymidine kinase, more preferrably Herpes simplex virus thymidine kinase, Varicella zoster thymidine kinase; a plant thymidine kinase, preferably a tomato thymidine kinase; cytosine deaminase, preferably bacterial cytosine deaminase or Yeast cytosine deaminase; deoxynucleoside kinase, preferably *Drosophila melanogaster* deoxynucleoside kinase; deoxycytidine kinase, preferably a mammalian deoxycytidine kinase, purine nucleoside phosphorylase, preferably a bacterial purine nucleoside phosphorylase.

It is already known that suicide gene therapy is a promising treatment for cancer (Ardiani et al., 2012. Curr. Gene Ther. 12(2):77-91. PMID: 22384805). This approach is based on the successful delivery and expression of the suicide gene in tumor cells. The suicide gene encodes an enzyme with the unique ability to activate an otherwise ineffective prodrug. Following suicide gene expression in transfected cells, an appropriate prodrug is administered and is converted to a cytotoxic compound by the actions of the suicide gene product. As most suicide genes encode enzymes belonging to the class of nucleotide metabolizing enzymes, the general mode of action of activated prodrugs is interference with DNA synthesis that consequently results in induction of apoptosis. The potency of these drugs is maximized in cancer cells due to their greater proliferative rate as compared to normal cells. Because of the prospect to preferentially deliver genes to tumor cells, this strategy has the potential to offer selective tumor killing while sparing normal cells, a feature that standard chemotherapeutic and radiotherapy approaches do not generally afford.

The following table 3 (Ardiani et al., 2012. Curr. Gene Ther. 12(2):77-91. PMID: 22384805) summarizes preferred nucleotide metabolizing enzymes usable in the inventive approach. The table includes variants and mutants of such enzymes which were generated by protein engineering strategies.

TABLE 3

Suicide enzymes

| Enzyme | Source gene | Natural substrate | Prodrug | Variants/Mutants | Drug inhibitors action* |
|---|---|---|---|---|---|
| Herpes Simplex Virus Thymidine Kinase (HSVTK) | Herpes Simplex Virus 1 (HSV-1) Thymidine Kinase (TK) | Thymidine | Ganciclovir (GCV), acyclovir (ACV) | Mutant 30<br>Mutant 75<br>SR39<br>A168H<br>A167Y<br>Q125N | 1<br>1<br>1<br>1<br>1<br>1, 2 |
| Bacterial Cytosine Deaminase (bCD) | *Escherichia coli* - codA | Cytosine | 5-Fluorocytosine (5-FC) | D314 mutants<br>bCD1525 | 1, 2, 4<br>1, 2, 4 |
| Yeast Cytosine Deaminase (yCD) | *Saccharomyces cerevisiae* - fcy1 | Cytosine | 5-FC | yCD triple<br>D92E | 1, 2, 4<br>1, 2, 4 |
| *Drosophila melanogaster* Deoxynucleoside Kinase (Dm-dNK) | *Drosophila melanogaster* - dNK | All four deoxy-ribo-nucleo-sides | azidothymidine (AZT), dideoxycytoinse (ddC); CdA; 9-beta-D-arabinofuranosyl-2-fluoroadenine (F-AraA); GCV, 9-beta-D-arabinosylguanine (AraG); 2',3'-didehydro-3'-deoxythymidine (D4T); 2',3'-Dideoxythymidine (ddT) | MuD<br>B5<br>B10<br>M88R<br>HDHD-12, HD-16<br>R4.V3 | 1, 5<br>1<br>1, 3<br>1<br>1, 5<br>1 |
| Deoxy-cytidine Kinase (dCK) | *Homo sapiens* - dCK | Deoxy-cytidine | 2',2'-difluoro-deoxycytidine (dFdC), AraA, β-L-thymidine (L-dT) AZT cytarabine 5'-monophosphate (AraC) | DMMA, DMLA<br>EpTK6<br>Ser-74 | 1, 3<br>1, 3, 5<br>1, 3 |
| Purine Nucleoside Phosphor-ylase (PNP) | *Escherichia coli* - deoD | Purine ribo-nucleo-sides | 9-(6-deoxy-α-L-talofuranosyl)-6-methylpurine (Me(talo)-MeP-R) | M64V | 1, 4 |

*Drug inhibitory action. 1: DNA synthesis; 2: Thymidylate synthetase; 3: Ribonucleotide reductase; 4: RNA/protein synthesis; 5: Reverse transcriptase.

Herpes simplex virus type 1 thymidine kinase (HSVTK, EC 2.7.1.21), a homodimer with a subunit molecular mass of 45 kDa, is responsible for the phosphorylation of thymidine, deoxycytidine, deoxythymidylate (dTMP) as well as various pharmaceutically important pyrimidine and guanosine analogs. Of particular note, HSVTK is responsible for the initial and rate limiting phosphorylation of the antiviral guanosine analogs acyclovir (ACV) and ganciclovir (GCV). Once monophosphorylated these analogs can be further phosphorylated by endogenous enzymes (guanylate kinase and nucleoside diphosphokinase) before being incorporated into nascent DNA to cause double strand destabilization and, subsequently, cell death.

Moreover, the Varicella zoster virus thymidine kinase (VZV-tk) may be used e.g. in conjunction with the prodrug 6-methoxypurine arabinoside (ara-M) or 1-(2'-deoxy-2-flioro-b-D-arabinofuranosyl)-5-iodouracil (FIAU). Other examples are thymidine kinases of Aleutian disease virus (ADV), respiratory syncytial virus (RSV) and cytomegalovirus (CMV).

Cytosine deaminase (CD; EC 3.5.4.1) is an enzyme in the pyrimidine salvage pathway that catalyzes the deamination of cytosine to form uracil and ammonia. CD from *E. coli* (bCD) is a hexamer of 48 kDA subunits with a catalytic metal iron. This enzyme is absent in mammals and uniquely present in fungi and bacteria. It is used in suicide gene therapy because of its ability to deaminate the anti-fungal drug, 5-fluorocytosine (5FC), to 5-fluorouracil (5FU), a potent anti-neoplastic drug. UPRT (Uracil phosphoribosyl-transferase) may be used as potential enhancer.

*Saccharomyces cerevisiae* or Yeast cytosine deaminase (yCD, EC 3.5.4.1) is a homodimer of 17.5 kDa subunits and has been shown to be more active towards 5FC than bCD (22-fold lower $K_m$) with a slightly better catalytic efficiency ($k_{cat}/K_m$) toward 5FC relative to its natural substrate cytosine.

*Drosophila melanogaster* deoxyribonucleoside kinase (Dm-dNK; EC 2.7.1.145) is a 29 kDa homodimeric, multi-substrate kinase able to phosphorylate all four natural deoxyribonucleosides required for DNA synthesis. In addition to its broad substrate specificity, Dm-dNK exhibits higher catalytic rates toward these natural deoxynucleosides and several nucleoside analogs as compared to mammalian deoxynucleoside kinases. Due to these distinctive characteristics Dm-dNK is a especially preferred enzyme for the inventive suicide gene therapy application.

Human deoxycytidine kinase (dCK; EC 2.7.1.74) is a 30.5 kDa homodimeric enzyme in the salvage pathway of deoxyribonucleosides and is responsible for activating all natural deoxyribonucleosides, excluding thymidine, as precursors for DNA synthesis. Due to its broad substrate specificity, dCK is able to activate multiple nucleoside analogs effective against different types of cancer. However, wild type dCK is intrinsically a relatively poor catalyst with low turnover rates and prodrug activation is dependent on its expression levels. Indeed, nucleoside analogs that are efficient substrates of dCK, such as cytarabine (AraC), fludarabine (F-AraA), cladribine (CdA), and gemcitabine (dFdC), are effective anti-leukemic agents as lymphoblasts have been shown to have high dCK expression levels whereas cancer cells lacking dCK activity are resistant to these same analogs. Therefore dCK is an especially preferred enzyme for the inventive approach.

Preferably the RNA of the inventive RNA containing composition is used in combination with further components which enhance the cytotoxic effect of the treatment. It is especially preferred to use the RNA in combination with RNA coding for connexins and/or with a protein of the connexin family or parts or fragments thereof. Connexins are transmembrane proteins which form gap junctions between cells. They allow transfer of e.g. molecules between neighboring cells thereby enabling the transfer of cytoxic substances.

Although suicide gene therapy is a fairly new anti-cancer approach, the concept was originally described more than two decades ago in 1986 by Moolten (Moolten, 1986. Cancer Res. 46(10):5276-81). He also proposed the existence of what is currently known as the bystander effect, now widely recognized as a fundamental feature of suicide gene therapy success. By definition the bystander effect is the extension of cytotoxic effects from transfected cells to non-transfected neighboring cells such that complete tumor regression is observed when only a small subpopulation of tumor cells is successfully transfected. This phenomenon is crucial to the overall effectiveness of suicide gene therapy today due to low transfection efficiencies achievable by available delivery systems.

The bystander effect is thought to occur via two major mechanisms: local and immune-mediated. The local mechanism involves the killing of untransfected nearby cells due to the transfer of toxic materials or suicide enzymes through gap junctions, apoptotic vesicles or through diffusion of soluble toxic metabolites. Gap junctions are important in cell-cell interactions and are responsible for the transfer of ions, nucleotides and small molecules to adjacent cells. The transfer of toxic drugs through gap junctions, however, may not be available in certain types of tumors that down regulate intracellular gap junction communication and display disorganized and non-functional gap junctions. To address this problem, several studies have increased the expression of connexins, the building blocks of gap junctions, and demonstrated that enhanced bystander and cell killing effects were achieved.

Accumulating evidence from in vivo experiments suggests that the immune-mediated bystander effect plays an important role in tumor regression as well. The presence of inflammatory infiltrates, chemokines, and cytokines have been found elevated in regressing tumors of immune competent animals receiving suicide gene therapy treatment. These cytokines and chemokines further induce the production of immune-regulatory molecules able to stimulate a more robust anti-cancer effect and additionally, because death of transfected cells is through apoptosis, numerous inflammatory signals may be released to evoke a potent immune response. Therefore the combination of the inventive composition with connexins or with RNA coding for connexins is especially preferred, because it strengthens the bystander effect thereby increasing the efficiency of the inventive RNA containing composition.

According to preferred embodiments in the context of the present invention suicide gene products may be selected from any suicide gene product selected from the group consisting of Cytosine_Deaminase_codA; Cytosine_Deaminase_fcy1; Deoxy-cytidine_Kinase_dCK; Deoxynucleoside_Kinase_dNK; Purine_Nucleoside_Phosphorylase_deoD; Thymidine_Kinase_TK, preferably as disclosed in Table 4. Particularly preferred in this context are the RNA sequences encoding a suicide gene product according to Table 4.

TABLE 4

| | | | RNA | |
| | | Protein | Sequence | RNA |
| | Protein | Sequence | wild type | Sequence |
| Gene Name | Accession No. | SEQ ID NO: | SEQ ID NO: | SEQ ID NO: |
| --- | --- | --- | --- | --- |
| Cytosine_Deaminase_codA | UniProtKB: A0A024KS17 | 5305 | 5306 | 5307, 5308, 5309, 5310, 5311, 5312 |
| Cytosine_Deaminase_codA | UniProtKB: A0A0H2V4N7 | 5313 | 5314 | 5315, 5316, 5317, 5318, 5319, 5320 |
| Cytosine_Deaminase_codA | UniProtKB: A0A0H2YX33 | 5321 | 5322 | 5323, 5324, 5325, 5326, 5327, 5328 |
| Cytosine_Deaminase_codA | UniProtKB: F4NM90 | 5329 | 5330 | 5331, 5332, 5333, 5334, 5335, 5336 |
| Cytosine_Deaminase_codA | UniProtKB: H9UNZ4 | 5337 | 5338 | 5339, 5340, 5341, 5342, 5343, 5344 |
| Cytosine_Deaminase_codA | UniProtKB: Q1RFJ5 | 5345 | 5346 | 5347, 5348, 5349, 5350, 5351, 5352 |
| Cytosine_Deaminase_codA | UniProtKB: Q2VP09 | 5353 | 5354 | 5355, 5356, 5357, 5358, 5359, 5360 |
| Cytosine_Deaminase_codA | UniProtKB: Q53ZC8 | 5361 | 5362 | 5363, 5364, 5365, 5366, 5367, 5368 |

TABLE 4-continued

Suicide Gene Products

| Gene Name | Protein Accession No. | Protein Sequence SEQ ID NO: | RNA Sequence wild type SEQ ID NO: | RNA Sequence SEQ ID NO: |
|---|---|---|---|---|
| Cytosine_Deaminase_codA | UniProtKB: Q6Q8Q1 | 5369 | 5370 | 5371, 5372, 5373, 5374, 5375, 5376 |
| Cytosine_Deaminase_codA | UniProtKB: W8ZNH5 | 5377 | 5378 | 5379, 5380, 5381, 5382, 5383, 5384 |
| Cytosine_Deaminase_fcy1 | UniProtKB: A0A023ZJG6 | 5385 | 5386 | 5387, 5388, 5389, 5390, 5391, 5392 |
| Cytosine_Deaminase_fcy1 | UniProtKB: A0A024XGF7 | 5393 | 5394 | 5395, 5396, 5397, 5398, 5399, 5400 |
| Cytosine_Deaminase_fcy1 | UniProtKB: A0A024XUW9 | 5401 | 5402 | 5403, 5404, 5405, 5406, 5407, 5408 |
| Cytosine_Deaminase_fcy1 | UniProtKB: A0A0C5ITD0 | 5409 | 5410 | 5411, 5412, 5413, 5414, 5415, 5416 |
| Cytosine_Deaminase_fcy1 | UniProtKB: A0A0D4WVI5 | 5417 | 5418 | 5419, 5420, 5421, 5422, 5423, 5424 |
| Cytosine_Deaminase_fcy1 | UniProtKB: A0A0D4WY08 | 5425 | 5426 | 5427, 5428, 5429, 5430, 5431, 5432 |
| Cytosine_Deaminase_fcy1 | UniProtKB: A0A0D4WZA2 | 5433 | 5434 | 5435, 5436, 5437, 5438, 5439, 5440 |
| Cytosine_Deaminase_fcy1 | UniProtKB: A0A0D4WZQ5 | 5441 | 5442 | 5443, 5444, 5445, 5446, 5447, 5448 |
| Cytosine_Deaminase_fcy1 | UniProtKB: A0A0D4X0R8 | 5449 | 5450 | 5451, 5452, 5453, 5454, 5455, 5456 |
| Cytosine_Deaminase_fcy1 | UniProtKB: A0A0D4X195 | 5457 | 5458 | 5459, 5460, 5461, 5462, 5463, 5464 |
| Cytosine_Deaminase_fcy1 | UniProtKB: A0A0D4X2R9 | 5465 | 5466 | 5467, 5468, 5469, 5470, 5471, 5472 |
| Cytosine_Deaminase_fcy1 | UniProtKB: A0A0D4X3Q1 | 5473 | 5474 | 5475, 5476, 5477, 5478, 5479, 5480 |
| Cytosine_Deaminase_fcy1 | UniProtKB: A0A0D4X4K1 | 5481 | 5482 | 5483, 5484, 5485, 5486, 5487, 5488 |
| Cytosine_Deaminase_fcy1 | UniProtKB: A0A0D4X5B7 | 5489 | 5490 | 5491, 5492, 5493, 5494, 5495, 5496 |
| Cytosine_Deaminase_fcy1 | UniProtKB: A0A0D4X7R4 | 5497 | 5498 | 5499, 5500, 5501, 5502, 5503, 5504 |
| Cytosine_Deaminase_fcy1 | UniProtKB: A0A0D4X7X4 | 5505 | 5506 | 5507, 5508, 5509, 5510, 5511, 5512 |
| Cytosine_Deaminase_fcy1 | UniProtKB: A0A0D4XA07 | 5513 | 5514 | 5515, 5516, 5517, 5518, 5519, 5520 |
| Cytosine_Deaminase_fcy1 | UniProtKB: A0A0D4XA25 | 5521 | 5522 | 5523, 5524, 5525, 5526, 5527, 5528 |
| Cytosine_Deaminase_fcy1 | UniProtKB: A0A0D4XAV6 | 5529 | 5530 | 5531, 5532, 5533, 5534, 5535, 5536 |
| Cytosine_Deaminase_fcy1 | UniProtKB: A0A0D4XCJ5 | 5537 | 5538 | 5539, 5540, 5541, 5542, 5543, 5544 |
| Cytosine_Deaminase_fcy1 | UniProtKB: A0A0D4XDL4 | 5545 | 5546 | 5547, 5548, 5549, 5550, 5551, 5552 |
| Cytosine_Deaminase_fcy1 | UniProtKB: A0A0D4XG53 | 5553 | 5554 | 5555, 5556, 5557, 5558, 5559, 5560 |
| Cytosine_Deaminase_fcy1 | UniProtKB: A0A0D4XGH3 | 5561 | 5562 | 5563, 5564, 5565, 5566, 5567, 5568 |
| Cytosine_Deaminase_fcy1 | UniProtKB: A0A0D4XHD4 | 5569 | 5570 | 5571, 5572, 5573, 5574, 5575, 5576 |
| Cytosine_Deaminase_fcy1 | UniProtKB: A0A0D4XIK5 | 5577 | 5578 | 5579, 5580, 5581, 5582, 5583, 5584 |
| Cytosine_Deaminase_fcy1 | UniProtKB: A0A0D4XJR4 | 5585 | 5586 | 5587, 5588, 5589, 5590, 5591, 5592 |
| Cytosine_Deaminase_fcy1 | UniProtKB: A0A0D4XL36 | 5593 | 5594 | 5595, 5596, 5597, 5598, 5599, 5600 |
| Cytosine_Deaminase_fcy1 | UniProtKB: A0A0D4XNH2 | 5601 | 5602 | 5603, 5604, 5605, 5606, 5607, 5608 |
| Cytosine_Deaminase_fcy1 | UniProtKB: A0A0D4XNS1 | 5609 | 5610 | 5611, 5612, 5613, 5614, 5615, 5616 |
| Cytosine_Deaminase_fcy1 | UniProtKB: A0A0D4XQY5 | 5617 | 5618 | 5619, 5620, 5621, 5622, 5623, 5624 |
| Cytosine_Deaminase_fcy1 | UniProtKB: A0A0D4XS80 | 5625 | 5626 | 5627, 5628, 5629, 5630, 5631, 5632 |
| Cytosine_Deaminase_fcy1 | UniProtKB: A0A0D4XS82 | 5633 | 5634 | 5635, 5636, 5637, 5638, 5639, 5640 |
| Cytosine_Deaminase_fcy1 | UniProtKB: A0A0D4XTC2 | 5641 | 5642 | 5643, 5644, 5645, 5646, 5647, 5648 |
| Cytosine_Deaminase_fcy1 | UniProtKB: A0A0D4XUZ4 | 5649 | 5650 | 5651, 5652, 5653, 5654, 5655, 5656 |

TABLE 4-continued

Suicide Gene Products

| Gene Name | Protein Accession No. | Protein Sequence SEQ ID NO: | RNA Sequence wild type SEQ ID NO: | RNA Sequence SEQ ID NO: |
|---|---|---|---|---|
| Cytosine_Deaminase_fcy1 | UniProtKB: A0A0D4XW26 | 5657 | 5658 | 5659, 5660, 5661, 5662, 5663, 5664 |
| Cytosine_Deaminase_fcy1 | UniProtKB: A0A0D4XXD1 | 5665 | 5666 | 5667, 5668, 5669, 5670, 5671, 5672 |
| Cytosine_Deaminase_fcy1 | UniProtKB: A0A0D4XYH3 | 5673 | 5674 | 5675, 5676, 5677, 5678, 5679, 5680 |
| Cytosine_Deaminase_fcy1 | UniProtKB: A0A0D4XZT0 | 5681 | 5682 | 5683, 5684, 5685, 5686, 5687, 5688 |
| Cytosine_Deaminase_fcy1 | UniProtKB: A0A0D4Y164 | 5689 | 5690 | 5691, 5692, 5693, 5694, 5695, 5696 |
| Cytosine_Deaminase_fcy1 | UniProtKB: A0A0D4Y2A8 | 5697 | 5698 | 5699, 5700, 5701, 5702, 5703, 5704 |
| Cytosine_Deaminase_fcy1 | UniProtKB: A0A0D4Y3N1 | 5705 | 5706 | 5707, 5708, 5709, 5710, 5711, 5712 |
| Cytosine_Deaminase_fcy1 | UniProtKB: A0A0D4Y5S3 | 5713 | 5714 | 5715, 5716, 5717, 5718, 5719, 5720 |
| Cytosine_Deaminase_fcy1 | UniProtKB: A0A0D4Y5Y1 | 5721 | 5722 | 5723, 5724, 5725, 5726, 5727, 5728 |
| Cytosine_Deaminase_fcy1 | UniProtKB: A0A0D4Y7I2 | 5729 | 5730 | 5731, 5732, 5733, 5734, 5735, 5736 |
| Cytosine_Deaminase_fcy1 | UniProtKB: A0A0D4Y8S5 | 5737 | 5738 | 5739, 5740, 5741, 5742, 5743, 5744 |
| Cytosine_Deaminase_fcy1 | UniProtKB: A0A0D4YAR2 | 5745 | 5746 | 5747, 5748, 5749, 5750, 5751, 5752 |
| Cytosine_Deaminase_fcy1 | UniProtKB: A0A0D4YBY2 | 5753 | 5754 | 5755, 5756, 5757, 5758, 5759, 5760 |
| Cytosine_Deaminase_fcy1 | UniProtKB: A0A0D4YCB3 | 5761 | 5762 | 5763, 5764, 5765, 5766, 5767, 5768 |
| Cytosine_Deaminase_fcy1 | UniProtKB: A0A0D4YEC2 | 5769 | 5770 | 5771, 5772, 5773, 5774, 5775, 5776 |
| Cytosine_Deaminase_fcy1 | UniProtKB: A0A0D4YF30 | 5777 | 5778 | 5779, 5780, 5781, 5782, 5783, 5784 |
| Cytosine_Deaminase_fcy1 | UniProtKB: A0A0D4YGU2 | 5785 | 5786 | 5787, 5788, 5789, 5790, 5791, 5792 |
| Cytosine_Deaminase_fcy1 | UniProtKB: A0A0D4YHN3 | 5793 | 5794 | 5795, 5796, 5797, 5798, 5799, 5800 |
| Cytosine_Deaminase_fcy1 | UniProtKB: A0A0D4YIU4 | 5801 | 5802 | 5803, 5804, 5805, 5806, 5807, 5808 |
| Cytosine_Deaminase_fcy1 | UniProtKB: A0A0D4YJ74 | 5809 | 5810 | 5811, 5812, 5813, 5814, 5815, 5816 |
| Cytosine_Deaminase_fcy1 | UniProtKB: A0A0D4YKC5 | 5817 | 5818 | 5819, 5820, 5821, 5822, 5823, 5824 |
| Cytosine_Deaminase_fcy1 | UniProtKB: A0A0D4YMN8 | 5825 | 5826 | 5827, 5828, 5829, 5830, 5831, 5832 |
| Cytosine_Deaminase_fcy1 | UniProtKB: A0A0D4YMV6 | 5833 | 5834 | 5835, 5836, 5837, 5838, 5839, 5840 |
| Cytosine_Deaminase_fcy1 | UniProtKB: A0A0D4YPP6 | 5841 | 5842 | 5843, 5844, 5845, 5846, 5847, 5848 |
| Cytosine_Deaminase_fcy1 | UniProtKB: A0A0D4YRD4 | 5849 | 5850 | 5851, 5852, 5853, 5854, 5855, 5856 |
| Cytosine_Deaminase_fcy1 | UniProtKB: A0A0D4YS13 | 5857 | 5858 | 5859, 5860, 5861, 5862, 5863, 5864 |
| Cytosine_Deaminase_fcy1 | UniProtKB: A0A0D4YTJ7 | 5865 | 5866 | 5867, 5868, 5869, 5870, 5871, 5872 |
| Cytosine_Deaminase_fcy1 | UniProtKB: A0A0D4YUX9 | 5873 | 5874 | 5875, 5876, 5877, 5878, 5879, 5880 |
| Cytosine_Deaminase_fcy1 | UniProtKB: A0A0D4YV34 | 5881 | 5882 | 5883, 5884, 5885, 5886, 5887, 5888 |
| Cytosine_Deaminase_fcy1 | UniProtKB: A0A0D4YXE1 | 5889 | 5890 | 5891, 5892, 5893, 5894, 5895, 5896 |
| Cytosine_Deaminase_fcy1 | UniProtKB: A0A0D4YYM6 | 5897 | 5898 | 5899, 5900, 5901, 5902, 5903, 5904 |
| Cytosine_Deaminase_fcy1 | UniProtKB: A0A0D4YZB7 | 5905 | 5906 | 5907, 5908, 5909, 5910, 5911, 5912 |
| Cytosine_Deaminase_fcy1 | UniProtKB: A0A0D4Z060 | 5913 | 5914 | 5915, 5916, 5917, 5918, 5919, 5920 |
| Cytosine_Deaminase_fcy1 | UniProtKB: A0A0D4Z1S2 | 5921 | 5922 | 5923, 5924, 5925, 5926, 5927, 5928 |
| Cytosine_Deaminase_fcy1 | UniProtKB: A0A0D4Z2L6 | 5929 | 5930 | 5931, 5932, 5933, 5934, 5935, 5936 |
| Cytosine_Deaminase_fcy1 | UniProtKB: A0A0D4Z4A1 | 5937 | 5938 | 5939, 5940, 5941, 5942, 5943, 5944 |

TABLE 4-continued

Suicide Gene Products

| Gene Name | Protein Accession No. | Protein Sequence SEQ ID NO: | RNA Sequence wild type SEQ ID NO: | RNA Sequence SEQ ID NO: |
|---|---|---|---|---|
| Cytosine_Deaminase_fcy1 | UniProtKB: A0A0D4Z552 | 5945 | 5946 | 5947, 5948, 5949, 5950, 5951, 5952 |
| Cytosine_Deaminase_fcy1 | UniProtKB: A0A0D4Z6N6 | 5953 | 5954 | 5955, 5956, 5957, 5958, 5959, 5960 |
| Cytosine_Deaminase_fcy1 | UniProtKB: A0A0D4Z800 | 5961 | 5962 | 5963, 5964, 5965, 5966, 5967, 5968 |
| Cytosine_Deaminase_fcy1 | UniProtKB: A0A0D4Z9V2 | 5969 | 5970 | 5971, 5972, 5973, 5974, 5975, 5976 |
| Cytosine_Deaminase_fcy1 | UniProtKB: A0A0D4ZB52 | 5977 | 5978 | 5979, 5980, 5981, 5982, 5983, 5984 |
| Cytosine_Deaminase_fcy1 | UniProtKB: A0A0D4ZCA2 | 5985 | 5986 | 5987, 5988, 5989, 5990, 5991, 5992 |
| Cytosine_Deaminase_fcy1 | UniProtKB: A0A0D4ZCG3 | 5993 | 5994 | 5995, 5996, 5997, 5998, 5999, 6000 |
| Cytosine_Deaminase_fcy1 | UniProtKB: A0A0D4ZEM2 | 6001 | 6002 | 6003, 6004, 6005, 6006, 6007, 6008 |
| Cytosine_Deaminase_fcy1 | UniProtKB: A0A0D4ZFD0 | 6009 | 6010 | 6011, 6012, 6013, 6014, 6015, 6016 |
| Cytosine_Deaminase_fcy1 | UniProtKB: A0A0D4ZGR1 | 6017 | 6018 | 6019, 6020, 6021, 6022, 6023, 6024 |
| Cytosine_Deaminase_fcy1 | UniProtKB: A0A0D4ZIM2 | 6025 | 6026 | 6027, 6028, 6029, 6030, 6031, 6032 |
| Cytosine_Deaminase_fcy1 | UniProtKB: A0A0D4ZJC0 | 6033 | 6034 | 6035, 6036, 6037, 6038, 6039, 6040 |
| Cytosine_Deaminase_fcy1 | UniProtKB: A0A0D4ZK17 | 6041 | 6042 | 6043, 6044, 6045, 6046, 6047, 6048 |
| Cytosine_Deaminase_fcy1 | UniProtKB: A0A0D4ZMC8 | 6049 | 6050 | 6051, 6052, 6053, 6054, 6055, 6056 |
| Cytosine_Deaminase_fcy1 | UniProtKB: A0A0D4ZMX9 | 6057 | 6058 | 6059, 6060, 6061, 6062, 6063, 6064 |
| Cytosine_Deaminase_fcy1 | UniProtKB: A0A0D4ZP21 | 6065 | 6066 | 6067, 6068, 6069, 6070, 6071, 6072 |
| Cytosine_Deaminase_fcy1 | UniProtKB: A0A0D4ZQ62 | 6073 | 6074 | 6075, 6076, 6077, 6078, 6079, 6080 |
| Cytosine_Deaminase_fcy1 | UniProtKB: A0A0D4ZQ92 | 6081 | 6082 | 6083, 6084, 6085, 6086, 6087, 6088 |
| Cytosine_Deaminase_fcy1 | UniProtKB: A0A0D4ZS31 | 6089 | 6090 | 6091, 6092, 6093, 6094, 6095, 6096 |
| Cytosine_Deaminase_fcy1 | UniProtKB: A0A0D4ZS87 | 6097 | 6098 | 6099, 6100, 6101, 6102, 6103, 6104 |
| Cytosine_Deaminase_fcy1 | UniProtKB: A0A0D4ZTS6 | 6105 | 6106 | 6107, 6108, 6109, 6110, 6111, 6112 |
| Cytosine_Deaminase_fcy1 | UniProtKB: A0A0D4ZUK0 | 6113 | 6114 | 6115, 6116, 6117, 6118, 6119, 6120 |
| Cytosine_Deaminase_fcy1 | UniProtKB: A0A0D4ZVN6 | 6121 | 6122 | 6123, 6124, 6125, 6126, 6127, 6128 |
| Cytosine_Deaminase_fcy1 | UniProtKB: A0A0D4ZWP2 | 6129 | 6130 | 6131, 6132, 6133, 6134, 6135, 6136 |
| Cytosine_Deaminase_fcy1 | UniProtKB: A0A0D4ZX07 | 6137 | 6138 | 6139, 6140, 6141, 6142, 6143, 6144 |
| Cytosine_Deaminase_fcy1 | UniProtKB: Q12178 | 6145 | 6146 | 6147, 6148, 6149, 6150, 6151, 6152 |
| Cytosine_Deaminase_fcy1 | UniProtKB: W7PK48 | 6153 | 6154 | 6155, 6156, 6157, 6158, 6159, 6160 |
| Cytosine_Deaminase_fcy1 | UniProtKB: W7R647 | 6161 | 6162 | 6163, 6164, 6165, 6166, 6167, 6168 |
| Deoxy-cytidine_Kinase_dCK | UniProtKB: P27707 | 6169 | 6170 | 6171, 6172, 6173, 6174, 6175, 6176 |
| Deoxynucleoside_Kinase_dNK | UniProtKB: Q540Z9 | 6177 | 6178 | 6179, 6180, 6181, 6182, 6183, 6184 |
| Deoxynucleoside_Kinase_dNK | UniProtKB: Q9XZT6 | 6185 | 6186 | 6187, 6188, 6189, 6190, 6191, 6192 |
| Purine_Nucleoside_Phosphorylase_deoD | UniProtKB: A0A023Z7B9 | 6193 | 6194 | 6195, 6196, 6197, 6198, 6199, 6200 |
| Purine_Nucleoside_Phosphorylase_deoD | UniProtKB: A0A024KMI2 | 6201 | 6202 | 6203, 6204, 6205, 6206, 6207, 6208 |
| Purine_Nucleoside_Phosphorylase_deoD | UniProtKB: A0A0E0SRY5 | 6209 | 6210 | 6211, 6212, 6213, 6214, 6215, 6216 |
| Purine_Nucleoside_Phosphorylase_deoD | UniProtKB: A0A0E0U7I4 | 6217 | 6218 | 6219, 6220, 6221, 6222, 6223, 6224 |
| Purine_Nucleoside_Phosphorylase_deoD | UniProtKB: A0A0E0VFI3 | 6225 | 6226 | 6227, 6228, 6229, 6230, 6231, 6232 |

TABLE 4-continued

Suicide Gene Products

| Gene Name | Protein Accession No. | Protein Sequence SEQ ID NO: | RNA Sequence wild type SEQ ID NO: | RNA Sequence SEQ ID NO: |
|---|---|---|---|---|
| Purine_Nucleoside_Phosphorylase_deoD | UniProtKB: A0A0E0Y455 | 6233 | 6234 | 6235, 6236, 6237, 6238, 6239, 6240 |
| Purine_Nucleoside_Phosphorylase_deoD | UniProtKB: A0A0E1M7E2 | 6241 | 6242 | 6243, 6244, 6245, 6246, 6247, 6248 |
| Purine_Nucleoside_Phosphorylase_deoD | UniProtKB: A0A0E3KJD7 | 6249 | 6250 | 6251, 6252, 6253, 6254, 6255, 6256 |
| Purine_Nucleoside_Phosphorylase_deoD | UniProtKB: A0A0F6CCW6 | 6257 | 6258 | 6259, 6260, 6261, 6262, 6263, 6264 |
| Purine_Nucleoside_Phosphorylase_deoD | UniProtKB: A0A0F6FGI8 | 6265 | 6266 | 6267, 6268, 6269, 6270, 6271, 6272 |
| Purine_Nucleoside_Phosphorylase_deoD | UniProtKB: A0A0F6GWR2 | 6273 | 6274 | 6275, 6276, 6277, 6278, 6279, 6280 |
| Purine_Nucleoside_Phosphorylase_deoD | UniProtKB: A0A0G2SIK5 | 6281 | 6282 | 6283, 6284, 6285, 6286, 6287, 6288 |
| Purine_Nucleoside_Phosphorylase_deoD | UniProtKB: A0A0G3J9R6 | 6289 | 6290 | 6291, 6292, 6293, 6294, 6295, 6296 |
| Purine_Nucleoside_Phosphorylase_deoD | UniProtKB: A0A0G3J9Y2 | 6297 | 6298 | 6299, 6300, 6301, 6302, 6303, 6304 |
| Purine_Nucleoside_Phosphorylase_deoD | UniProtKB: A0A0G3KD68 | 6305 | 6306 | 6307, 6308, 6309, 6310, 6311, 6312 |
| Purine_Nucleoside_Phosphorylase_deoD | UniProtKB: A0A0H2Z6H1 | 6313 | 6314 | 6315, 6316, 6317, 6318, 6319, 6320 |
| Purine_Nucleoside_Phosphorylase_deoD | UniProtKB: A0A0H3EQW1 | 6321 | 6322 | 6323, 6324, 6325, 6326, 6327, 6328 |
| Purine_Nucleoside_Phosphorylase_deoD | UniProtKB: A0A0H3XF09 | 6329 | 6330 | 6331, 6332, 6333, 6334, 6335, 6336 |
| Purine_Nucleoside_Phosphorylase_deoD | UniProtKB: A0A0J9WZC9 | 6337 | 6338 | 6339, 6340, 6341, 6342, 6343, 6344 |
| Purine_Nucleoside_Phosphorylase_deoD | UniProtKB: A7ZVS7 | 6345 | 6346 | 6347, 6348, 6349, 6350, 6351, 6352 |
| Purine_Nucleoside_Phosphorylase_deoD | UniProtKB: A8A8B3 | 6353 | 6354 | 6355, 6356, 6357, 6358, 6359, 6360 |
| Purine_Nucleoside_Phosphorylase_deoD | UniProtKB: B1IS35 | 6361 | 6362 | 6363, 6364, 6365, 6366, 6367, 6368 |
| Purine_Nucleoside_Phosphorylase_deoD | UniProtKB: B1LEI9 | 6369 | 6370 | 6371, 6372, 6373, 6374, 6375, 6376 |
| Purine_Nucleoside_Phosphorylase_deoD | UniProtKB: B1XFJ4 | 6377 | 6378 | 6379, 6380, 6381, 6382, 6383, 6384 |
| Purine_Nucleoside_Phosphorylase_deoD | UniProtKB: B3HEI4 | 6385 | 6386 | 6387, 6388, 6389, 6390, 6391, 6392 |
| Purine_Nucleoside_Phosphorylase_deoD | UniProtKB: B5Z4R6 | 6393 | 6394 | 6395, 6396, 6397, 6398, 6399, 6400 |
| Purine_Nucleoside_Phosphorylase_deoD | UniProtKB: B6I6N1 | 6401 | 6402 | 6403, 6404, 6405, 6406, 6407, 6408 |
| Purine_Nucleoside_Phosphorylase_deoD | UniProtKB: B7LEN0 | 6409 | 6410 | 6411, 6412, 6413, 6414, 6415, 6416 |
| Purine_Nucleoside_Phosphorylase_deoD | UniProtKB: B7LXU6 | 6417 | 6418 | 6419, 6420, 6421, 6422, 6423, 6424 |
| Purine_Nucleoside_Phosphorylase_deoD | UniProtKB: B7MNJ1 | 6425 | 6426 | 6427, 6428, 6429, 6430, 6431, 6432 |
| Purine_Nucleoside_Phosphorylase_deoD | UniProtKB: B7N2V8 | 6433 | 6434 | 6435, 6436, 6437, 6438, 6439, 6440 |
| Purine_Nucleoside_Phosphorylase_deoD | UniProtKB: B7NH52 | 6441 | 6442 | 6443, 6444, 6445, 6446, 6447, 6448 |
| Purine_Nucleoside_Phosphorylase_deoD | UniProtKB: B7NW64 | 6449 | 6450 | 6451, 6452, 6453, 6454, 6455, 6456 |
| Purine_Nucleoside_Phosphorylase_deoD | UniProtKB: B7UR12 | 6457 | 6458 | 6459, 6460, 6461, 6462, 6463, 6464 |
| Purine_Nucleoside_Phosphorylase_deoD | UniProtKB: C3SE47 | 6465 | 6466 | 6467, 6468, 6469, 6470, 6471, 6472 |
| Purine_Nucleoside_Phosphorylase_deoD | UniProtKB: C4ZT66 | 6473 | 6474 | 6475, 6476, 6477, 6478, 6479, 6480 |
| Purine_Nucleoside_Phosphorylase_deoD | UniProtKB: C8TQD7 | 6481 | 6482 | 6483, 6484, 6485, 6486, 6487, 6488 |
| Purine_Nucleoside_Phosphorylase_deoD | UniProtKB: C8U157 | 6489 | 6490 | 6491, 6492, 6493, 6494, 6495, 6496 |
| Purine_Nucleoside_Phosphorylase_deoD | UniProtKB: C8UN92 | 6497 | 6498 | 6499, 6500, 6501, 6502, 6503, 6504 |
| Purine_Nucleoside_Phosphorylase_deoD | UniProtKB: D3GY24 | 6505 | 6506 | 6507, 6508, 6509, 6510, 6511, 6512 |
| Purine_Nucleoside_Phosphorylase_deoD | UniProtKB: D3QNE6 | 6513 | 6514 | 6515, 6516, 6517, 6518, 6519, 6520 |

TABLE 4-continued

Suicide Gene Products

| Gene Name | Protein Accession No. | Protein Sequence SEQ ID NO: | RNA Sequence wild type SEQ ID NO: | RNA Sequence SEQ ID NO: |
|---|---|---|---|---|
| Purine_Nucleoside_Phosphorylase_deoD | UniProtKB: D6I4N2 | 6521 | 6522 | 6523, 6524, 6525, 6526, 6527, 6528 |
| Purine_Nucleoside_Phosphorylase_deoD | UniProtKB: D6IHU2 | 6529 | 6530 | 6531, 6532, 6533, 6534, 6535, 6536 |
| Purine_Nucleoside_Phosphorylase_deoD | UniProtKB: D6J6A4 | 6537 | 6538 | 6539, 6540, 6541, 6542, 6543, 6544 |
| Purine_Nucleoside_Phosphorylase_deoD | UniProtKB: E0J437 | 6545 | 6546 | 6547, 6548, 6549, 6550, 6551, 6552 |
| Purine_Nucleoside_Phosphorylase_deoD | UniProtKB: E2QLE4 | 6553 | 6554 | 6555, 6556, 6557, 6558, 6559, 6560 |
| Purine_Nucleoside_Phosphorylase_deoD | UniProtKB: E3PFG7 | 6561 | 6562 | 6563, 6564, 6565, 6566, 6567, 6568 |
| Purine_Nucleoside_Phosphorylase_deoD | UniProtKB: E8YEH0 | 6569 | 6570 | 6571, 6572, 6573, 6574, 6575, 6576 |
| Purine_Nucleoside_Phosphorylase_deoD | UniProtKB: F4NLK2 | 6577 | 6578 | 6579, 6580, 6581, 6582, 6583, 6584 |
| Purine_Nucleoside_Phosphorylase_deoD | UniProtKB: F4SEX7 | 6585 | 6586 | 6587, 6588, 6589, 6590, 6591, 6592 |
| Purine_Nucleoside_Phosphorylase_deoD | UniProtKB: F4STB8 | 6593 | 6594 | 6595, 6596, 6597, 6598, 6599, 6600 |
| Purine_Nucleoside_Phosphorylase_deoD | UniProtKB: F4T9F1 | 6601 | 6602 | 6603, 6604, 6605, 6606, 6607, 6608 |
| Purine_Nucleoside_Phosphorylase_deoD | UniProtKB: F4UXB7 | 6609 | 6610 | 6611, 6612, 6613, 6614, 6615, 6616 |
| Purine_Nucleoside_Phosphorylase_deoD | UniProtKB: F4VN60 | 6617 | 6618 | 6619, 6620, 6621, 6622, 6623, 6624 |
| Purine_Nucleoside_Phosphorylase_deoD | UniProtKB: F4VQF8 | 6625 | 6626 | 6627, 6628, 6629, 6630, 6631, 6632 |
| Purine_Nucleoside_Phosphorylase_deoD | UniProtKB: H9V0H4 | 6633 | 6634 | 6635, 6636, 6637, 6638, 6639, 6640 |
| Purine_Nucleoside_Phosphorylase_deoD | UniProtKB: J7QV83 | 6641 | 6642 | 6643, 6644, 6645, 6646, 6647, 6648 |
| Purine_Nucleoside_Phosphorylase_deoD | UniProtKB: P0ABP8 | 6649 | 6650 | 6651, 6652, 6653, 6654, 6655, 6656 |
| Purine_Nucleoside_Phosphorylase_deoD | UniProtKB: Q0T8S9 | 6657 | 6658 | 6659, 6660, 6661, 6662, 6663, 6664 |
| Purine_Nucleoside_Phosphorylase_deoD | UniProtKB: Q1R259 | 6665 | 6666 | 6667, 6668, 6669, 6670, 6671, 6672 |
| Purine_Nucleoside_Phosphorylase_deoD | UniProtKB: W8ZSE4 | 6673 | 6674 | 6675, 6676, 6677, 6678, 6679, 6680 |
| Purine_Nucleoside_Phosphorylase_deoD | UniProtKB: X5FDR9 | 6681 | 6682 | 6683, 6684, 6685, 6686, 6687, 6688 |
| Thymidine_Kinase_TK | UniProtKB: B2CPP5 | 6689 | 6690 | 6691, 6692, 6693, 6694, 6695, 6696 |
| Thymidine_Kinase_TK | UniProtKB: B2CPP6 | 6697 | 6698 | 6699, 6700, 6701, 6702, 6703, 6704 |
| Thymidine_Kinase_TK | UniProtKB: B2CPP7 | 6705 | 6706 | 6707, 6708, 6709, 6710, 6711, 6712 |
| Thymidine_Kinase_TK | UniProtKB: B2CPP8 | 6713 | 6714 | 6715, 6716, 6717, 6718, 6719, 6720 |
| Thymidine_Kinase_TK | UniProtKB: B2CPP9 | 6721 | 6722 | 6723, 6724, 6725, 6726, 6727, 6728 |
| Thymidine_Kinase_TK | UniProtKB: B2CPQ0 | 6729 | 6730 | 6731, 6732, 6733, 6734, 6735, 6736 |
| Thymidine_Kinase_TK | UniProtKB: B2CPQ2 | 6737 | 6738 | 6739, 6740, 6741, 6742, 6743, 6744 |
| Thymidine_Kinase_TK | UniProtKB: B2CPQ3 | 6745 | 6746 | 6747, 6748, 6749, 6750, 6751, 6752 |
| Thymidine_Kinase_TK | UniProtKB: B2CPQ4 | 6753 | 6754 | 6755, 6756, 6757, 6758, 6759, 6760 |
| Thymidine_Kinase_TK | UniProtKB: B2CPQ5 | 6761 | 6762 | 6763, 6764, 6765, 6766, 6767, 6768 |
| Thymidine_Kinase_TK | UniProtKB: O72346 | 6769 | 6770 | 6771, 6772, 6773, 6774, 6775, 6776 |
| Thymidine_Kinase_TK | UniProtKB: P06478 | 6777 | 6778 | 6779, 6780, 6781, 6782, 6783, 6784 |
| Thymidine_Kinase_TK | UniProtKB: P08333 | 6785 | 6786 | 6787, 6788, 6789, 6790, 6791, 6792 |
| Thymidine_Kinase_TK | UniProtKB: Q9DLP2 | 6793 | 6794 | 6795, 6796, 6797, 6798, 6799, 6800 |
| Thymidine_Kinase_TK | UniProtKB: Q9ENS0 | 6801 | 6802 | 6803, 6804, 6805, 6806, 6807, 6808 |

TABLE 4-continued

Suicide Gene Products

| Gene Name | Protein Accession No. | Protein Sequence SEQ ID NO: | RNA Sequence wild type SEQ ID NO: | RNA Sequence SEQ ID NO: |
|---|---|---|---|---|
| Thymidine_Kinase_TK | UniProtKB: Q9ENS1 | 6809 | 6810 | 6811, 6812, 6813, 6814, 6815, 6816 |
| Thymidine_Kinase_TK | UniProtKB: Q9ENS2 | 6817 | 6818 | 6819, 6820, 6821, 6822, 6823, 6824 |
| Thymidine_Kinase_TK | UniProtKB: Q9ENS3 | 6825 | 6826 | 6827, 6828, 6829, 6830, 6831, 6832 |
| Thymidine_Kinase_TK | UniProtKB: Q9ENS4 | 6833 | 6834 | 6835, 6836, 6837, 6838, 6839, 6840 |
| Thymidine_Kinase_TK | UniProtKB: Q9ENS5 | 6841 | 6842 | 6843, 6844, 6845, 6846, 6847, 6848 |
| Thymidine_Kinase_TK | UniProtKB: Q9IYZ7 | 6849 | 6850 | 6851, 6852, 6853, 6854, 6855, 6856 |
| Thymidine_Kinase_TK | UniProtKB: Q9IYZ9 | 6857 | 6858 | 6859, 6860, 6861, 6862, 6863, 6864 |
| Thymidine_Kinase_TK | UniProtKB: Q9IZ02 | 6865 | 6866 | 6867, 6868, 6869, 6870, 6871, 6872 |
| Thymidine_Kinase_TK | UniProtKB: Q9IZ03 | 6873 | 6874 | 6875, 6876, 6877, 6878, 6879, 6880 |
| Thymidine_Kinase_TK | UniProtKB: Q9IZ07 | 6881 | 6882 | 6883, 6884, 6885, 6886, 6887, 6888 |
| Thymidine_Kinase_TK | UniProtKB: Q9QNF7 | 6889 | 6890 | 6891, 6892, 6893, 6894, 6895, 6896 |

According to the present invention, in a more preferred embodiment, the inventive composition comprises at least one RNA, preferably an mRNA comprising at least one coding region encoding at least one suicide gene product or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 4.

4. Immunogenic Proteins or Peptides

Preferably the RNA, preferably mRNA of the inventive RNA composition codes for at least one immunogenic protein or peptide, especially a protein or peptide of a pathogen, preferably a viral pathogen, or a fragment or variant thereof. By using RNA which codes for an immunogenic protein or peptide which is preferably a pathogenic antigen it is possible to utilize preexisting immunity against such antigens for treatment of tumor and/or cancer diseases. The memory immune response is triggered and the immune system is strengthened for attacking tumor cells.

This embodiment of the invention is based on the recognition that in principle every organism with an immune system exhibits "memory immune responses" against certain foreign molecules (antigens), for example proteins, in particular viral or bacterial proteins. If an organism has already been infected at an earlier point in time with the antigen an immune response against e.g. the viral protein has already been triggered by this infection. The immune system has a "memory" of this response and stores it. As consequence of a reinfection with the antigen the immune response is reactivated. Such reactivation may proceed by administration of an RNA, preferably mRNA coding for the antigen, wherein the preferred intratumoral administration according to the invention is especially effective. By reactivation of the memory immune response against e.g. viral pathogens it is possible to destroy tumor cells effectively.

Preferred examples of immunogenic proteins or peptides for this embodiment of the invention are proteins or peptides of widespread pathogens, i.e. pathogens with which every organism, in particular mammals, preferably humans, has a high probability of being infected at least once in his/her lifetime. These include, for example, any structural or non-structural protein or peptide of:

influenza virus type A or B or any other orthomyxovirus (influenza type C),
picornaviruses, such as rhinovirus or hepatitis A virus,
togaviruses, such as alphavirus or rubivirus, e.g. Sindbis, Semliki-Forest or rubeolavirus (measles virus),
rubella virus (German measles virus),
coronaviruses, in particular subtypes HCV-229E or HCV-OC43,
rhabdoviruses, such as rabies virus,
paramyxoviruses, such as mumps virus,
reoviruses, such as group A, B or C rotavirus,
hepadnaviruses, such as hepatitis B virus,
papoviruses, such as human papillomaviruses (HPV) of any serotype, especially from 1 to 75,
adenoviruses, in particular type 1 to 47,
herpesviruses, such as Herpes simplex virus 1, 2 or 3,
cytomegalovirus (CMV), preferably CMVpp65,
Epstein Barr virus (EBV),
vaccinia viruses and
the bacterium Chiamydophila pneumoniae (Chlamydia pneumoniae).

Further examples of preferred immunogenic proteins or peptides are proteins or peptides of pathogens which only seldom infect an organism. Nevertheless RNA coding for one or more of these proteins or peptides may be effective in the inventive approach. These proteins or peptide include, for example, any structural or non-structural protein or peptide of:

Flaviviruses, such as dengue virus type 1 to 4, yellow fever virus, West Nile virus, Japanese encephalitis virus hepatitis C virus,
caliciviruses,
filoviruses, such as Ebola virus,
bornaviruses, bunyaviruses, such as Rift Valley fever virus,
arenaviruses, such as LCMV (lymphocytic choriomeningitis virus) or hemorrhagic fever viruses,
retroviruses, such as HIV and
parvoviruses.

Preferably the RNA of the inventive mRNA composition codes for influenza nucleoprotein (NP). It has been shown by the inventors that the use of a composition containing mRNA coding for influenza nucleoprotein is especially effective in reducing tumor size, when applied according to the inventive approach. In this context an mRNA encoding an Influenza nucleoprotein according to SEQ ID NO. 6 is particularly preferred.

5. Cell Death Inducers and Apoptosis Inducers:

In the broadest sense, an apoptosis inducer or cell death inducer has to be understood as a molecule inducing autophagy, cornification, excitotoxicity, necrosis, Wallerian degeneration, entosis, mitotic catastrophe, necroptosis and pyroptosis (reviewed in Kroemer, G., et al. "Classification of cell death: recommendations of the Nomenclature Committee on Cell Death 2009." Cell Death & Differentiation 16.1 (2009): 3-11.).

In a further preferred embodiment of the inventive RNA containing composition the RNA codes for at least one apoptosis inducer, preferably an apoptosis inducer chosen from the group consisting of the Bcl-2 family and tumor suppressor protein p53 and ligands of transmembrane death receptors, especially the TNF (tumor necrosis factor) receptor gene superfamily, pro-apoptic receptor agonists and Beclin-1.

A particularly preferred apoptosis inducer in the context of the present invention is Beclin-1 (derived from the BECN1 gene). It is known in the art that Beclin-1 interacts with Bcl-2, BCL2L2, GOPC and MAP1LC3A to regulate autophagy and cell death.

Apoptosis provides an important barrier against cancer. However, specific mutations (e.g. mutation of the tumor suppressor gene p53) enable some tumor cells to escape apoptotic death and become more malignant. By using an mRNA coding for at least one apoptosis inducer it is possible to reactivate apoptosis which is an important and effective system of the organism to eliminate cancer cells.

Preferred examples of apoptosis inducers may be chosen from the following list: Bcl-10, Bax, Bak, Bid, Bad, Bim, Bik, Blk, Cytochrome c, Caspases, especially Caspase 3, Caspase 6, Caspase 7, Caspase 8, Caspase 9, Death domain, especially of Fas, preferably FasL, TNFα, Apo2L/TRAIL, agonist of DR4 and/or DR5, Apo3L, DR4 agonistic antibody, DR5 agonistic antibody, protein kinase R (PKR) (preferably constitutive active PKR), Granzyme B.

Two signalling pathways initiate apoptosis: the intrinsic pathway acts through intracellular Bcl-2 proteins, the extrinsic pathway through cell-surface pro-apoptotic receptors.

The intrinsic signaling pathway for programmed cell death involves non-receptor-mediated intracellular signals, inducing activities in the mitochondria that initiate apoptosis. Stimuli for the intrinsic pathway include viral infections or damage to the cell by toxins, free radicals, or radiation. Damage to the cellular DNA can also induce the activation of the intrinsic pathway for programmed cell death. These stimuli induce changes in the inner mitochondrial membrane that result in the loss of transmembrane potential, causing the release of pro-apoptotic proteins into the cytosol. Pro-apoptotic proteins activate caspases that mediate the destruction of the cell through many pathways. These proteins also translocate into the cellular nucleus, inducing DNA fragmentation, a hallmark of apoptosis. The regulation of pro-apoptotic events in the mitochondria occurs through activity of members of the Bcl-2 family of proteins and the tumor suppressor protein p53. Members of the Bcl-2 family of proteins may be pro-apoptotic or anti-apoptotic. The anti-apoptotic proteins are Bcl-2, Bcl-x, Bcl-xL, Bcl-XS, Bcl-w, and BAG. Pro-apoptotic proteins include Bcl-10, Bax, Bak, Bid, Bad, Bim, Bik, and Blk (Elmore, 2007. Toxicol Pathol. 35(4):495-516 (PMID: 17562483)), which are especially preferred for the inventive approach.

The extrinsic signaling pathway leading to apoptosis involves transmembrane death receptors that are members of the tumor necrosis factor (TNF) receptor gene superfamily. Members of this receptor family bind to extrinsic ligands and transduce intracellular signals that ultimately result in the destruction of the cell. The most well characterized ligands of these receptors to date are FasL, TNFα, Apo2L, and Apo3L. Corresponding receptors are FasR, TNFR1, DR3, and DR4/DR5. Molecules that stimulate the activity of these pro-apoptotic proteins or activate these receptors are currently under evaluation for their therapeutic potential in the treatment of cancer, including hematologic malignancies (Elmore, 2007. Toxicol Pathol. 35(4):495-516 (PMID: 17562483)). These extrinsic ligands are further especially preferred examples for use in the inventive approach.

New molecular insights have inspired the development of pro-apoptotic receptor agonists (PARAs), including the recombinant human protein apoptosis ligand 2/TNF-related apoptosis-inducing ligand (Apo2L/TRAIL). In addition, agonistic monoclonal antibodies to its signalling receptors DR4 (TRAILR1) and DR5 (TRAILR2) are under development. Mapatumumab is an example of a DR4 agonist antibody. Examples of DR5 agonistic antibodies include Lexatumumab, Apomab, AMG655, CS-1008 and LBY-135 (Ashkenazi, 2008. Nat. Rev. Drug Discov. 7(12):1001-12 (PMID: 18989337)).

The following table 5 summarizes some preferred apoptosis inducers.

TABLE 5

| Apoptosis inducers | |
|---|---|
| Gene/Agent | Example |
| Intrinsic pathway | |
| Bcl-10 | |
| Bax | |
| Bak | |
| Bid | |
| Bad | |
| Bim | |
| Bik | |
| Blk | |
| Cytochrome c | |
| Caspase 3, 6, 7, 8, 9 | |
| Extrinsic pathway | |
| FasL | |
| TNFα | |
| Apo2L/TRAIL | |
| Apo3L | |
| DR4 agonist antibody | Mapatumumab |
| DR5 agonist antibody | Lexatumumab, Apomab, AMG655, CS-1008, LBY-135 |
| Other | |
| Granzyme B | |

According to preferred embodiments in the context of the present invention apoptosis inducers may be selected from any apoptosis inducer selected from the group consisting of Apo2L/TRAIL; Apo3L; Bad; Bak; Bax; Bcl-10; Bid; Bik; Bim; Blk; Caspase_3; Caspase_6; Caspase_7; Caspase_8; Caspase_9; Cytochrome_c; FasL; Granzyme_B; TNF, preferably as disclosed in Table 6. Particularly preferred in this context are the RNA sequences encoding an apoptosis inducer according to Table 6.

TABLE 6

Apoptosis inducers:

| Gene Name | Protein Accession No. | Protein Sequence SEQ ID NO: | RNA Sequence wild type SEQ ID NO: | Optimized RNA Sequence SEQ ID NO: |
|---|---|---|---|---|
| Apo2L/TRAIL | UniProtKB: P50591 | 6897 | 6898 | 6899, 6900, 6901, 6902, 6903, 6904 |
| Apo3L | UniProtKB: O43508 | 6905 | 6906 | 6907, 6908, 6909, 6910, 6911, 6912 |
| Bad | UniProtKB: A0A024R562 | 6913 | 6914 | 6915, 6916, 6917, 6918, 6919, 6920 |
| Bad | UniProtKB: Q92934 | 6921 | 6922 | 6923, 6924, 6925, 6926, 6927, 6928 |
| Bak | UniProtKB: Q16611 | 6929 | 6930 | 6931, 6932, 6933, 6934, 6935, 6936 |
| Bak | UniProtKB: Q8NFF3 | 6937 | 6938 | 6939, 6940, 6941, 6942, 6943, 6944 |
| Bax | UniProtKB: A0A0C4MVT1 | 6945 | 6946 | 6947, 6948, 6949, 6950, 6951, 6952 |
| Bax | UniProtKB: A0A0C4MW46 | 6953 | 6954 | 6955, 6956, 6957, 6958, 6959, 6960 |
| Bax | UniProtKB: A0A0C4MWS3 | 6961 | 6962 | 6963, 6964, 6965, 6966, 6967, 6968 |
| Bax | UniProtKB: I6LPK7 | 6969 | 6970 | 6971, 6972, 6973, 6974, 6975, 6976 |
| Bax | UniProtKB: K4JQN1 | 6977 | 6978 | 6979, 6980, 6981, 6982, 6983, 6984 |
| Bax | UniProtKB: Q07812 | 6985 | 6986 | 6987, 6988, 6989, 6990, 6991, 6992 |
| Bcl-10 | UniProtKB: O95999 | 6993 | 6994 | 6995, 6996, 6997, 6998, 6999, 7000 |
| Bid | UniProtKB: A8ASI8 | 7001 | 7002 | 7003, 7004, 7005, 7006, 7007, 7008 |
| Bid | UniProtKB: B2ZP78 | 7009 | 7010 | 7011, 7012, 7013, 7014, 7015, 7016 |
| Bid | UniProtKB: B2ZP79 | 7017 | 7018 | 7019, 7020, 7021, 7022, 7023, 7024 |
| Bid | UniProtKB: P55957 | 7025 | 7026 | 7027, 7028, 7029, 7030, 7031, 7032 |
| Bik | UniProtKB: A0A024R4X6 | 7033 | 7034 | 7035, 7036, 7037, 7038, 7039, 7040 |
| Bik | UniProtKB: Q13323 | 7041 | 7042 | 7043, 7044, 7045, 7046, 7047, 7048 |
| Bim | UniProtKB: O43521 | 7049 | 7050 | 7051, 7052, 7053, 7054, 7055, 7056 |
| Blk | UniProtKB: P51451 | 7057 | 7058 | 7059, 7060, 7061, 7062, 7063, 7064 |
| Caspase_3 | UniProtKB: P42574 | 7065 | 7066 | 7067, 7068, 7069, 7070, 7071, 7072 |
| Caspase_6 | UniProtKB: P55212 | 7073 | 7074 | 7075, 7076, 7077, 7078, 7079, 7080 |
| Caspase_7 | UniProtKB: P55210 | 7081 | 7082 | 7083, 7084, 7085, 7086, 7087, 7088 |
| Caspase_8 | UniProtKB: B5BU46 | 7089 | 7090 | 7091, 7092, 7093, 7094, 7095, 7096 |
| Caspase_8 | UniProtKB: B6CGU5 | 7097 | 7098 | 7099, 7100, 7101, 7102, 7103, 7104 |
| Caspase_8 | UniProtKB: C3S3G0 | 7105 | 7106 | 7107, 7108, 7109, 7110, 7111, 7112 |
| Caspase_8 | UniProtKB: Q14790 | 7113 | 7114 | 7115, 7116, 7117, 7118, 7119, 7120 |
| Caspase_9 | UniProtKB: A0A024R8F1 | 7121 | 7122 | 7123, 7124, 7125, 7126, 7127, 7128 |
| Caspase_9 | UniProtKB: A0A024R8I4 | 7129 | 7130 | 7131, 7132, 7133, 7134, 7135, 7136 |
| Caspase_9 | UniProtKB: P55211 | 7137 | 7138 | 7139, 7140, 7141, 7142, 7143, 7144 |
| Caspase_9 | UniProtKB: Q9H257 | 7145 | 7146 | 7147, 7148, 7149, 7150, 7151, 7152 |
| Cytochrome_c | UniProtKB: A0A024R9B7 | 7153 | 7154 | 7155, 7156, 7157, 7158, 7159, 7160 |
| Cytochrome_c | UniProtKB: A0A024RAP6 | 7161 | 7162 | 7163, 7164, 7165, 7166, 7167, 7168 |

TABLE 6-continued

Apoptosis inducers:

| Gene Name | Protein Accession No. | Protein Sequence SEQ ID NO: | RNA Sequence wild type SEQ ID NO: | Optimized RNA Sequence SEQ ID NO: |
|---|---|---|---|---|
| Cytochrome_c | UniProtKB: A0A024RBN6 | 7169 | 7170 | 7171, 7172, 7173, 7174, 7175, 7176 |
| Cytochrome_c | UniProtKB: A0A024RBY9 | 7177 | 7178 | 7179, 7180, 7181, 7182, 7183, 7184 |
| Cytochrome_c | UniProtKB: B8XYC5 | 7185 | 7186 | 7187, 7188, 7189, 7190, 7191, 7192 |
| Cytochrome_c | UniProtKB: G4XXL9 | 7193 | 7194 | 7195, 7196, 7197, 7198, 7199, 7200 |
| Cytochrome_c | UniProtKB: H0UI06 | 7201 | 7202 | 7203, 7204, 7205, 7206, 7207, 7208 |
| Cytochrome_c | UniProtKB: H6SG12 | 7209 | 7210 | 7211, 7212, 7213, 7214, 7215, 7216 |
| Cytochrome_c | UniProtKB: H6SG13 | 7217 | 7218 | 7219, 7220, 7221, 7222, 7223, 7224 |
| Cytochrome_c | UniProtKB: H6SG14 | 7225 | 7226 | 7227, 7228, 7229, 7230, 7231, 7232 |
| Cytochrome_c | UniProtKB: H6SG15 | 7233 | 7234 | 7235, 7236, 7237, 7238, 7239, 7240 |
| Cytochrome_c | UniProtKB: O95101 | 7241 | 7242 | 7243, 7244, 7245, 7246, 7247, 7248 |
| Cytochrome_c | UniProtKB: P08574 | 7249 | 7250 | 7251, 7252, 7253, 7254, 7255, 7256 |
| Cytochrome_c | UniProtKB: P99999 | 7257 | 7258 | 7259, 7260, 7261, 7262, 7263, 7264 |
| Cytochrome_c | UniProtKB: Q496I0 | 7265 | 7266 | 7267, 7268, 7269, 7270, 7271, 7272 |
| Cytochrome_c | UniProtKB: Q53XN1 | 7273 | 7274 | 7275, 7276, 7277, 7278, 7279, 7280 |
| Cytochrome_c | UniProtKB: Q6FGA0 | 7281 | 7282 | 7283, 7284, 7285, 7286, 7287, 7288 |
| Cytochrome_c | UniProtKB: Q6FGI7 | 7289 | 7290 | 7291, 7292, 7293, 7294, 7295, 7296 |
| Cytochrome_c | UniProtKB: Q71U45 | 7297 | 7298 | 7299, 7300, 7301, 7302, 7303, 7304 |
| Cytochrome_c | UniProtKB: Q86WV2 | 7305 | 7306 | 7307, 7308, 7309, 7310, 7311, 7312 |
| Cytochrome_c | UniProtKB: Q9UEG9 | 7313 | 7314 | 7315, 7316, 7317, 7318, 7319, 7320 |
| FasL | UniProtKB: P48023 | 7321 | 7322 | 7323, 7324, 7325, 7326, 7327, 7328 |
| Granzyme_B | UniProtKB: J3KQ52 | 7329 | 7330 | 7331, 7332, 7333, 7334, 7335, 7336 |
| Granzyme_B | UniProtKB: Q67BC3 | 7337 | 7338 | 7339, 7340, 7341, 7342, 7343, 7344 |
| Granzyme_B | UniProtKB: Q6XGZ2 | 7345 | 7346 | 7347, 7348, 7349, 7350, 7351, 7352 |
| Granzyme_B | UniProtKB: Q6XGZ3 | 7353 | 7354 | 7355, 7356, 7357, 7358, 7359, 7360 |
| Granzyme_B | UniProtKB: Q6XGZ4 | 7361 | 7362 | 7363, 7364, 7365, 7366, 7367, 7368 |
| TNF | UniProtKB: P01375 | 7369 | 7370 | 7371, 7372, 7373, 7374, 7375, 7376 |
| TNF | UniProtKB: Q5STB3 | 7377 | 7378 | 7379, 7380, 7381, 7382, 7383, 7384 |

According to the present invention, in a more preferred embodiment, the inventive composition comprises at least one RNA, preferably an mRNA comprising at least one coding region encoding at least one apoptosis inducer or cell death inducer or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 6.

6. Angiogenesis Inhibitors

In a further preferred embodiment of the inventive RNA containing composition the at least one RNA, preferably mRNA codes for at least one angiogenesis modulator or inhibitor, preferably an endogenous angiogenesis inhibitor or a fragment or variant thereof. Tumor growth and survival depend on angiogenesis to provide a path for delivery of oxygen and nutrients to tumor cells. By using RNA coding for at least one angiogenesis inhibitor according to the inventive approach it is possible to block angiogenesis in a localized manner, namely within the tumor tissue, thereby providing an effective method for stopping tumor growth and decreasing tumor volume. Preferred examples of angiogenesis inhibitors according to the invention may be chosen from the following list: interferon alpha (IFN-α), (interferon beta) IFN-β, interferon gamma (IFN-γ), CXCL9, CXCL10, interleukin 12 (IL-12), platelet factor 4 (PF-4), tumor necrosis factor alpha (TNF-α), soluble fms-like tyrosine kinase 1 (sFLT-1), Fetal Liver Kinase 1 (FLK-1), Angiostatin, Endostatin, Vasostatin, Canstatin, Tumstatin, 16 kD prolacin fragment, tissue inhibitor of metalloproteinases 1 (TIMP-1), tissue inhibitor of metalloproteinases 2 (TIMP-2), tissue inhibitor of metalloproteinases 3 (TIMP-3), thrombospondin 1 (TSP-1), thrombospondin 2 (TSP-2), Maspin, PEX, soluble Tyrosine-protein kinase receptor 1 (sTie1), soluble Angiopoietin-1 receptor 2 (sTie2), Angiopoietin-1, Angiopoietin-2, Antivascular endothelial growth factor receptor 2 (VEGFR2) antibody (e.g. Alacizumab, Ramucirumab), Anti-vascular endothelial growth factor (VEGF) antibody (e.g. Brolucizumab, Ranibizumab, Bevacizumab), and Anti-vascular endothelial growth factor receptor 1 (VEGFR1) antibody (e.g. Icrucumab).

Without this process of blood vessel recruitment, tumor growth is limited to 1 to 2 mm$^2$, the diffusion limit of oxygen. Already in 1971, Folkman proposed that tumor growth could be arrested by blocking angiogenesis (Folkman, 1972. N. Engl. J. Med. 285(21):1182-6).

Angiogenesis is a multistep process of new blood vessel formation from preexisting vasculature that includes the activation, proliferation and migration of endothelial cells (ECs), disruption of vascular basement membranes, remodeling of the extracellular matrix of tissues, formation of vascular tubes and networks, recruitment of supporting cells, including smooth muscle cells and pericytes, and connection to the pre-existing vascular network.

Within a given microenvironment, the angiogenic response results from a balance between pro-angiogenic and anti-angiogenic factors, secreted both by tumor cells and components of the stroma; the prevalence of the former determines the "angiogenic switch", resulting in the activation of angiogenesis followed by tumor outgrowth (Hanahan and Folkman, 1996. Cell 86(3):353-64).

Gene therapy based strategies of angiogenesis inhibition and especially the approach according to the present invention have several advantages compared with conventional modalities of administration of anti-angiogenic drugs. First of all, since effective suppression of pathological angiogenesis may eventually require chronic treatment, the gene therapy strategy according to the invention is useful to achieve selective delivery to affected tissues and prolonged expression of the therapeutic agents. Gene therapy in general also represents a method for circumventing the production problems of many recombinant proteins including their stability and solubility; adequate production of anti-angiogenic factors by recombinant engineering methods has been sometimes problematic (e.g. for angiostatin) and may limit their clinical application. Moreover gene transfer usage allows the correct folding of proteic agents and their stability in vivo since they are assembled in their physiologic environment. A particularly attractive feature of the inventive approach is the possibility of targeting gene delivery to selective tissues, namely tumor tissue, thus achieving localized gene expression and high regional drug concentrations without increasing the systemic levels of the therapeutic agents and thereby resulting in an improved therapeutic index.

Angiogenesis inhibitors are heterogeneous in origin and potency, and their growing list includes proteolysis products of larger molecules with a different function, such as angiostatin, endostatin and vasostatin, modulators of vascular endothelial growth factor activity, such as soluble FLT-1 (sFLT-1), and some cytokines/chemokines with marked anti-endothelial activity, such as IL-12, IFN-α, and CXCL10. The following table 8 (adapted from Persano et al., 2007. Mol. Aspects Med. 28(1):87-114. PMID: 17306361) summarizes the preferred angiogenesis inhibitors which may be used in the inventive approach. According to preferred embodiments in the context of the present invention angiogenesis inhibitors may be selected from any endogenous angiogenesis inhibitor selected from the group consisting of Angiopoietin-2; Angiostatin; Canstatin; CXCL10; CXCL4; CXCL9; Endostatin; FLK-1; IFNalpha; IFNB; IFNG; IL-12; PEX; PRL; SERPINB5; sFLT-1; sTie2; TIMP-1; TIMP-2; TIMP-3; TNF; TSP-1; TSP-2; Tumstatin; Vasostatin, preferably as disclosed in Table 7. Particularly preferred in this context are the RNA sequences encoding an angiogenesis inhibitor according to Table 7.

TABLE 7

Endogenous angiogenesis inhibitors

| Gene Name | Protein Accession No. | Protein Sequence SEQ ID NO: | RNA Sequence wild type SEQ ID NO: | Optimized RNA Sequence SEQ ID NO: |
|---|---|---|---|---|
| IFNalpha | UniProtKB: G9JKF1 | 3953 | 3954 | 3955, 3956, 3957, 3958, 3959, 3960 |
| IFNalpha | UniProtKB: P01562 | 3961 | 3962 | 3963, 3964, 3965, 3966, 3967, 3968 |
| IFNalpha | UniProtKB: P01563 | 3969 | 3970 | 3971, 3972, 3973, 3974, 3975, 3976 |
| IFNalpha | UniProtKB: P01566 | 3977 | 3978 | 3979, 3980, 3981, 3982, 3983, 3984 |
| IFNalpha | UniProtKB: P01567 | 3985 | 3986 | 3987, 3988, 3989, 3990, 3991, 3992 |
| IFNalpha | UniProtKB: P01568 | 3993 | 3994 | 3995, 3996, 3997, 3998, 3999, 4000 |
| IFNalpha | UniProtKB: P01569 | 4001 | 4002 | 4003, 4004, 4005, 4006, 4007, 4008 |
| IFNalpha | UniProtKB: P01570 | 4009 | 4010 | 4011, 4012, 4013, 4014, 4015, 4016 |
| IFNalpha | UniProtKB: P01571 | 4017 | 4018 | 4019, 4020, 4021, 4022, 4023, 4024 |
| IFNalpha | UniProtKB: P05013 | 4025 | 4026 | 4027, 4028, 4029, 4030, 4031, 4032 |
| IFNalpha | UniProtKB: P05014 | 4033 | 4034 | 4035, 4036, 4037, 4038, 4039, 4040 |

TABLE 7-continued

Endogenous angiogenesis inhibitors

| Gene Name | Protein Accession No. | Protein Sequence SEQ ID NO: | RNA Sequence wild type SEQ ID NO: | Optimized RNA Sequence SEQ ID NO: |
|---|---|---|---|---|
| IFNalpha | UniProtKB: P05015 | 4041 | 4042 | 4043, 4044, 4045, 4046, 4047, 4048 |
| IFNalpha | UniProtKB: P32881 | 4049 | 4050 | 4051, 4052, 4053, 4054, 4055, 4056 |
| IFNalpha | UniProtKB: Q14618 | 4057 | 4058 | 4059, 4060, 4061, 4062, 4063, 4064 |
| IFNalpha | UniProtKB: Q86UP4 | 4065 | 4066 | 4067, 4068, 4069, 4070, 4071, 4072 |
| IFNB | UniProtKB: P01574 | 4073 | 4074 | 4075, 4076, 4077, 4078, 4079, 4080 |
| IFNB | UniProtKB: Q15943 | 4081 | 4082 | 4083, 4084, 4085, 4086, 4087, 4088 |
| IFNG | UniProtKB: P01579 | 4089 | 4090 | 4091, 4092, 4093, 4094, 4095, 4096 |
| IFNG | UniProtKB: Q14609 | 4097 | 4098 | 4099, 4100, 4101, 4102, 4103, 4104 |
| IFNG | UniProtKB: Q14610 | 4105 | 4106 | 4107, 4108, 4109, 4110, 4111, 4112 |
| IFNG | UniProtKB: Q14611 | 4113 | 4114 | 4115, 4116, 4117, 4118, 4119, 4120 |
| IFNG | UniProtKB: Q14612 | 4121 | 4122 | 4123, 4124, 4125, 4126, 4127, 4128 |
| IFNG | UniProtKB: Q14613 | 4129 | 4130 | 4131, 4132, 4133, 4134, 4135, 4136 |
| IFNG | UniProtKB: Q14614 | 4137 | 4138 | 4139, 4140, 4141, 4142, 4143, 4144 |
| IFNG | UniProtKB: Q14615 | 4145 | 4146 | 4147, 4148, 4149, 4150, 4151, 4152 |
| IFNG | UniProtKB: Q8NHY9 | 4153 | 4154 | 4155, 4156, 4157, 4158, 4159, 4160 |
| IL-12 | UniProtKB: P29460 | 4193 | 4194 | 4195, 4196, 4197, 4198, 4199, 4200 |
| CXCL10 | UniProtKB: A0A024RDA4 | 5129 | 5130 | 5131, 5132, 5133, 5134, 5135, 5136 |
| CXCL10 | UniProtKB: P02778 | 5137 | 5138 | 5139, 5140, 5141, 5142, 5143, 5144 |
| CXCL4 | UniProtKB: P02776 | 5225 | 5226 | 5227, 5228, 5229, 5230, 5231, 5232 |
| CXCL9 | UniProtKB: L8E8X0 | 5273 | 5274 | 5275, 5276, 5277, 5278, 5279, 5280 |
| CXCL9 | UniProtKB: Q07325 | 5281 | 5282 | 5283, 5284, 5285, 5286, 5287, 5288 |
| TNF | UniProtKB: P01375 | 7369 | 7370 | 7371, 7372, 7373, 7374, 7375, 7376 |
| TNF | UniProtKB: Q5STB3 | 7377 | 7378 | 7379, 7380, 7381, 7382, 7383, 7384 |
| Angiopoietin-2 | UniProtKB: B2R6E3 | 7385 | 7386 | 7387, 7388, 7389, 7390, 7391, 7392 |
| Angiopoietin-2 | UniProtKB: O15123 | 7393 | 7394 | 7395, 7396, 7397, 7398, 7399, 7400 |
| Angiostatin | UniProtKB: A0A0F7G8J1 | 7401 | 7402 | 7403, 7404, 7405, 7406, 7407, 7408 |
| Angiostatin | UniProtKB: P00747 | 7409 | 7410 | 7411, 7412, 7413, 7414, 7415, 7416 |
| Angiostatin | UniProtKB: Q5TEH5 | 7417 | 7418 | 7419, 7420, 7421, 7422, 7423, 7424 |
| Canstatin | UniProtKB: P08572 | 7425 | 7426 | 7427, 7428, 7429, 7430, 7431, 7432 |
| Endostatin | Homo_sapiens | 7433 | 7434 | 7435, 7436, 7437, 7438, 7439, 7440 |
| FLK-1 | UniProtKB: P35968 | 7441 | 7442 | 7443, 7444, 7445, 7446, 7447, 7448 |
| PEX | UniProtKB: P78562 | 7449 | 7450 | 7451, 7452, 7453, 7454, 7455, 7456 |
| PRL | UniProtKB: P01236 | 7457 | 7458 | 7459, 7460, 7461, 7462, 7463, 7464 |
| SERPINB5 | UniProtKB: P36952 | 7465 | 7466 | 7467, 7468, 7469, 7470, 7471, 7472 |
| sFLT-1 | UniProtKB: H9N1E7 | 7473 | 7474 | 7475, 7476, 7477, 7478, 7479, 7480 |
| sFLT-1 | UniProtKB: H9N1E8 | 7481 | 7482 | 7483, 7484, 7485, 7486, 7487, 7488 |

TABLE 7-continued

Endogenous angiogenesis inhibitors

| Gene Name | Protein Accession No. | Protein Sequence SEQ ID NO: | RNA Sequence wild type SEQ ID NO: | Optimized RNA Sequence SEQ ID NO: |
|---|---|---|---|---|
| sFLT-1 | UniProtKB: L7RSL3 | 7489 | 7490 | 7491, 7492, 7493, 7494, 7495, 7496 |
| sFLT-1 | UniProtKB: P17948 | 7497 | 7498 | 7499, 7500, 7501, 7502, 7503, 7504 |
| sTie2 | UniProtKB: B5A953 | 7505 | 7506 | 7507, 7508, 7509, 7510, 7511, 7512 |
| TIMP-1 | UniProtKB: P01033 | 7513 | 7514 | 7515, 7516, 7517, 7518, 7519, 7520 |
| TIMP-2 | UniProtKB: P16035 | 7521 | 7522 | 7523, 7524, 7525, 7526, 7527, 7528 |
| TIMP-3 | UniProtKB: P35625 | 7529 | 7530 | 7531, 7532, 7533, 7534, 7535, 7536 |
| TSP-1 | UniProtKB: P07996 | 7537 | 7538 | 7539, 7540, 7541, 7542, 7543, 7544 |
| TSP-2 | UniProtKB: P35442 | 7545 | 7546 | 7547, 7548, 7549, 7550, 7551, 7552 |
| Tumstatin | UniProtKB: Q01955 | 7553 | 7554 | 7555, 7556, 7557, 7558, 7559, 7560 |
| Vasostatin | UniProtKB: P10645 | 7561 | 7562 | 7563, 7564, 7565, 7566, 7567, 7568 |

According to the present invention, in a more preferred embodiment, the inventive composition comprises at least one RNA, preferably an mRNA comprising at least one coding region encoding at least one angiogenesis inhibitor or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 7.

7. Heat Shock Proteins

In a further preferred embodiment of the inventive RNA containing composition the RNA codes for at least one heat shock protein (HSP) or a fragment or variant thereof. Preferably, the heat shock protein may be chosen from the following list: HSP27, HSP47 (serpin H1), HSP60, HSP70, HSC70, GRP78 (BiP), HSP90, HSP110, GRP94 (gp96), GRP170 (ORP150), PDI/PDIA, CRT/CALR.

As reviewed by Graner et al. (Graner M W, Lillehei K O, Katsanis E. Endoplasmic reticulum chaperones and their roles in the immunogenicity of cancer vaccines. Front Oncol. 2015 Jan. 6; 4:379. doi: 10.3389/fonc.2014.00379) heat shock proteins play essential cellular housekeeping functions and are indispensible during protein synthesis, folding and transport across intracellular membranes as well as protein degradation. HSPs belong to a multiprotein family of chaperons which consists of, but is not limited to, HSP27, HSP47 (serpin H1), HSP60, HSP70, HSC70, GRP78 (BiP), HSP90, HSP110, GRP94 (gp96), GRP170 (ORP150), PDI/PDIA, CRT/CALR. In addition to the intracellular functions as chaperons, HSPs have been shown to play an important extracellular role as simulators of the immune responses particularly in tumor settings. Various literature reports demonstrated that tumor-derived HSP-peptide complexes induce anti-tumor immune responses very efficiently. The molecular mechanism of these observations has been elucidated. HSPs as chaperons have the capacity to bind denatured peptides including the antigenic ones and those complexes are internalized by antigen presenting cells (APCs) which eventually leads to antigen presentation and induction of immunity. In addition to their chaperon function, HSPs have been shown to trigger danger signals in the tumor microenvironment and thus stimulate macrophages and dendritic cells (DCs) to produce proinflammatory cytokines and enhance the induced immune responses.

According to preferred embodiments in the context of the present invention heat shock proteins may be selected from any heat shock protein selected from the group consisting of calreticulin; GRP170_(ORP150); GRP78_(BiP); GRP94_(gp96); HSC70; HSP110; HSP27; HSP47_(serpin_H1); HSP60; HSP70; HSP90; PDI/PDIA, preferably as disclosed in Table 8. Particularly preferred in this context are the RNA sequences encoding a heat shock protein according to Table 8.

TABLE 8

Heat shock proteins

| Gene Name | Protein Accession No. | Protein Sequence SEQ ID NO: | RNA Sequence wild type SEQ ID NO: | Optimized RNA Sequence SEQ ID NO: |
|---|---|---|---|---|
| calreticulin | UniProtKB: B4DHR1 | 7569 | 7570 | 7571, 7572, 7573, 7574, 7575, 7576 |
| calreticulin | UniProtKB: B4E2Y9 | 7577 | 7578 | 7579, 7580, 7581, 7582, 7583, 7584 |

TABLE 8-continued

Heat shock proteins

| Gene Name | Protein Accession No. | Protein Sequence SEQ ID NO: | RNA Sequence wild type SEQ ID NO: | Optimized RNA Sequence SEQ ID NO: |
|---|---|---|---|---|
| calreticulin | UniProtKB: P27797 | 7585 | 7586 | 7587, 7588, 7589, 7590, 7591, 7592 |
| calreticulin | UniProtKB: Q96L12 | 7593 | 7594 | 7595, 7596, 7597, 7598, 7599, 7600 |
| GRP170_(ORP150) | UniProtKB: Q9Y4L1 | 7601 | 7602 | 7603, 7604, 7605, 7606, 7607, 7608 |
| GRP78_(BiP) | UniProtKB: P11021 | 7609 | 7610 | 7611, 7612, 7613, 7614, 7615, 7616 |
| GRP94_(gp96) | UniProtKB: P14625 | 7617 | 7618 | 7619, 7620, 7621, 7622, 7623, 7624 |
| HSC70 | UniProtKB: P11142 | 7625 | 7626 | 7627, 7628, 7629, 7630, 7631, 7632 |
| HSP110 | UniProtKB: Q92598 | 7633 | 7634 | 7635, 7636, 7637, 7638, 7639, 7640 |
| HSP27 | UniProtKB: P04792 | 7641 | 7642 | 7643, 7644, 7645, 7646, 7647, 7648 |
| HSP47_(serpin_H1) | UniProtKB: P50454 | 7649 | 7650 | 7651, 7652, 7653, 7654, 7655, 7656 |
| HSP60 | UniProtKB: A0A024R3X4 | 7657 | 7658 | 7659, 7660, 7661, 7662, 7663, 7664 |
| HSP60 | UniProtKB: B3GQS7 | 7665 | 7666 | 7667, 7668, 7669, 7670, 7671, 7672 |
| HSP60 | UniProtKB: P10809 | 7673 | 7674 | 7675, 7676, 7677, 7678, 7679, 7680 |
| HSP60 | UniProtKB: Q0VDF9 | 7681 | 7682 | 7683, 7684, 7685, 7686, 7687, 7688 |
| HSP70 | UniProtKB: P38646 | 7689 | 7690 | 7691, 7692, 7693, 7694, 7695, 7696 |
| HSP90 | UniProtKB: P07900 | 7697 | 7698 | 7699, 7700, 7701, 7702, 7703, 7704 |
| HSP90 | UniProtKB: P08238 | 7705 | 7706 | 7707, 7708, 7709, 7710, 7711, 7712 |
| PDI/PDIA | UniProtKB: P07237 | 7713 | 7714 | 7715, 7716, 7717, 7718, 7719, 7720 |
| PDI/PDIA | UniProtKB: Q6YPB00 | 7721 | 7722 | 7723, 7724, 7725, 7726, 7727, 7728 |
| PDI/PDIA | UniProtKB: Q71S60 | 7729 | 7730 | 7731, 7732, 7733, 7734, 7735, 7736 |

According to the present invention, in a more preferred embodiment, the inventive composition comprises at least one RNA, preferably an mRNA comprising at least one coding region encoding at least one heat shock protein or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 8.

8. Tumor Antigens

In a further preferred embodiment of the inventive RNA containing composition the composition may contain RNA, preferably mRNA which codes for at least one tumor antigen or a fragment or variant thereof, which are used for vaccination to induce an adaptive immune response according to the invention.

In this context tumor antigens are particularly preferred to be encoded by RNA, preferably mRNA comprised in the inventive RNA composition. It is particularly preferred that the inventive RNA composition comprises at least one RNA encoding at least one tumor antigen or a fragment or variant thereof.

Tumor antigens are preferably located on the surface of the (tumor) cell. Tumor antigens may also be selected from proteins, which are overexpressed in tumor cells compared to a normal cell. Furthermore, tumor antigens also includes antigens expressed in cells which are (were) not themselves (or originally not themselves) degenerated but are associated with the supposed tumor. Antigens which are connected with tumor-supplying vessels or (re)formation thereof, in particular those antigens which are associated with neovascularization, e.g. growth factors, such as VEGF, bFGF etc., are also included herein. Antigens connected with a tumor furthermore include antigens from cells or tissues, typically embedding the tumor. Further, some substances (usually proteins or peptides) are expressed in patients suffering (knowingly or not-knowingly) from a cancer disease and they occur in increased concentrations in the body fluids of said patients. These substances are also referred to as "tumor antigens", however they are not antigens in the stringent meaning of an immune response inducing substance. The class of tumor antigens can be divided further into tumor-specific antigens (TSAs) and tumor-associated-antigens (TAAs). TSAs can only be presented by tumor cells and never by normal "healthy" cells. They typically result from a tumor specific mutation. TAAs, which are more common, are usually presented by both tumor and healthy cells. These antigens are recognized and the antigen-presenting cell can be destroyed by cytotoxic T cells. Additionally, tumor antigens can also occur on the surface of the tumor in the form of, e.g., a mutated receptor. In this case, they can be recognized by antibodies.

Further, tumor associated antigens may be classified as tissue-specific antigens, also called melanocyte-specific antigens, cancer-testis antigens and tumor-specific antigens. Cancer-testis antigens are typically understood to be peptides or proteins of germ-line associated genes which may be activated in a wide variety of tumors. Human cancer-testis antigens may be further subdivided into antigens which are encoded on the X chromosome, so-called CT-X antigens, and those antigens which are not encoded on the X chromosome, the so-called (non-X CT antigens). Cancer-testis antigens which are encoded on the X-chromosome comprises, for example, the family of melanoma antigen genes, the so-called MAGE-family. The genes of the MAGE-family may be characterised by a shared MAGE homology domain (MHD). Each of these antigens, i.e. melanocyte-specific antigens, cancer-testis antigens and tumor-specific antigens, may elicit autologous cellular and humoral immune response. Accordingly, the tumor antigen encoded by the inventive nucleic acid sequence is preferably a melanocyte-specific antigen, a cancer-testis antigen or a tumor-specific antigens, preferably it may be a CT-X antigen, a non-X CT-antigens, a binding partner for a CT-X antigen or a binding partner for a non-X CT-antigen or a tumor-specific antigen, more preferably a CT-X antigen, a binding partner for a non-X CT-antigen or a tumor-specific antigen.

Particular preferred tumor antigens are selected from the list consisting of 5T4, 707-AP, 9D7, AFP, AlbZIP HPG1, alpha-5-beta-1-integrin, alpha-5-beta-6-integrin, alpha-actinin-4/m, alpha-methylacyl-coenzyme A racemase, ART-4, ARTC1/m, B7H4, BAGE-1, BCL-2, bcr/abl, beta-catenin/m, BING-4, BRCA1/m, BRCA2/m, CA 15-3/CA 27-29, CA 19-9, CA72-4, CA125, calreticulin, CAMEL, CASP-8/m, cathepsin B, cathepsin L, CD19, CD20, CD22, CD25, CDE30, CD33, CD4, CD52, CD55, CD56, CD80, CDC27/m, CDK4/m, CDKN2A/m, CEA, CLCA2, CML28, CML66, COA-1/m, coactosin-like protein, collage XXIII, COX-2, CT-9/BRD6, Cten, cyclin B1, cyclin D1, cyp-B, CYPB1, DAM-10, DAM-6, DEK-CAN, EFTUD2/m, EGFR, ELF2/m, EMMPRIN, EpCam, EphA2, EphA3, ErbB3, ETV6-AML1, EZH2, FGF-5, FN, Frau-1, G250, GAGE-1, GAGE-2, GAGE-3, GAGE-4, GAGE-5, GAGE-6, GAGE7b, GAGE-8, GDEP, GnT-V, gp100, GPC3, GPNMB/m, HAGE, HAST-2, hepsin, Her2/neu, HERV-K-MEL, HLA-A*0201-R17I, HLA-A11/m, HLA-A2/m, HNE, homeobox NKX3.1, HOM-TES-14/SCP-1, HOM-TES-85, HPV-E6, HPV-E7, HSP70-2M, HST-2, hTERT, iCE, IGF-1R, IL-13Ra2, IL-2R, IL-5, immature laminin receptor, kallikrein-2, kallikrein-4, Ki67, KIAA0205, KIAA0205/m, KK-LC-1, K-Ras/m, LAGE-A1, LDLR-FUT, MAGE-A1, MAGE-A2, MAGE-A3, MAGE-A4, MAGE-A6, MAGE-A9, MAGE-A10, MAGE-A12, MAGE-B1, MAGE-B2, MAGE-B3, MAGE-B4, MAGE-B5, MAGE-B6, MAGE-B10, MAGE-B16, MAGE-B17, MAGE-C1, MAGE-C2, MAGE-C3, MAGE-D1, MAGE-D2, MAGE-D4, MAGE-E1, MAGE-E2, MAGE-F1, MAGE-H1, MAGEL2, mammaglobin A, MART-1/melan-A, MART-2, MART-2/m, matrix protein 22, MC1R, M-CSF, ME1/m, mesothelin, MG50/PXDN, MMP11, MN/CA IX-antigen, MRP-3, MUC-1, MUC-2, MUM-1/m, MUM-2/m, MUM-3/m, myosin class I/m, NA88-A, N-acetylglucosaminyltransferase-V, Neo-PAP, Neo-PAP/m, NFYC/m, NGEP, NMP22, NPM/ALK, N-Ras/m, NSE, NY-ESO-B, NY-ESO-1, OA1, OFA-iLRP, OGT, OGT/m, OS-9, OS-9/m, osteocalcin, osteopontin, p15, p190 minor bcr-abl, p53, p53/m, PAGE-4, PAI-1, PAI-2, PAP, PART-1, PATE, PDEF, Pim-1-Kinase, Pin-1, Pml/PARalpha, POTE, PRAME, PRDX5/m, prostein, proteinase-3, PSA, PSCA, PSGR, PSM, PSMA, PTPRK/m, RAGE-1, RBAF600/m, RHAMM/CD168, RU1, RU2, S-100, SAGE, SART-1, SART-2, SART-3, SCC, SIRT2/m, Sp17, SSX-1, SSX-2/HOM-MEL-40, SSX-4, STAMP-1, STEAP-1, survivin, survivin-2B, SYT-SSX-1, SYT-SSX-2, TA-90, TAG-72, TARP, TEL-AML1, TGFbeta, TGFbetaRII, TGM-4, TPI/m, TRAG-3, TRG, TRP-1, TRP-2/6b, TRP/INT2, TRP-p8, tyrosinase, UPA, VEGFR1, VEGFR-2/FLK-1, and WT1. Such tumor antigens preferably may be selected from the group consisting of p53, CA125, EGFR, Her2/neu, hTERT, PAP, MAGE-A1, MAGE-A3, Mesothelin, MUC-1, GP100, MART-1, Tyrosinase, PSA, PSCA, PSMA, STEAP-1, VEGF, VEGFR1, VEGFR2, Ras, CEA or WT1, and more preferably from PAP, MAGE-A3, WT1, and MUC-1. Such tumor antigens preferably may be selected from the group consisting of MAGE-A1 (e.g. MAGE-A1 according to accession number M77481), MAGE-A2, MAGE-A3, MAGE-A6 (e.g. MAGE-A6 according to accession number NM_005363), MAGE-C1, MAGE-C2, melan-A (e.g. melan-A according to accession number NM_005511), GP100 (e.g. GP100 according to accession number M77348), tyrosinase (e.g. tyrosinase according to accession number NM_000372), surviving (e.g. survivin according to accession number AF077350), CEA (e.g. CEA according to accession number NM_004363), Her-2/neu (e.g. Her-2/neu according to accession number M11730), WT1 (e.g. WT1 according to accession number NM_000378), PRAME (e.g. PRAME according to accession number NM_006115), EGFRI (epidermal growth factor receptor 1) (e.g. EGFRI (epidermal growth factor receptor 1) according to accession number AF288738), MUC1, mucin-1 (e.g. mucin-1 according to accession number NM_002456), SEC61G (e.g. SEC61G according to accession number NM_014302), hTERT (e.g. hTERT accession number NM_198253), 5T4 (e.g. 5T4 according to accession number NM_006670), TRP-2 (e.g. TRP-2 according to accession number NM_001922), STEAP1, PCA, PSA, PSMA, etc.

According to preferred embodiments in the context of the present invention tumor antigens may be selected from any tumor antigen selected from the group consisting of 1A01_HLA-A/m; 1A02; 5T4; ACRBP; AFP; AKAP4; alpha-actinin-_4/m; alpha-methylacyl-coenzyme_A_racemase; ANDR; ART-4; ARTC1/m; AURKB; B2MG; B3GN5; B4GN1; B7H4; BAGE-1; BASI; BCL-2; bcr/abl; beta-catenin/m; BING-4; BIRC7; BRCA1/m; BY55; calreticulin; CAMEL; CASPA; Caspase_8; cathepsin_B; cathepsin_L; CD1A; CD1B; CD1C; CD1D; CD1E; CD20; CD22; CD276; CD33; CD3E; CD3Z; CD4; CD44_Isoform_1; CD44_Isoform_6; CD52; CD55; CD56; CD80; CD86; CD8A; CDC27/m; CDE30; CDK4/m; CDKN2A/m; CEA; CEAM6; CH3L2; CLCA2; CML28; CML66; COA-1/m; coactosin-like_protein; collagen_XXIII; COX-2; CP1B1; CSAG2; CT-_9/BRD6; CT45A1; CT55; CTAG2_Isoform_LAGE-1A; CTAG2_Isoform_LAGE-1B; CTCFL; Cten; cyclin_B1; cyclin_D1; cyp-B; DAM-10; DEP1A; E7; EF1A2; EFTUD2/m; EGFR; EGLN3; ELF2/m; EMMPRIN; EpCam; EphA2; EphA3; ErbB3; ERBB4; ERG; ETV6; EWS; EZH2; FABP7; FCGR3A_Version_1; FCGR3A_Version_2; FGF5; FGFR2; fibronectin; FOS; FOXP3; FUT1; G250; GAGE-1; GAGE-2; GAGE-3; GAGE-4; GAGE-5; GAGE-6; GAGE7b; GAGE-8_ (GAGE-2D); GASR; GnT-V; GPC3; GPNMB/m; GRM3; HAGE; hepsin; Her2/neu; HLA-A2/m; homeobox_ NKX3.1; HOM-TES-85; HPG1; HS71A; HS71B; HST-2; hTERT; iCE; IF2B3; IL-10; IL-13Ra2; IL2-RA; IL2-RB; IL2-RG; IL-5; IMP3; ITA5; ITB1; ITB6; kallikrein-2; kallikrein-4; KI20A; KIAA0205; KIF2C; KK-LC-1; LDLR; LGMN; LIRB2; LY6K; MAGA5; MAGA8; MAGAB; MAGE-_B1; MAGE-_E1; MAGE-A1; MAGE-A10; MAGE-A12; MAGE-A2; MAGE-A3; MAGE-A4; MAGE-A6; MAGE-A9; MAGE-B10; MAGE-B16; MAGE-B17; MAGE-B2; MAGE-B3; MAGE-B4; MAGE-B5; MAGE-B6; MAGE-C1; MAGE-C2; MAGE-C3; MAGE-D1; MAGE-D2; MAGE-D4; MAGE-E1_(MAGE1); MAGE-E2; MAGE-F1; MAGE-H1; MAGEL2; mammaglobin_A; MART-1/melan-A; MART-2; MC1_R; M-CSF; mesothelin; MITF; MMP1_1; MMP7; MUC-1; MUM-1/m; MUM-2/m; MYO1A; MYO1B; MYO1C; MYO1D; MYO1E; MYO1F; MYO1G; MYO1H; NA17; NA88-A; Neo-PAP; NFYC/m; NGEP; N-myc; NPM; NRCAM; NSE; NUF2; NY-ESO-1; OA1; OGT; OS-9; osteocalcin; osteopontin; p53; PAGE-4; PAI-1; PAI-2; PAP; PATE; PAX3; PAX5; PD1L1; PDCD1; PDEF; PECA1; PGCB; PGFRB; Pim-1_-Kinase; Pin-1; PLAC1; PMEL; PML; POTE; POTEF; PRAME; PRDX5/m; PRM2; prostein; proteinase-3; PSA; PSB9; PSCA; PSGR; PSM; PTPRC; RAB8A; RAGE-1; RARA; RASH; RASK; RASN; RGS5; RHAMM/CD168; RHOC; RSSA; RU1; RU2; RUNX1; S-100; SAGE; SART-_1; SART-2; SART-3; SEPR; SERPINB5; SIA7F; SIA8A; SIAT9; SIRT2/m; SOX10; SP17; SPNXA; SPXN3; SSX-1; SSX-2; SSX3; SSX-4; ST1A1; STAG2; STAMP-1; STEAP-1; survivin; Survivin-2B; SYCP1; SYT-SSX-1; SYT-SSX-2; TARP; TCRg; TF2AA; TGFbeta1; TGFR2; TGM-4; TIE2; TKTL1; TPI/m; TRGV11; TRGV9; TRPC1; TRP-p8; TSG10; TSPY1; TVC_(TRGV3); TX101; tyrosinase; TYRP1; TYRP2; UPA; VEGFR1; WT1; XAGE1, preferably as disclosed in Table 9. Particularly preferred in this context are the RNA sequences encoding a tumor antigen according to Table 9.

TABLE 9

Tumor antigens

| Gene Name | Protein Accession No. | Protein Sequence SEQ ID NO: | RNA Sequence wild type SEQ ID NO: | Optimized RNA Sequence SEQ ID NO: |
|---|---|---|---|---|
| 1A01_HLA-A/m | UniProtKB: P30443 | 398 | 399 | 400, 401, 402, 403, 404 |
| 1A02 | UniProtKB: P01892 | 405 | 406 | 407, 408, 409, 410, 411 |
| 5T4 | UniProtKB: Q13641 | 412 | 413 | 414, 415, 416, 417, 418 |
| ACRBP | UniProtKB: Q8NEB7 | 419 | 420 | 421, 422, 423, 424, 425 |
| AFP | UniProtKB: P02771 | 426 | 427 | 428, 429, 430, 431, 432 |
| AKAP4 | UniProtKB: Q5JQC9 | 433 | 434 | 435, 436, 437, 438, 439 |
| alpha-actinin-_4/m | UniProtKB: B4DSX0 | 440 | 441 | 442, 443, 444, 445, 446 |
| alpha-actinin-_4/m | UniProtKB: B4E337 | 447 | 448 | 449, 450, 451, 452, 453 |
| alpha-actinin-_4/m | UniProtKB: O43707 | 454 | 455 | 456, 457, 458, 459, 460 |
| alpha-methylacyl-coenzyme_A_racemase | UniProtKB: A0A024RE16 | 461 | 462 | 463, 464, 465, 466, 467 |
| alpha-methylacyl-coenzyme_A_racemase | UniProtKB: A8KAC3 | 468 | 469 | 470, 471, 472, 473, 474 |
| ANDR | UniProtKB: P10275 | 475 | 476 | 477, 478, 479, 480, 481 |
| ART-4 | UniProtKB: Q9ULX3 | 482 | 483 | 484, 485, 486, 487, 488 |
| ARTC1/m | UniProtKB: P52961 | 489 | 490 | 491, 492, 493, 494, 495 |
| AURKB | UniProtKB: Q96GD4 | 496 | 497 | 498, 499, 500, 501, 502 |
| B2MG | UniProtKB: P61769 | 503 | 504 | 505, 506, 507, 508, 509 |
| B3GN5 | UniProtKB: Q9BYG0 | 510 | 511 | 512, 513, 514, 515, 516 |
| B4GN1 | UniProtKB: Q00973 | 517 | 518 | 519, 520, 521, 522, 523 |
| B7H4 | UniProtKB: Q7Z7D3 | 524 | 525 | 526, 527, 528, 529, 530 |
| BAGE-1 | UniProtKB: Q13072 | 531 | 532 | 533, 534, 535, 536, 537 |
| BASI | UniProtKB: P35613 | 538 | 539 | 540, 541, 542, 543, 544 |
| BCL-2 | UniProtKB: A9QXG9 | 545 | 546 | 547, 548, 549, 550, 551 |
| bcr/abl | UniProtKB: A9UEZ4 | 552 | 553 | 554, 555, 556, 557, 558 |
| bcr/abl | UniProtKB: A9UEZ7 | 559 | 560 | 561, 562, 563, 564, 565 |
| bcr/abl | UniProtKB: A9UEZ8 | 566 | 567 | 568, 569, 570, 571, 572 |
| bcr/abl | UniProtKB: A9UEZ9 | 573 | 574 | 575, 576, 577, 578, 579 |
| bcr/abl | UniProtKB: A9UF00 | 580 | 581 | 582, 583, 584, 585, 586 |
| bcr/abl | UniProtKB: A9UF01 | 587 | 588 | 589, 590, 591, 592, 593 |
| bcr/abl | UniProtKB: A9UF03 | 594 | 595 | 596, 597, 598, 599, 600 |
| bcr/abl | UniProtKB: A9UF04 | 601 | 602 | 603, 604, 605, 606, 607 |
| bcr/abl | UniProtKB: A9UF05 | 608 | 609 | 610, 611, 612, 613, 614 |
| bcr/abl | UniProtKB: A9UF06 | 615 | 616 | 617, 618, 619, 620, 621 |
| bcr/abl | UniProtKB: A9UF08 | 622 | 623 | 624, 625, 626, 627, 628 |
| beta-catenin/m | UniProtKB: P35222 | 629 | 630 | 631, 632, 633, 634, 635 |
| beta-catenin/m | UniProtKB: Q8WYA6 | 636 | 637 | 638, 639, 640, 641, 642 |
| BING-4 | UniProtKB: O15213 | 643 | 644 | 645, 646, 647, 648, 649 |
| BIRC7 | UniProtKB: Q96CA5 | 650 | 651 | 652, 653, 654, 655, 656 |
| BRCA1/m | UniProtKB: A0A024R1V0 | 657 | 658 | 659, 660, 661, 662, 663 |
| BRCA1/m | UniProtKB: A0A024R1V7 | 664 | 665 | 666, 667, 668, 669, 670 |
| BRCA1/m | UniProtKB: A0A024R1Z8 | 671 | 672 | 673, 674, 675, 676, 677 |
| BRCA1/m | UniProtKB: A0A068BFX7 | 678 | 679 | 680, 681, 682, 683, 684 |
| BRCA1/m | UniProtKB: C6YB45 | 685 | 686 | 687, 688, 689, 690, 691 |
| BRCA1/m | UniProtKB: C6YB47 | 692 | 693 | 694, 695, 696, 697, 698 |
| BRCA1/m | UniProtKB: G3XAC3 | 699 | 700 | 701, 702, 703, 704, 705 |
| BY55 | UniProtKB: O95971 | 706 | 707 | 708, 709, 710, 711, 712 |
| CAMEL | UniProtKB: O95987 | 713 | 714 | 715, 716, 717, 718, 719 |
| CASPA | UniProtKB: Q92851-4 | 720 | 721 | 722, 723, 724, 725, 726 |
| cathepsin_B | UniProtKB: A0A024R374 | 727 | 728 | 729, 730, 731, 732, 733 |
| cathepsin_B | UniProtKB: P07858 | 734 | 735 | 736, 737, 738, 739, 740 |

TABLE 9-continued

| | | | | Optimized |
| | | Protein | RNA | RNA |
| | | Sequence | Sequence | Sequence |
| Gene Name | Protein Accession No. | SEQ ID NO: | wild type SEQ ID NO: | SEQ ID NO: |
|---|---|---|---|---|
| cathepsin_L | UniProtKB: A0A024R276 | 741 | 742 | 743, 744, 745, 746, 747 |
| cathepsin_L | UniProtKB: P07711 | 748 | 749 | 750, 751, 752, 753, 754 |
| cathepsin_L | UniProtKB: Q9HBQ7 | 755 | 756 | 757, 758, 759, 760, 761 |
| CD1A | UniProtKB: P06126 | 762 | 763 | 764, 765, 766, 767, 768 |
| CD1B | UniProtKB: P29016 | 769 | 770 | 771, 772, 773, 774, 775 |
| CD1C | UniProtKB: P29017 | 776 | 777 | 778, 779, 780, 781, 782 |
| CD1D | UniProtKB: P15813 | 783 | 784 | 785, 786, 787, 788, 789 |
| CD1E | UniProtKB: P15812 | 790 | 791 | 792, 793, 794, 795, 796 |
| CD20 | UniProtKB: P11836 | 797 | 798 | 799, 800, 801, 802, 803 |
| CD22 | UniProtKB: O60926 | 804 | 805 | 806, 807, 808, 809, 810 |
| CD22 | UniProtKB: P20273 | 811 | 812 | 813, 814, 815, 816, 817 |
| CD22 | UniProtKB: Q0EAF5 | 818 | 819 | 820, 821, 822, 823, 824 |
| CD276 | UniProtKB: Q5ZPR3 | 825 | 826 | 827, 828, 829, 830, 831 |
| CD33 | UniProtKB: B4DF51 | 832 | 833 | 834, 835, 836, 837, 838 |
| CD33 | UniProtKB: P20138 | 839 | 840 | 841, 842, 843, 844, 845 |
| CD33 | UniProtKB: Q546G0 | 846 | 847 | 848, 849, 850, 851, 852 |
| CD3E | UniProtKB: P07766 | 853 | 854 | 855, 856, 857, 858, 859 |
| CD3Z | UniProtKB: P20963 | 860 | 861 | 862, 863, 864, 865, 866 |
| CD44_Isoform_1 | UniProtKB: P16070 | 867 | 868 | 869, 870, 871, 872, 873 |
| CD44_Isoform_6 | UniProtKB: P16070-6 | 874 | 875 | 876, 877, 878, 879, 880 |
| CD4 | UniProtKB: P01730 | 881 | 882 | 883, 884, 885, 886, 887 |
| CD52 | UniProtKB: P31358 | 888 | 889 | 890, 891, 892, 893, 894 |
| CD52 | UniProtKB: Q6IBD0 | 895 | 896 | 897, 898, 899, 900, 901 |
| CD52 | UniProtKB: V9HWN9 | 902 | 903 | 904, 905, 906, 907, 908 |
| CD55 | UniProtKB: B1AP15 | 909 | 910 | 911, 912, 913, 914, 915 |
| CD55 | UniProtKB: D3DT85 | 916 | 917 | 918, 919, 920, 921, 922 |
| CD55 | UniProtKB: D3DT86 | 923 | 924 | 925, 926, 927, 928, 929 |
| CD55 | UniProtKB: P08174 | 930 | 931 | 932, 933, 934, 935, 936 |
| CD56 | UniProtKB: P13591 | 937 | 938 | 939, 940, 941, 942, 943 |
| CD80 | UniProtKB: A0N0P2 | 944 | 945 | 946, 947, 948, 949, 950 |
| CD80 | UniProtKB: P33681 | 951 | 952 | 953, 954, 955, 956, 957 |
| CD86 | UniProtKB: P42081 | 958 | 959 | 960, 961, 962, 963, 964 |
| CD8A | UniProtKB: P01732 | 965 | 966 | 967, 968, 969, 970, 971 |
| CDC27/m | UniProtKB: G5EA36 | 972 | 973 | 974, 975, 976, 977, 978 |
| CDC27/m | UniProtKB: P30260 | 979 | 980 | 981, 982, 983, 984, 985 |
| CDE30 | UniProtKB: P28908 | 986 | 987 | 988, 989, 990, 991, 992 |
| CDK4/m | UniProtKB: A0A024RBB6 | 993 | 994 | 995, 996, 997, 998, 999 |
| CDK4/m | UniProtKB: P11802 | 1000 | 1001 | 1002, 1003, 1004, 1005, 1006 |
| CDK4/m | UniProtKB: Q6LC83 | 1007 | 1008 | 1009, 1010, 1011, 1012, 1013 |
| CDK4/m | UniProtKB: Q96BE9 | 1014 | 1015 | 1016, 1017, 1018, 1019, 1020 |
| CDKN2A/m | UniProtKB: D1LYX3 | 1021 | 1022 | 1023, 1024, 1025, 1026, 1027 |
| CDKN2A/m | UniProtKB: G3XAG3 | 1028 | 1029 | 1030, 1031, 1032, 1033, 1034 |
| CDKN2A/m | UniProtKB: K7PML8 | 1035 | 1036 | 1037, 1038, 1039, 1040, 1041 |
| CDKN2A/m | UniProtKB: L8E941 | 1042 | 1043 | 1044, 1045, 1046, 1047, 1048 |
| CDKN2A/m | UniProtKB: Q8N726 | 1049 | 1050 | 1051, 1052, 1053, 1054, 1055 |
| CEA | RefSeq: NP_004354 | 1056 | 1057 | 1058, 1059, 1060, 1061, 1062 |
| CEAM6 | UniProtKB: P40199 | 1063 | 1064 | 1065, 1066, 1067, 1068, 1069 |
| CH3L2 | UniProtKB: Q15782 | 1070 | 1071 | 1072, 1073, 1074, 1075, 1076 |
| CLCA2 | UniProtKB: Q9UQC9 | 1077 | 1078 | 1079, 1080, 1081, 1082, 1083 |
| CML28 | UniProtKB: Q9NQT4 | 1084 | 1085 | 1086, 1087, 1088, 1089, 1090 |
| CML66 | UniProtKB: Q96RS6 | 1091 | 1092 | 1093, 1094, 1095, 1096, 1097 |
| COA-1/m | UniProtKB: Q5T124 | 1098 | 1099 | 1100, 1101, 1102, 1103, 1104 |
| coactosin-like_protein | UniProtKB: Q14019 | 1105 | 1106 | 1107, 1108, 1109, 1110, 1111 |
| collagen_XXIII | UniProtKB: L8EAS4 | 1112 | 1113 | 1114, 1115, 1116, 1117, 1118 |
| collagen_XXIII | UniProtKB: Q86Y22 | 1119 | 1120 | 1121, 1122, 1123, 1124, 1125 |

TABLE 9-continued

| | | | Tumor antigens | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| COX-2 | UniProtKB: Q6ZYK7 | 1126 | 1127 | 1128, 1129, 1130, 1131, 1132 |
| CP1B1 | UniProtKB: Q16678 | 1133 | 1134 | 1135, 1136, 1137, 1138, 1139 |
| CSAG2 | UniProtKB: Q9Y5P2-2 | 1140 | 1141 | 1142, 1143, 1144, 1145, 1146 |
| CSAG2 | UniProtKB: Q9Y5P2 | 1147 | 1148 | 1149, 1150, 1151, 1152, 1153 |
| CT45A1 | UniProtKB: Q5HYN5 | 1154 | 1155 | 1156, 1157, 1158, 1159, 1160 |
| CT55 | UniProtKB: Q8WUE5 | 1161 | 1162 | 1163, 1164, 1165, 1166, 1167 |
| CT-_9/BRD6 | UniProtKB: Q58F21 | 1168 | 1169 | 1170, 1171, 1172, 1173, 1174 |
| CTAG2_Isoform_LAGE-1A | UniProtKB: O75638-2 | 1175 | 1176 | 1177, 1178, 1179, 1180, 1181 |
| CTAG2_Isoform_LAGE-1B | UniProtKB: O75638 | 1182 | 1183 | 1184, 1185, 1186, 1187, 1188 |
| CTCFL | UniProtKB: Q8NI51 | 1189 | 1190 | 1191, 1192, 1193, 1194, 1195 |
| Cten | UniProtKB: Q8IZW8 | 1196 | 1197 | 1198, 1199, 1200, 1201, 1202 |
| cyclin_B1 | UniProtKB: P14635 | 1203 | 1204 | 1205, 1206, 1207, 1208, 1209 |
| cyclin_D1 | UniProtKB: P24385 | 1210 | 1211 | 1212, 1213, 1214, 1215, 1216 |
| cyp-B | UniProtKB: P23284 | 1217 | 1218 | 1219, 1220, 1221, 1222, 1223 |
| DAM-10 | UniProtKB: P43366 | 1224 | 1225 | 1226, 1227, 1228, 1229, 1230 |
| DEP1A | UniProtKB: Q5TB30 | 1231 | 1232 | 1233, 1234, 1235, 1236, 1237 |
| E7 | UniProtKB: P03129 | 1238 | 1239 | 1240, 1241, 1242, 1243, 1244 |
| E7 | UniProtKB: P06788 | 1245 | 1246 | 1247, 1248, 1249, 1250, 1251 |
| E7 | UniProtKB: P17387 | 1252 | 1253 | 1254, 1255, 1256, 1257, 1258 |
| E7 | UniProtKB: P06429 | 1259 | 1260 | 1261, 1262, 1263, 1264, 1265 |
| E7 | UniProtKB: P27230 | 1266 | 1267 | 1268, 1269, 1270, 1271, 1272 |
| E7 | UniProtKB: P24837 | 1273 | 1274 | 1275, 1276, 1277, 1278, 1279 |
| E7 | UniProtKB: P21736 | 1280 | 1281 | 1282, 1283, 1284, 1285, 1286 |
| E7 | UniProtKB: P26558 | 1287 | 1288 | 1289, 1290, 1291, 1292, 1293 |
| E7 | UniProtKB: P36831 | 1294 | 1295 | 1296, 1297, 1298, 1299, 1300 |
| E7 | UniProtKB: P36833 | 1301 | 1302 | 1303, 1304, 1305, 1306, 1307 |
| E7 | UniProtKB: Q9QCZ1 | 1308 | 1309 | 1310, 1311, 1312, 1313, 1314 |
| E7 | UniProtKB: Q81965 | 1315 | 1316 | 1317, 1318, 1319, 1320, 1321 |
| E7 | UniProtKB: Q80956 | 1322 | 1323 | 1324, 1325, 1326, 1327, 1328 |
| EF1A2 | UniProtKB: Q05639 | 1329 | 1330 | 1331, 1332, 1333, 1334, 1335 |
| EFTUD2/m | UniProtKB: Q15029 | 1336 | 1337 | 1338, 1339, 1340, 1341, 1342 |
| EGFR | UniProtKB: A0A0B4J1Y5 | 1343 | 1344 | 1345, 1346, 1347, 1348, 1349 |
| EGFR | UniProtKB: E7BSV0 | 1350 | 1351 | 1352, 1353, 1354, 1355, 1356 |
| EGFR | UniProtKB: L0R6G1 | 1357 | 1358 | 1359, 1360, 1361, 1362, 1363 |
| EGFR | UniProtKB: P00533-2 | 1364 | 1365 | 1366, 1367, 1368, 1369, 1370 |
| EGFR | UniProtKB: P00533 | 1371 | 1372 | 1373, 1374, 1375, 1376, 1377 |

TABLE 9-continued

| | Tumor antigens | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| EGFR | UniProtKB: Q147T7 | 1378 | 1379 | 1380, 1381, 1382, 1383, 1384 |
| EGFR | UniProtKB: Q504U8 | 1385 | 1386 | 1387, 1388, 1389, 1390, 1391 |
| EGFR | UniProtKB: Q8NDU8 | 1392 | 1393 | 1394, 1395, 1396, 1397, 1398 |
| EGLN3 | UniProtKB: Q9H6Z9 | 1399 | 1400 | 1401, 1402, 1403, 1404, 1405 |
| ELF2/m | UniProtKB: B7Z720 | 1406 | 1407 | 1408, 1409, 1410, 1411, 1412 |
| EMMPRIN | UniProtKB: Q54A51 | 1413 | 1414 | 1415, 1416, 1417, 1418, 1419 |
| EpCam | UniProtKB: P16422 | 1420 | 1421 | 1422, 1423, 1424, 1425, 1426 |
| EphA2 | UniProtKB: P29317 | 1427 | 1428 | 1429, 1430, 1431, 1432, 1433 |
| EphA3 | UniProtKB: P29320 | 1434 | 1435 | 1436, 1437, 1438, 1439, 1440 |
| EphA3 | UniProtKB: Q6P4R6 | 1441 | 1442 | 1443, 1444, 1445, 1446, 1447 |
| ErbB3 | UniProtKB: B3KWG5 | 1448 | 1449 | 1450, 1451, 1452, 1453, 1454 |
| ErbB3 | UniProtKB: B4DGQ7 | 1455 | 1456 | 1457, 1458, 1459, 1460, 1461 |
| ERBB4 | UniProtKB: Q15303 | 1462 | 1463 | 1464, 1465, 1466, 1467, 1468 |
| ERG | UniProtKB: P11308 | 1469 | 1470 | 1471, 1472, 1473, 1474, 1475 |
| ETV6 | UniProtKB: P41212 | 1476 | 1477 | 1478, 1479, 1480, 1481, 1482 |
| EWS | UniProtKB: Q01844 | 1483 | 1484 | 1485, 1486, 1487, 1488, 1489 |
| EZH2 | UniProtKB: F2YMM1 | 1490 | 1491 | 1492, 1493, 1494, 1495, 1496 |
| EZH2 | UniProtKB: G3XAL2 | 1497 | 1498 | 1499, 1500, 1501, 1502, 1503 |
| EZH2 | UniProtKB: L0R855 | 1504 | 1505 | 1506, 1507, 1508, 1509, 1510 |
| EZH2 | UniProtKB: Q15910 | 1511 | 1512 | 1513, 1514, 1515, 1516, 1517 |
| EZH2 | UniProtKB: S4S3R8 | 1518 | 1519 | 1520, 1521, 1522, 1523, 1524 |
| FABP7 | UniProtKB: O15540 | 1525 | 1526 | 1527, 1528, 1529, 1530, 1531 |
| FCGR3A_Version_1 | UniProtKB: P08637 | 1532 | 1533 | 1534, 1535, 1536, 1537, 1538 |
| FCGR3A_Version_2 | CCDS: CCDS1232.1 | 1539 | 1540 | 1541, 1542, 1543, 1544, 1545 |
| FGF5 | UniProtKB: P12034 | 1546 | 1547 | 1548, 1549, 1550, 1551, 1552 |
| FGF5 | UniProtKB: Q60518 | 1553 | 1554 | 1555, 1556, 1557, 1558, 1559 |
| FGFR2 | UniProtKB: P21802 | 1560 | 1561 | 1562, 1563, 1564, 1565, 1566 |
| fibronectin | UniProtKB: A0A024R5I6 | 1567 | 1568 | 1569, 1570, 1571, 1572, 1573 |
| fibronectin | UniProtKB: A0A024RB01 | 1574 | 1575 | 1576, 1577, 1578, 1579, 1580 |
| fibronectin | UniProtKB: A0A024RDT9 | 1581 | 1582 | 1583, 1584, 1585, 1586, 1587 |
| fibronectin | UniProtKB: A0A024RDV5 | 1588 | 1589 | 1590, 1591, 1592, 1593, 1594 |
| fibronectin | UniProtKB: A6NH44 | 1595 | 1596 | 1597, 1598, 1599, 1600, 1601 |
| fibronectin | UniProtKB: A8K6A5 | 1602 | 1603 | 1604, 1605, 1606, 1607, 1608 |
| fibronectin | UniProtKB: B2R627 | 1609 | 1610 | 1611, 1612, 1613, 1614, 1615 |
| fibronectin | UniProtKB: B3KXM5 | 1616 | 1617 | 1618, 1619, 1620, 1621, 1622 |
| fibronectin | UniProtKB: B4DIC5 | 1623 | 1624 | 1625, 1626, 1627, 1628, 1629 |

TABLE 9-continued

| | | | Tumor antigens | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| fibronectin | UniProtKB: B4DN21 | 1630 | 1631 | 1632, 1633, 1634, 1635, 1636 |
| fibronectin | UniProtKB: B4DS98 | 1637 | 1638 | 1639, 1640, 1641, 1642, 1643 |
| fibronectin | UniProtKB: B4DTH2 | 1644 | 1645 | 1646, 1647, 1648, 1649, 1650 |
| fibronectin | UniProtKB: B4DTK1 | 1651 | 1652 | 1653, 1654, 1655, 1656, 1657 |
| fibronectin | UniProtKB: B4DU16 | 1658 | 1659 | 1660, 1661, 1662, 1663, 1664 |
| fibronectin | UniProtKB: B7Z3W5 | 1665 | 1666 | 1667, 1668, 1669, 1670, 1671 |
| fibronectin | UniProtKB: B7Z939 | 1672 | 1673 | 1674, 1675, 1676, 1677, 1678 |
| fibronectin | UniProtKB: G5E9X3 | 1679 | 1680 | 1681, 1682, 1683, 1684, 1685 |
| fibronectin | UniProtKB: Q9H382 | 1686 | 1687 | 1688, 1689, 1690, 1691, 1692 |
| FOS | UniProtKB: P01100 | 1693 | 1694 | 1695, 1696, 1697, 1698, 1699 |
| FOXP3 | UniProtKB: Q9BZS1 | 1700 | 1701 | 1702, 1703, 1704, 1705, 1706 |
| FUT1 | UniProtKB: P19526 | 1707 | 1708 | 1709, 1710, 1711, 1712, 1713 |
| G250 | UniProtKB: Q16790 | 1714 | 1715 | 1716, 1717, 1718, 1719, 1720 |
| GAGE-1 | Genbank: AAA82744 | 1721 | 1722 | 1723, 1724, 1725, 1726, 1727 |
| GAGE-2 | UniProtKB: Q6NT46 | 1728 | 1729 | 1730, 1731, 1732, 1733, 1734 |
| GAGE-3 | UniProtKB: Q13067 | 1735 | 1736 | 1737, 1738, 1739, 1740, 1741 |
| GAGE-4 | UniProtKB: Q13068 | 1742 | 1743 | 1744, 1745, 1746, 1747, 1748 |
| GAGE-5 | UniProtKB: Q13069 | 1749 | 1750 | 1751, 1752, 1753, 1754, 1755 |
| GAGE-6 | UniProtKB: Q13070 | 1756 | 1757 | 1758, 1759, 1760, 1761, 1762 |
| GAGE7b | UniProtKB: O76087 | 1763 | 1764 | 1765, 1766, 1767, 1768, 1769 |
| GAGE-8_(GAGE-2D) | UniProtKB: Q9UEU5 | 1770 | 1771 | 1772, 1773, 1774, 1775, 1776 |
| GASR | UniProtKB: P32239 | 1777 | 1778 | 1779, 1780, 1781, 1782, 1783 |
| GnT-V | UniProtKB: Q09328 | 1784 | 1785 | 1786, 1787, 1788, 1789, 1790 |
| GPC3 | UniProtKB: I6QJG3 | 1791 | 1792 | 1793, 1794, 1795, 1796, 1797 |
| GPC3 | UniProtKB: P51654 | 1798 | 1799 | 1800, 1801, 1802, 1803, 1804 |
| GPC3 | UniProtKB: Q8IYG2 | 1805 | 1806 | 1807, 1808, 1809, 1810, 1811 |
| GPNMB/m | UniProtKB: A0A024RA55 | 1812 | 1813 | 1814, 1815, 1816, 1817, 1818 |
| GPNMB/m | UniProtKB: Q14956 | 1819 | 1820 | 1821, 1822, 1823, 1824, 1825 |
| GPNMB/m | UniProtKB: Q8IXJ5 | 1826 | 1827 | 1828, 1829, 1830, 1831, 1832 |
| GPNMB/m | UniProtKB: Q96F58 | 1833 | 1834 | 1835, 1836, 1837, 1838, 1839 |
| GRM3 | UniProtKB: Q14832 | 1840 | 1841 | 1842, 1843, 1844, 1845, 1846 |
| HAGE | UniProtKB: Q9NXZ2 | 1847 | 1848 | 1849, 1850, 1851, 1852, 1853 |
| hepsin | UniProtKB: B2ZDQ2 | 1854 | 1855 | 1856, 1857, 1858, 1859, 1860 |
| hepsin | UniProtKB: P05981 | 1861 | 1862 | 1863, 1864, 1865, 1866, 1867 |
| Her2/neu | UniProtKB: B4DTR1 | 1868 | 1869 | 1870, 1871, 1872, 1873, 1874 |
| Her2/neu | UniProtKB: L8E8G2 | 1875 | 1876 | 1877, 1878, 1879, 1880, 1881 |

TABLE 9-continued

| | Tumor antigens | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| Her2/neu | UniProtKB: P04626 | 1882 | 1883 | 1884, 1885, 1886, 1887, 1888 |
| Her2/neu | UniProtKB: Q9UK79 | 1889 | 1890 | 1891, 1892, 1893, 1894, 1895 |
| HLA-A2/m | UniProtKB: Q95387 | 1896 | 1897 | 1898, 1899, 1900, 1901, 1902 |
| HLA-A2/m | UniProtKB: Q9MYF8 | 1903 | 1904 | 1905, 1906, 1907, 1908, 1909 |
| homeobox_NKX3.1 | UniProtKB: Q99801 | 1910 | 1911 | 1912, 1913, 1914, 1915, 1916 |
| HOM-TES-85 | UniProtKB: B2RBQ6 | 1917 | 1918 | 1919, 1920, 1921, 1922, 1923 |
| HOM-TES-85 | UniProtKB: Q9P127 | 1924 | 1925 | 1926, 1927, 1928, 1929, 1930 |
| HPG1 | Pubmed: 12543784 | 1931 | 1932 | 1933, 1934, 1935, 1936, 1937 |
| HS71A | UniProtKB: P0DMV8 | 1938 | 1939 | 1940, 1941, 1942, 1943, 1944 |
| HS71B | UniProtKB: P0DMV9 | 1945 | 1946 | 1947, 1948, 1949, 1950, 1951 |
| HST-2 | UniProtKB: P10767 | 1952 | 1953 | 1954, 1955, 1956, 1957, 1958 |
| hTERT | UniProtKB: O94807 | 1959 | 1960 | 1961, 1962, 1963, 1964, 1965 |
| iCE | UniProtKB: O00748 | 1966 | 1967 | 1968, 1969, 1970, 1971, 1972 |
| IF2B3 | UniProtKB: O00425 | 1973 | 1974 | 1975, 1976, 1977, 1978, 1979 |
| IL-13Ra2 | UniProtKB: Q14627 | 1980 | 1981 | 1982, 1983, 1984, 1985, 1986 |
| IL2-RA | UniProtKB: P01589 | 1987 | 1988 | 1989, 1990, 1991, 1992, 1993 |
| IL2-RB | UniProtKB: P14784 | 1994 | 1995 | 1996, 1997, 1998, 1999, 2000 |
| IL2-RG | UniProtKB: P31785 | 2001 | 2002 | 2003, 2004, 2005, 2006, 2007 |
| IMP3 | UniProtKB: Q9NV31 | 2008 | 2009 | 2010, 2011, 2012, 2013, 2014 |
| ITA5 | UniProtKB: P08648 | 2015 | 2016 | 2017, 2018, 2019, 2020, 2021 |
| ITB1 | UniProtKB: P05556 | 2022 | 2023 | 2024, 2025, 2026, 2027, 2028 |
| ITB6 | UniProtKB: P18564 | 2029 | 2030 | 2031, 2032, 2033, 2034, 2035 |
| kallikrein-2 | UniProtKB: A0A024R4J4 | 2036 | 2037 | 2038, 2039, 2040, 2041, 2042 |
| kallikrein-2 | UniProtKB: A0A024R4N3 | 2043 | 2044 | 2045, 2046, 2047, 2048, 2049 |
| kallikrein-2 | UniProtKB: B0AZU9 | 2050 | 2051 | 2052, 2053, 2054, 2055, 2056 |
| kallikrein-2 | UniProtKB: B4DU77 | 2057 | 2058 | 2059, 2060, 2061, 2062, 2063 |
| kallikrein-2 | UniProtKB: P20151 | 2064 | 2065 | 2066, 2067, 2068, 2069, 2070 |
| kallikrein-2 | UniProtKB: Q6T774 | 2071 | 2072 | 2073, 2074, 2075, 2076, 2077 |
| kallikrein-2 | UniProtKB: Q6T775 | 2078 | 2079 | 2080, 2081, 2082, 2083, 2084 |
| kallikrein-4 | UniProtKB: A0A0C4DFQ5 | 2085 | 2086 | 2087, 2088, 2089, 2090, 2091 |
| kallikrein-4 | UniProtKB: Q5BQA0 | 2092 | 2093 | 2094, 2095, 2096, 2097, 2098 |
| kallikrein-4 | UniProtKB: Q96PT0 | 2099 | 2100 | 2101, 2102, 2103, 2104, 2105 |
| kallikrein-4 | UniProtKB: Q96PT1 | 2106 | 2107 | 2108, 2109, 2110, 2111, 2112 |
| kallikrein-4 | UniProtKB: Q9Y5K2 | 2113 | 2114 | 2115, 2116, 2117, 2118, 2119 |
| KI20A | UniProtKB: O95235 | 2120 | 2121 | 2122, 2123, 2124, 2125, 2126 |
| KIAA0205 | UniProtKB: Q92604 | 2127 | 2128 | 2129, 2130, 2131, 2132, 2133 |

TABLE 9-continued

Tumor antigens

| Gene Name | Protein Accession No. | Protein Sequence SEQ ID NO: | RNA Sequence wild type SEQ ID NO: | Optimized RNA Sequence SEQ ID NO: |
|---|---|---|---|---|
| KIF2C | UniProtKB: Q99661 | 2134 | 2135 | 2136, 2137, 2138, 2139, 2140 |
| KK-LC-1 | UniProtKB: Q5H943 | 2141 | 2142 | 2143, 2144, 2145, 2146, 2147 |
| LDLR | UniProtKB: P01130 | 2148 | 2149 | 2150, 2151, 2152, 2153, 2154 |
| LGMN | UniProtKB: Q99538 | 2155 | 2156 | 2157, 2158, 2159, 2160, 2161 |
| LIRB2 | UniProtKB: Q8N423 | 2162 | 2163 | 2164, 2165, 2166, 2167, 2168 |
| LY6K | UniProtKB: Q17RY6 | 2169 | 2170 | 2171, 2172, 2173, 2174, 2175 |
| MAGA5 | UniProtKB: P43359 | 2176 | 2177 | 2178, 2179, 2180, 2181, 2182 |
| MAGA8 | UniProtKB: P43361 | 2183 | 2184 | 2185, 2186, 2187, 2188, 2189 |
| MAGAB | UniProtKB: P43364 | 2190 | 2191 | 2192, 2193, 2194, 2195, 2196 |
| MAGE-A10 | UniProtKB: A0A024RC14 | 2197 | 2198 | 2199, 2200, 2201, 2202, 2203 |
| MAGE-A12 | UniProtKB: P43365 | 2204 | 2205 | 2206, 2207, 2208, 2209, 2210 |
| MAGE-A1 | UniProtKB: P43355 | 2211 | 2212 | 2213, 2214, 2215, 2216, 2217 |
| MAGE-A2 | UniProtKB: P43356 | 2218 | 2219 | 2220, 2221, 2222, 2223, 2224 |
| MAGE-A3 | UniProtKB: P43357 | 2225 | 2226 | 2227, 2228, 2229, 2230, 2231 |
| MAGE-A4 | UniProtKB: A0A024RC12 | 2232 | 2233 | 2234, 2235, 2236, 2237, 2238 |
| MAGE-A4 | UniProtKB: P43358 | 2239 | 2240 | 2241, 2242, 2243, 2244, 2245 |
| MAGE-A4 | UniProtKB: Q1RN33 | 2246 | 2247 | 2248, 2249, 2250, 2251, 2252 |
| MAGE-A6 | UniProtKB: A8K072 | 2253 | 2254 | 2255, 2256, 2257, 2258, 2259 |
| MAGE-A6 | UniProtKB: P43360 | 2260 | 2261 | 2262, 2263, 2264, 2265, 2266 |
| MAGE-A6 | UniProtKB: Q6FHI5 | 2267 | 2268 | 2269, 2270, 2271, 2272, 2273 |
| MAGE-A9 | UniProtKB: P43362 | 2274 | 2275 | 2276, 2277, 2278, 2279, 2280 |
| MAGE-B10 | UniProtKB: Q96LZ2 | 2281 | 2282 | 2283, 2284, 2285, 2286, 2287 |
| MAGE-B16 | UniProtKB: A2A368 | 2288 | 2289 | 2290, 2291, 2292, 2293, 2294 |
| MAGE-B17 | UniProtKB: A8MXT2 | 2295 | 2296 | 2297, 2298, 2299, 2300, 2301 |
| MAGE-_B1 | UniProtKB: Q96TG1 | 2302 | 2303 | 2304, 2305, 2306, 2307, 2308 |
| MAGE-B2 | UniProtKB: O15479 | 2309 | 2310 | 2311, 2312, 2313, 2314, 2315 |
| MAGE-B3 | UniProtKB: O15480 | 2316 | 2317 | 2318, 2319, 2320, 2321, 2322 |
| MAGE-B4 | UniProtKB: O15481 | 2323 | 2324 | 2325, 2326, 2327, 2328, 2329 |
| MAGE-B5 | UniProtKB: Q9BZ81 | 2330 | 2331 | 2332, 2333, 2334, 2335, 2336 |
| MAGE-B6 | UniProtKB: Q8N7X4 | 2337 | 2338 | 2339, 2340, 2341, 2342, 2343 |
| MAGE-C1 | UniProtKB: O60732 | 2344 | 2345 | 2346, 2347, 2348, 2349, 2350 |
| MAGE-C2 | UniProtKB: Q9UBF1 | 2351 | 2352 | 2353, 2354, 2355, 2356, 2357 |
| MAGE-C3 | UniProtKB: Q8TD91 | 2358 | 2359 | 2360, 2361, 2362, 2363, 2364 |
| MAGE-D1 | UniProtKB: Q9Y5V3 | 2365 | 2366 | 2367, 2368, 2369, 2370, 2371 |
| MAGE-D2 | UniProtKB: Q9UNF1 | 2372 | 2373 | 2374, 2375, 2376, 2377, 2378 |
| MAGE-D4 | UniProtKB: Q96JG8 | 2379 | 2380 | 2381, 2382, 2383, 2384, 2385 |

TABLE 9-continued

| | | | | Tumor antigens | |
|---|---|---|---|---|---|
| Gene Name | Protein Accession No. | Protein Sequence SEQ ID NO: | RNA Sequence wild type SEQ ID NO: | Optimized RNA Sequence SEQ ID NO: | |
| MAGE-_E1 | UniProtKB: Q6IAI7 | 2386 | 2387 | 2388, 2389, 2390, 2391, 2392 | |
| MAGE-E1_(MAGE1) | UniProtKB: Q9HCI5 | 2393 | 2394 | 2395, 2396, 2397, 2398, 2399 | |
| MAGE-E2 | UniProtKB: Q8TD90 | 2400 | 2401 | 2402, 2403, 2404, 2405, 2406 | |
| MAGE-F1 | UniProtKB: Q9HAY2 | 2407 | 2408 | 2409, 2410, 2411, 2412, 2413 | |
| MAGE-H1 | UniProtKB: Q9H213 | 2414 | 2415 | 2416, 2417, 2418, 2419, 2420 | |
| MAGEL2 | UniProtKB: Q9UJ55 | 2421 | 2422 | 2423, 2424, 2425, 2426, 2427 | |
| mammaglobin_A | UniProtKB: Q13296 | 2428 | 2429 | 2430, 2431, 2432, 2433, 2434 | |
| mammaglobin_A | UniProtKB: Q6NX70 | 2435 | 2436 | 2437, 2438, 2439, 2440, 2441 | |
| MART-1/melan-A | UniProtKB: Q16655 | 2442 | 2443 | 2444, 2445, 2446, 2447, 2448 | |
| MART-2 | UniProtKB: Q5VTY9 | 2449 | 2450 | 2451, 2452, 2453, 2454, 2455 | |
| MC1_R | UniProtKB: Q01726 | 2456 | 2457 | 2458, 2459, 2460, 2461, 2462 | |
| MC1_R | UniProtKB: Q1JUL4 | 2463 | 2464 | 2465, 2466, 2467, 2468, 2469 | |
| MC1_R | UniProtKB: Q1JUL6 | 2470 | 2471 | 2472, 2473, 2474, 2475, 2476 | |
| MC1_R | UniProtKB: Q1JUL8 | 2477 | 2478 | 2479, 2480, 2481, 2482, 2483 | |
| MC1_R | UniProtKB: Q1JUL9 | 2484 | 2485 | 2486, 2487, 2488, 2489, 2490 | |
| MC1_R | UniProtKB: Q1JUM0 | 2491 | 2492 | 2493, 2494, 2495, 2496, 2497 | |
| MC1_R | UniProtKB: Q1JUM2 | 2498 | 2499 | 2500, 2501, 2502, 2503, 2504 | |
| MC1_R | UniProtKB: Q1JUM3 | 2505 | 2506 | 2507, 2508, 2509, 2510, 2511 | |
| MC1_R | UniProtKB: Q1JUM4 | 2512 | 2513 | 2514, 2515, 2516, 2517, 2518 | |
| MC1_R | UniProtKB: Q1JUM5 | 2519 | 2520 | 2521, 2522, 2523, 2524, 2525 | |
| MC1_R | UniProtKB: Q6UR92 | 2526 | 2527 | 2528, 2529, 2530, 2531, 2532 | |
| MC1_R | UniProtKB: Q6UR94 | 2533 | 2534 | 2535, 2536, 2537, 2538, 2539 | |
| MC1_R | UniProtKB: Q6UR95 | 2540 | 2541 | 2542, 2543, 2544, 2545, 2546 | |
| MC1_R | UniProtKB: Q6UR96 | 2547 | 2548 | 2549, 2550, 2551, 2552, 2553 | |
| MC1_R | UniProtKB: Q6UR97 | 2554 | 2555 | 2556, 2557, 2558, 2559, 2560 | |
| MC1_R | UniProtKB: Q6UR98 | 2561 | 2562 | 2563, 2564, 2565, 2566, 2567 | |
| MC1_R | UniProtKB: Q6UR99 | 2568 | 2569 | 2570, 2571, 2572, 2573, 2574 | |
| MC1_R | UniProtKB: Q6URA0 | 2575 | 2576 | 2577, 2578, 2579, 2580, 2581 | |
| MC1_R | UniProtKB: Q86YW1 | 2582 | 2583 | 2584, 2585, 2586, 2587, 2588 | |
| MC1_R | UniProtKB: V9Q5S2 | 2589 | 2590 | 2591, 2592, 2593, 2594, 2595 | |
| MC1_R | UniProtKB: V9Q671 | 2596 | 2597 | 2598, 2599, 2600, 2601, 2602 | |
| MC1_R | UniProtKB: V9Q783 | 2603 | 2604 | 2605, 2606, 2607, 2608, 2609 | |
| MC1_R | UniProtKB: V9Q7F1 | 2610 | 2611 | 2612, 2613, 2614, 2615, 2616 | |
| MC1_R | UniProtKB: V9Q8N1 | 2617 | 2618 | 2619, 2620, 2621, 2622, 2623 | |
| MC1_R | UniProtKB: V9Q977 | 2624 | 2625 | 2626, 2627, 2628, 2629, 2630 | |
| MC1_R | UniProtKB: V9Q9P5 | 2631 | 2632 | 2633, 2634, 2635, 2636, 2637 | |

TABLE 9-continued

| | | | | |
|---|---|---|---|---|
| | | | Tumor antigens | |
| Gene Name | Protein Accession No. | Protein Sequence SEQ ID NO: | RNA Sequence wild type SEQ ID NO: | Optimized RNA Sequence SEQ ID NO: |
| MC1_R | UniProtKB: V9Q9R8 | 2638 | 2639 | 2640, 2641, 2642, 2643, 2644 |
| MC1_R | UniProtKB: V9QAE0 | 2645 | 2646 | 2647, 2648, 2649, 2650, 2651 |
| MC1_R | UniProtKB: V9QAR2 | 2652 | 2653 | 2654, 2655, 2656, 2657, 2658 |
| MC1_R | UniProtKB: V9QAW3 | 2659 | 2660 | 2661, 2662, 2663, 2664, 2665 |
| MC1_R | UniProtKB: V9QB02 | 2666 | 2667 | 2668, 2669, 2670, 2671, 2672 |
| MC1_R | UniProtKB: V9QB58 | 2673 | 2674 | 2675, 2676, 2677, 2678, 2679 |
| MC1_R | UniProtKB: V9QBY6 | 2680 | 2681 | 2682, 2683, 2684, 2685, 2686 |
| MC1_R | UniProtKB: V9QC17 | 2687 | 2688 | 2689, 2690, 2691, 2692, 2693 |
| MC1_R | UniProtKB: V9QC66 | 2694 | 2695 | 2696, 2697, 2698, 2699, 2700 |
| MC1_R | UniProtKB: V9QCQ4 | 2701 | 2702 | 2703, 2704, 2705, 2706, 2707 |
| MC1_R | UniProtKB: V9QDF4 | 2708 | 2709 | 2710, 2711, 2712, 2713, 2714 |
| MC1_R | UniProtKB: V9QDN7 | 2715 | 2716 | 2717, 2718, 2719, 2720, 2721 |
| MC1_R | UniProtKB: V9QDQ6 | 2722 | 2723 | 2724, 2725, 2726, 2727, 2728 |
| mesothelin | UniProtKB: Q13421 | 2729 | 2730 | 2731, 2732, 2733, 2734, 2735 |
| MITF | UniProtKB: O75030-8 | 2736 | 2737 | 2738, 2739, 2740, 2741, 2742 |
| MITF | UniProtKB: O75030-9 | 2743 | 2744 | 2745, 2746, 2747, 2748, 2749 |
| MITF | UniProtKB: O75030 | 2750 | 2751 | 2752, 2753, 2754, 2755, 2756 |
| MMP1_1 | UniProtKB: B3KQS8 | 2757 | 2758 | 2759, 2760, 2761, 2762, 2763 |
| MMP7 | UniProtKB: P09237 | 2764 | 2765 | 2766, 2767, 2768, 2769, 2770 |
| MUC-1 | Genbank: AAA60019 | 2771 | 2772 | 2773, 2774, 2775, 2776, 2777 |
| MUM-1/m | RefSeq: NP_116242 | 2778 | 2779 | 2780, 2781, 2782, 2783, 2784 |
| MUM-2/m | UniProtKB: Q9Y5R8 | 2785 | 2786 | 2787, 2788, 2789, 2790, 2791 |
| MYO1A | UniProtKB: Q9UBC5 | 2792 | 2793 | 2794, 2795, 2796, 2797, 2798 |
| MYO1B | UniProtKB: O43795 | 2799 | 2800 | 2801, 2802, 2803, 2804, 2805 |
| MYO1C | UniProtKB: O00159 | 2806 | 2807 | 2808, 2809, 2810, 2811, 2812 |
| MYO1D | UniProtKB: O94832 | 2813 | 2814 | 2815, 2816, 2817, 2818, 2819 |
| MYO1E | UniProtKB: Q12965 | 2820 | 2821 | 2822, 2823, 2824, 2825, 2826 |
| MYO1F | UniProtKB: O00160 | 2827 | 2828 | 2829, 2830, 2831, 2832, 2833 |
| MYO1G | UniProtKB: B0I1T2 | 2834 | 2835 | 2836, 2837, 2838, 2839, 2840 |
| MYO1H | RefSeq: NP_001094891 | 2841 | 2842 | 2843, 2844, 2845, 2846, 2847 |
| NA17 | UniProtKB: Q3V5L5 | 2848 | 2849 | 2850, 2851, 2852, 2853, 2854 |
| NA88-A | Pubmed: 10790436 | 2855 | 2856 | 2857, 2858, 2859, 2860, 2861 |
| Neo-PAP | UniProtKB: Q9BWT3 | 2862 | 2863 | 2864, 2865, 2866, 2867, 2868 |
| NFYC/m | UniProtKB: Q13952 | 2869 | 2870 | 2871, 2872, 2873, 2874, 2875 |
| NGEP | UniProtKB: Q6IWH7 | 2876 | 2877 | 2878, 2879, 2880, 2881, 2882 |
| NPM | UniProtKB: P06748 | 2883 | 2884 | 2885, 2886, 2887, 2888, 2889 |

TABLE 9-continued

Tumor antigens

| Gene Name | Protein Accession No. | Protein Sequence SEQ ID NO: | RNA Sequence wild type SEQ ID NO: | Optimized RNA Sequence SEQ ID NO: |
|---|---|---|---|---|
| NRCAM | UniProtKB: Q92823 | 2890 | 2891 | 2892, 2893, 2894, 2895, 2896 |
| NSE | UniProtKB: P09104 | 2897 | 2898 | 2899, 2900, 2901, 2902, 2903 |
| NUF2 | UniProtKB: Q9BZD4 | 2904 | 2905 | 2906, 2907, 2908, 2909, 2910 |
| NY-ESO-1 | UniProtKB: P78358 | 2911 | 2912 | 2913, 2914, 2915, 2916, 2917 |
| OA1 | UniProtKB: P51810 | 2918 | 2919 | 2920, 2921, 2922, 2923, 2924 |
| OGT | UniProtKB: O15294 | 2925 | 2926 | 2927, 2928, 2929, 2930, 2931 |
| OS-9 | UniProtKB: B4DH11 | 2932 | 2933 | 2934, 2935, 2936, 2937, 2938 |
| OS-9 | UniProtKB: B4E321 | 2939 | 2940 | 2941, 2942, 2943, 2944, 2945 |
| OS-9 | UniProtKB: B7Z8E7 | 2946 | 2947 | 2948, 2949, 2950, 2951, 2952 |
| OS-9 | UniProtKB: Q13438 | 2953 | 2954 | 2955, 2956, 2957, 2958, 2959 |
| osteocalcin | UniProtKB: P02818 | 2960 | 2961 | 2962, 2963, 2964, 2965, 2966 |
| osteopontin | UniProtKB: A0A024RDE2 | 2967 | 2968 | 2969, 2970, 2971, 2972, 2973 |
| osteopontin | UniProtKB: A0A024RDE6 | 2974 | 2975 | 2976, 2977, 2978, 2979, 2980 |
| osteopontin | UniProtKB: A0A024RDJ0 | 2981 | 2982 | 2983, 2984, 2985, 2986, 2987 |
| osteopontin | UniProtKB: B7Z351 | 2988 | 2989 | 2990, 2991, 2992, 2993, 2994 |
| osteopontin | UniProtKB: F2YQ21 | 2995 | 2996 | 2997, 2998, 2999, 3000, 3001 |
| osteopontin | UniProtKB: P10451 | 3002 | 3003 | 3004, 3005, 3006, 3007, 3008 |
| p53 | UniProtKB: P04637 | 3009 | 3010 | 3011, 3012, 3013, 3014, 3015 |
| PAGE-4 | UniProtKB: O60829 | 3016 | 3017 | 3018, 3019, 3020, 3021, 3022 |
| PAI-1 | UniProtKB: P05121 | 3023 | 3024 | 3025, 3026, 3027, 3028, 3029 |
| PAI-2 | UniProtKB: P05120 | 3030 | 3031 | 3032, 3033, 3034, 3035, 3036 |
| PAP | UniProtKB: Q06141 | 3037 | 3038 | 3039, 3040, 3041, 3042, 3043 |
| PAP | UniProtKB: Q53S56 | 3044 | 3045 | 3046, 3047, 3048, 3049, 3050 |
| PATE | UniProtKB: Q8WXA2 | 3051 | 3052 | 3053, 3054, 3055, 3056, 3057 |
| PAX3 | UniProtKB: P23760 | 3058 | 3059 | 3060, 3061, 3062, 3063, 3064 |
| PAX5 | UniProtKB: Q02548 | 3065 | 3066 | 3067, 3068, 3069, 3070, 3071 |
| PD1L1 | UniProtKB: Q9NZQ7 | 3072 | 3073 | 3074, 3075, 3076, 3077, 3078 |
| PDCD1 | UniProtKB: Q15116 | 3079 | 3080 | 3081, 3082, 3083, 3084, 3085 |
| PDEF | UniProtKB: O95238 | 3086 | 3087 | 3088, 3089, 3090, 3091, 3092 |
| PECA1 | UniProtKB: P16284 | 3093 | 3094 | 3095, 3096, 3097, 3098, 3099 |
| PGCB | UniProtKB: Q96GW7 | 3100 | 3101 | 3102, 3103, 3104, 3105, 3106 |
| PGFRB | UniProtKB: P09619 | 3107 | 3108 | 3109, 3110, 3111, 3112, 3113 |
| Pim-1_-Kinase | UniProtKB: A0A024RD25 | 3114 | 3115 | 3116, 3117, 3118, 3119, 3120 |
| Pin-1 | UniProtKB: O15428 | 3121 | 3122 | 3123, 3124, 3125, 3126, 3127 |
| Pin-1 | UniProtKB: Q13526 | 3128 | 3129 | 3130, 3131, 3132, 3133, 3134 |
| Pin-1 | UniProtKB: Q49AR7 | 3135 | 3136 | 3137, 3138, 3139, 3140, 3141 |

TABLE 9-continued

Tumor antigens

| Gene Name | Protein Accession No. | Protein Sequence SEQ ID NO: | RNA Sequence wild type SEQ ID NO: | Optimized RNA Sequence SEQ ID NO: |
|---|---|---|---|---|
| PLAC1 | UniProtKB: Q9HBJ0 | 3142 | 3143 | 3144, 3145, 3146, 3147, 3148 |
| PMEL | UniProtKB: P40967 | 3149 | 3150 | 3151, 3152, 3153, 3154, 3155 |
| PML | UniProtKB: P29590 | 3156 | 3157 | 3158, 3159, 3160, 3161, 3162 |
| POTEF | UniProtKB: A5A3E0 | 3163 | 3164 | 3165, 3166, 3167, 3168, 3169 |
| POTE | UniProtKB: Q86YR6 | 3170 | 3171 | 3172, 3173, 3174, 3175, 3176 |
| PRAME | UniProtKB: A0A024R1E6 | 3177 | 3178 | 3179, 3180, 3181, 3182, 3183 |
| PRAME | UniProtKB: P78395 | 3184 | 3185 | 3186, 3187, 3188, 3189, 3190 |
| PRDX5/m | UniProtKB: P30044 | 3191 | 3192 | 3193, 3194, 3195, 3196, 3197 |
| PRM2 | UniProtKB: P04554 | 3198 | 3199 | 3200, 3201, 3202, 3203, 3204 |
| prostein | UniProtKB: Q96JT2 | 3205 | 3206 | 3207, 3208, 3209, 3210, 3211 |
| proteinase-3 | UniProtKB: D6CHE9 | 3212 | 3213 | 3214, 3215, 3216, 3217, 3218 |
| proteinase-3 | UniProtKB: P24158 | 3219 | 3220 | 3221, 3222, 3223, 3224, 3225 |
| PSA | UniProtKB: P55786 | 3226 | 3227 | 3228, 3229, 3230, 3231, 3232 |
| PSB9 | UniProtKB: P28065 | 3233 | 3234 | 3235, 3236, 3237, 3238, 3239 |
| PSCA | UniProtKB: D3DWI6 | 3240 | 3241 | 3242, 3243, 3244, 3245, 3246 |
| PSCA | UniProtKB: O43653 | 3247 | 3248 | 3249, 3250, 3251, 3252, 3253 |
| PSGR | UniProtKB: Q9H255 | 3254 | 3255 | 3256, 3257, 3258, 3259, 3260 |
| PSM | UniProtKB: Q04609 | 3261 | 3262 | 3263, 3264, 3265, 3266, 3267 |
| PTPRC | RefSeq: NP_002829 | 3268 | 3269 | 3270, 3271, 3272, 3273, 3274 |
| RAB8A | UniProtKB: P61006 | 3275 | 3276 | 3277, 3278, 3279, 3280, 3281 |
| RAGE-1 | UniProtKB: Q9UQ07 | 3282 | 3283 | 3284, 3285, 3286, 3287, 3288 |
| RARA | UniProtKB: P10276 | 3289 | 3290 | 3291, 3292, 3293, 3294, 3295 |
| RASH | UniProtKB: P01112 | 3296 | 3297 | 3298, 3299, 3300, 3301, 3302 |
| RASK | UniProtKB: P01116 | 3303 | 3304 | 3305, 3306, 3307, 3308, 3309 |
| RASN | UniProtKB: P01111 | 3310 | 3311 | 3312, 3313, 3314, 3315, 3316 |
| RGS5 | UniProtKB: O15539 | 3317 | 3318 | 3319, 3320, 3321, 3322, 3323 |
| RHAMM/CD168 | UniProtKB: O75330 | 3324 | 3325 | 3326, 3327, 3328, 3329, 3330 |
| RHOC | UniProtKB: P08134 | 3331 | 3332 | 3333, 3334, 3335, 3336, 3337 |
| RSSA | UniProtKB: P08865 | 3338 | 3339 | 3340, 3341, 3342, 3343, 3344 |
| RU1 | UniProtKB: Q9UHJ3 | 3345 | 3346 | 3347, 3348, 3349, 3350, 3351 |
| RU2 | UniProtKB: Q9UHG0 | 3352 | 3353 | 3354, 3355, 3356, 3357, 3358 |
| RUNX1 | UniProtKB: Q01196 | 3359 | 3360 | 3361, 3362, 3363, 3364, 3365 |
| S-100 | UniProtKB: V9HW39 | 3366 | 3367 | 3368, 3369, 3370, 3371, 3372 |
| SAGE | UniProtKB: Q9NXZ1 | 3373 | 3374 | 3375, 3376, 3377, 3378, 3379 |
| SART-_1 | UniProtKB: O43290 | 3380 | 3381 | 3382, 3383, 3384, 3385, 3386 |
| SART-2 | UniProtKB: Q9UL01 | 3387 | 3388 | 3389, 3390, 3391, 3392, 3393 |

TABLE 9-continued

| | Tumor antigens | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| SART-3 | UniProtKB: Q15020 | 3394 | 3395 | 3396, 3397, 3398, 3399, 3400 |
| SEPR | UniProtKB: Q12884 | 3401 | 3402 | 3403, 3404, 3405, 3406, 3407 |
| SIA7F | UniProtKB: Q969X2 | 3408 | 3409 | 3410, 3411, 3412, 3413, 3414 |
| SIA8A | UniProtKB: Q92185 | 3415 | 3416 | 3417, 3418, 3419, 3420, 3421 |
| SIAT9 | UniProtKB: Q9UNP4 | 3422 | 3423 | 3424, 3425, 3426, 3427, 3428 |
| SIRT2/m | UniProtKB: A0A024R0G8 | 3429 | 3430 | 3431, 3432, 3433, 3434, 3435 |
| SIRT2/m | UniProtKB: Q8IXJ6 | 3436 | 3437 | 3438, 3439, 3440, 3441, 3442 |
| SOX10 | UniProtKB: P56693 | 3443 | 3444 | 3445, 3446, 3447, 3448, 3449 |
| SP17 | UniProtKB: Q15506 | 3450 | 3451 | 3452, 3453, 3454, 3455, 3456 |
| SPNXA | UniProtKB: Q9NS26 | 3457 | 3458 | 3459, 3460, 3461, 3462, 3463 |
| SPXN3 | UniProtKB: Q5MJ09 | 3464 | 3465 | 3466, 3467, 3468, 3469, 3470 |
| SSX-1 | UniProtKB: Q16384 | 3471 | 3472 | 3473, 3474, 3475, 3476, 3477 |
| SSX-2 | UniProtKB: Q16385 | 3478 | 3479 | 3480, 3481, 3482, 3483, 3484 |
| SSX3 | UniProtKB: Q99909 | 3485 | 3486 | 3487, 3488, 3489, 3490, 3491 |
| SSX-4 | UniProtKB: O60224 | 3492 | 3493 | 3494, 3495, 3496, 3497, 3498 |
| ST1A1 | UniProtKB: P50225 | 3499 | 3500 | 3501, 3502, 3503, 3504, 3505 |
| STAG2 | UniProtKB: Q8N3U4-2 | 3506 | 3507 | 3508, 3509, 3510, 3511, 3512 |
| STAMP-1 | UniProtKB: Q8NFT2 | 3513 | 3514 | 3515, 3516, 3517, 3518, 3519 |
| STEAP-1 | UniProtKB: A0A024RA63 | 3520 | 3521 | 3522, 3523, 3524, 3525, 3526 |
| STEAP-1 | UniProtKB: Q9UHE8 | 3527 | 3528 | 3529, 3530, 3531, 3532, 3533 |
| Survivin-2B | UniProtKB: O15392-2 | 3534 | 3535 | 3536, 3537, 3538, 3539, 3540 |
| survivin | UniProtKB: O15392 | 3541 | 3542 | 3543, 3544, 3545, 3546, 3547 |
| SYCP1 | UniProtKB: A0A024R0I2 | 3548 | 3549 | 3550, 3551, 3552, 3553, 3554 |
| SYCP1 | UniProtKB: B7ZLS9 | 3555 | 3556 | 3557, 3558, 3559, 3560, 3561 |
| SYCP1 | UniProtKB: Q15431 | 3562 | 3563 | 3564, 3565, 3566, 3567, 3568 |
| SYCP1 | UniProtKB: Q3MHC4 | 3569 | 3570 | 3571, 3572, 3573, 3574, 3575 |
| SYT-SSX-1 | UniProtKB: A4PIV7 | 3576 | 3577 | 3578, 3579, 3580, 3581, 3582 |
| SYT-SSX-1 | UniProtKB: A4PIV8 | 3583 | 3584 | 3585, 3586, 3587, 3588, 3589 |
| SYT-SSX-2 | UniProtKB: A4PIV9 | 3590 | 3591 | 3592, 3593, 3594, 3595, 3596 |
| SYT-SSX-2 | UniProtKB: A4PIW0 | 3597 | 3598 | 3599, 3600, 3601, 3602, 3603 |
| TARP | UniProtKB: Q0VGM3 | 3604 | 3605 | 3606, 3607, 3608, 3609, 3610 |
| TCRg | UniProtKB: A2JGV3 | 3611 | 3612 | 3613, 3614, 3615, 3616, 3617 |
| TF2AA | UniProtKB: P52655 | 3618 | 3619 | 3620, 3621, 3622, 3623, 3624 |
| TGFR2 | UniProtKB: P37173 | 3625 | 3626 | 3627, 3628, 3629, 3630, 3631 |
| TGM-4 | UniProtKB: B2R7D1 | 3632 | 3633 | 3634, 3635, 3636, 3637, 3638 |
| TIE2 | UniProtKB: Q02763 | 3639 | 3640 | 3641, 3642, 3643, 3644, 3645 |

TABLE 9-continued

| | | | Tumor antigens | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| TKTL1 | UniProtKB: P51854 | 3646 | 3647 | 3648, 3649, 3650, 3651, 3652 |
| TPI/m | UniProtKB: P60174 | 3653 | 3654 | 3655, 3656, 3657, 3658, 3659 |
| TRGV11 | UniProtKB: Q99601 | 3660 | 3661 | 3662, 3663, 3664, 3665, 3666 |
| TRGV9 | UniProtKB: A4D1X2 | 3667 | 3668 | 3669, 3670, 3671, 3672, 3673 |
| TRGV9 | UniProtKB: Q99603 | 3674 | 3675 | 3676, 3677, 3678, 3679, 3680 |
| TRGV9 | UniProtKB: Q99604 | 3681 | 3682 | 3683, 3684, 3685, 3686, 3687 |
| TRPC1 | UniProtKB: P48995 | 3688 | 3689 | 3690, 3691, 3692, 3693, 3694 |
| TRP-p8 | UniProtKB: Q7Z2W7 | 3695 | 3696 | 3697, 3698, 3699, 3700, 3701 |
| TSG10 | UniProtKB: Q9BZW7 | 3702 | 3703 | 3704, 3705, 3706, 3707, 3708 |
| TSPY1 | UniProtKB: Q01534 | 3709 | 3710 | 3711, 3712, 3713, 3714, 3715 |
| TVC_(TRGV3) | Genbank: M13231.1 | 3716 | 3717 | 3718, 3719, 3720, 3721, 3722 |
| TX101 | UniProtKB: Q9BY14-2 | 3723 | 3724 | 3725, 3726, 3727, 3728, 3729 |
| tyrosinase | UniProtKB: A0A024DBG7 | 3730 | 3731 | 3732, 3733, 3734, 3735, 3736 |
| tyrosinase | UniProtKB: L8B082 | 3737 | 3738 | 3739, 3740, 3741, 3742, 3743 |
| tyrosinase | UniProtKB: L8B086 | 3744 | 3745 | 3746, 3747, 3748, 3749, 3750 |
| tyrosinase | UniProtKB: L8B0B9 | 3751 | 3752 | 3753, 3754, 3755, 3756, 3757 |
| tyrosinase | UniProtKB: O75767 | 3758 | 3759 | 3760, 3761, 3762, 3763, 3764 |
| tyrosinase | UniProtKB: P14679 | 3765 | 3766 | 3767, 3768, 3769, 3770, 3771 |
| tyrosinase | UniProtKB: U3M8N0 | 3772 | 3773 | 3774, 3775, 3776, 3777, 3778 |
| tyrosinase | UniProtKB: U3M9D5 | 3779 | 3780 | 3781, 3782, 3783, 3784, 3785 |
| tyrosinase | UniProtKB: U3M9J2 | 3786 | 3787 | 3788, 3789, 3790, 3791, 3792 |
| TYRP1 | UniProtKB: P17643 | 3793 | 3794 | 3795, 3796, 3797, 3798, 3799 |
| TYRP2 | UniProtKB: P40126 | 3800 | 3801 | 3802, 3803, 3804, 3805, 3806 |
| UPA | UniProtKB: Q96NZ9 | 3807 | 3808 | 3809, 3810, 3811, 3812, 3813 |
| VEGFR1 | UniProtKB: B5A924 | 3814 | 3815 | 3816, 3817, 3818, 3819, 3820 |
| WT1 | UniProtKB: A0A0H5AUY0 | 3821 | 3822 | 3823, 3824, 3825, 3826, 3827 |
| WT1 | UniProtKB: P19544 | 3828 | 3829 | 3830, 3831, 3832, 3833, 3834 |
| WT1 | UniProtKB: Q06250 | 3835 | 3836 | 3837, 3838, 3839, 3840, 3841 |
| XAGE1 | UniProtKB: Q9HD64 | 3842 | 3843 | 3844, 3845, 3846, 3847, 3848 |
| IL-10 | UniProtKB: P22301 | 4169 | 4170 | 4171, 4172, 4173, 4174, 4175, 4176 |
| IL-5 | UniProtKB: P05113 | 4585 | 4586 | 4587, 4588, 4589, 4590, 4591, 4592 |
| M-CSF | UniProtKB: P09603 | 4705 | 4706 | 4707, 4708, 4709, 4710, 4711, 4712 |
| TGFbeta1 | UniProtKB: P01137 | 4785 | 4786 | 4787, 4788, 4789, 4790, 4791, 4792 |
| Caspase_8 | UniProtKB: Q14790 | 7113 | 7114 | 7115, 7116, 7117, 7118, 7119, 7120 |
| SERPINB5 | UniProtKB: P36952 | 7465 | 7466 | 7467, 7468, 7469, 7470, 7471, 7472 |
| calreticulin | UniProtKB: B4DHR1 | 7569 | 7570 | 7571, 7572, 7573, 7574, 7575, 7576 |

TABLE 9-continued

Tumor antigens

| Gene Name | Protein Accession No. | Protein Sequence SEQ ID NO: | RNA Sequence wild type SEQ ID NO: | Optimized RNA Sequence SEQ ID NO: |
|---|---|---|---|---|
| calreticulin | UniProtKB: B4E2Y9 | 7577 | 7578 | 7579, 7580, 7581, 7582, 7583, 7584 |
| calreticulin | UniProtKB: P27797 | 7585 | 7586 | 7587, 7588, 7589, 7590, 7591, 7592 |
| calreticulin | UniProtKB: Q96L12 | 7593 | 7594 | 7595, 7596, 7597, 7598, 7599, 7600 |
| N-myc | UniProtKB: P04198 | 9987 | 9988 | 9989, 9990, 9991, 9992, 9993, 9994 |

According to the present invention, in a more preferred embodiment, the inventive composition comprises at least one RNA, preferably an mRNA comprising at least one coding region encoding at least one tumor antigen or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 9.

Furthermore tumor antigens also may encompass idiotypic antigens associated with a cancer or tumor disease, particularly lymphoma or a lymphoma associated disease, wherein said idiotypic antigen is an immunoglobulin idiotype of a lymphoid blood cell or a T cell receptor idiotype of a lymphoid blood cell.

In a particularly preferred embodiment the inventive RNA composition comprises at least one RNA, wherein the at least one RNA encodes the following antigens:
  STEAP (Six Transmembrane Epithelial Antigen of the Prostate);
  PSA (Prostate-Specific Antigen),
  PSMA (Prostate-Specific Membrane Antigen),
  PSCA (Prostate Stem Cell Antigen);
  PAP (Prostatic Acid Phosphatase), and
  MUC1 (Mucin 1).

In another particularly preferred embodiment the inventive RNA composition comprises at least one RNA, wherein the at least one RNA encodes the following antigens:
  5T4 (Trophoblast glycoprotein, TPBG);
  Survivin (Baculoviral IAP repeat-containing protein 5; BIRC5),
  NY-ESO-1 (New York esophageal squamous cell carcinoma 1; CTAG1B),
  MAGE-C1 (Melanoma antigen family C1);
  MAGE-C2 (Melanoma antigen family C2), and
  MUC1 (Mucin 1).

9. β-Catenin Inhibitors

In a further preferred embodiment of the inventive RNA containing composition the RNA, preferably mRNA codes for at least one β-catenin inhibitor or a fragment or variant thereof. Preferably the RNA encoding the at least one β-catenin inhibitor encodes an inhibitory protein or dominant negative mutant protein of the β-catenin pathway. Particular preferred β-catenin inhibitors according to the present invention comprise TAT-NLS-BLBD-6, axin-1, TCF-4, GSK-3b, DKK-1, Dvl-1 derivatives or fragments thereof.

As reviewed by Thakur and Mishra (Thakur R, Mishra D P. Pharmacological modulation of beta-catenin and its applications in cancer therapy. J Cell Mol Med. 2013 April; 17(4):449-56. doi: 10.1111/jcmm.12033) beta-catenin (β-catenin) is a multifunctional protein which plays an important role in physiological homeostasis. It acts both as a transcriptional regulator and an adaptor protein for intracellular adhesion. β-catenin is necessary for the establishment and maintenance of epithelial layers and provides a linkage between intracellular junctions and cytoskeletal proteins. β-catenin is regulated by Wnt signaling. In the absence of Wnt downstream signal β-catenin is phosphorylated which leads to its ubiquitination and eventually protein degradation. Various literature reports have linked β-catenin to the malignant transformation of normal cells. For example, Wnt signaling and β-catenin nuclear localization was associated with differentiation of hepatocytes into a tumoral phenotype. Similarly, in lung epithelial and pancreatic cells, activation of β-catenin was sufficient for induction of oncogenic transformation. In addition to being a driving force of malignant transformation, abnormal β-catenin expression and localization has been associated with increased metastatic potential. Recently, it has been shown that β-catenin signaling prevents T cell infiltration and anti-tumor immunity strongly limiting the potential effects of immunotherapies. Since β-catenin plays an important and detrimental role in tumorigenesis, it has been proposed as a putative drug target.

10. STING-Pathway Activators

In a further preferred embodiment of the inventive RNA containing composition the RNA, preferably mRNA codes for at least one activator of the STING (stimulator of interferon genes) pathway or a fragment or variant thereof. Preferably, the RNA encoding the at least one activator (stimulator) of the STING pathway encodes an activating protein or a constitutively active protein of the STING pathway, preferably DDX41, STING, cGAS, IRF3, TBK1 or STAT6 or a fragment or variant thereof.

As reviewed by Woo et al. (Woo S R, Corrales L, Gajewski T F. The STING pathway and the T cell-inflamed tumor microenvironment. Trends Immunol. 2015 Mar. 7. pii: S1471-4906(15)00019-8. doi: 10.1016/j.it.2015.02.003) and Dubensky et al. (Dubensky T W Jr, Kanne D B, Leong M L. Rationale, progress and development of vaccines utilizing STING-activating cyclic dinucleotide adjuvants. Ther Adv Vaccines. 2013 November; 1(4):131-43. doi: 10.1177/2051013613501988) the so-called STING pathway (STING—stimulator of interferon genes) is responsible for sensing of cytoplasmic DNA and induction of proinflammatory mediators. After binding of DNA in cytoplasm, STING activates signaling via TANK-binding kinase 1 (TBK-1)/IRF-3 axis which results in production of IFN-β.

This pathway was shown to play an important role in sensing of DNA viruses as well as some autoimmune disorders. Recent data have identified STING pathway as absolutely necessary to induce spontaneous T cell priming against tumor antigens in vivo. Tumor DNA was detected within tumor-infiltrating DCs, which led to IFN-β production and T cell activation. Thus, intratumoral application of small molecules STING pathway agonists has demonstrated their efficacy in tumor-bearing animals. Agonists of the STING pathway has been also evaluated as vaccine adjuvants showing potency to induce cellular and humoral immunity in vaccinated hosts.

11. Checkpoint Modulators

In a further preferred embodiment of the inventive RNA containing composition the RNA, preferably mRNA comprises at least one coding region that codes for at least one checkpoint modulator or a fragment or variant thereof.

Negative regulatory T cell surface molecules were discovered which are upregulated in activated T cells to dampen their activity, resulting in less effective killing of tumor cells. These inhibitory molecules were termed negative co-stimulatory molecules due to their homology to the T cell co-stimulatory molecule CD28. These proteins, also referred to as immune checkpoint proteins, function in multiple pathways including the attenuation of early activation signals, competition for positive co-stimulation and direct inhibition of antigen presenting cells (Bour-Jordan et al., 2011. Immunol Rev. 241(1):180-205).

In preferred embodiments of the present invention the checkpoint modulator is a modulator of B7-1/CD80, B7-2/CD86, B7-H1/PD-L1, B7-H2, B7-H3, B7-H4, B7-H6, B7-H7/HHLA2, BTLA, CD28, CD28H/IGPR-1, CTLA-4, ICOS, PD-1, PD-L2/B7-DC, PDCD6, VISTA/B7-H5/PD-1H, BTN1A1/Butyrophilin, BTN2A1, BTN2A2/Butyrophilin 2A2, BTN3A1/2, BTN3A2, BTN3A3, BTNL2/Butyrophilin-like 2, BTNL3, BTNL4, BTNL6, BTNL8, BTNL9, BTNL10, CD277/BTN3A1, LAIR1, LAIR2, CD96, CD155/PVR, CRTAM, DNAM-1/CD226, Nectin-2/CD112, Nectin-3, TIGIT, LILRA3/CD85e, LILRA4/CD85g/ILT7, LILRB1/CD85j/ILT2, LILRB2/CD85d/ILT4, LILRB3/CD85a/ILT5, LILRB4/CD85k/ILT3, 4-1BB/TNFRSF9/CD137, 4-1BB Ligand/TNFSF9, BAFF/BLyS/TNFSF13B, BAFF R/TNFRSF13C, CD27/TNFRSF7, CD27 Ligand/TNFSF7, CD30/TNFRSF8, CD30 Ligand/TNFSF8, CD40/TNFRSF5, CD40 Ligand/TNFSF5, DR3/TNFRSF25, GITR/TNFRSF18, GITR Ligand/TNFSF18, HVEM/TNFRSF14, LIGHT/TNFSF14, Lymphotoxin-alpha/TNF-beta, OX40/TNFRSF4, OX40 Ligand/TNFSF4, RELT/TNFRSF19L, TACI/TNFRSF13B, TL1A/TNFSF15, TNF-alpha, TNF RII/TNFRSF1B, 2B4/CD244/SLAMF4, BLAME/SLAMF8, CD2, CD2F-10/SLAMF9, CD48/SLAMF2, CD58/LFA-3, CD84/SLAMF5, CD229/SLAMF3, CRACC/SLAMF7, NTB-A/SLAMF6, SLAM/CD150, TIM-1/KIM-1/HAVCR, TIM-3, TIM-4, CD7, CD96, CD160, CD200, CD300a/LMIR1, CRTAM, DAP12, Dectin-1/CLEC7A, DPPIV/CD26, EphB6, Integrin alpha 4 beta 1, Integrin alpha 4 beta 7/LPAM-1, LAG-3, TIM-1/KIM-1/HAVCR, TIM-4, TSLP R, or any combinations thereof.

In the context of the present invention a checkpoint modulator is defined herein as a molecule preferably a protein e.g. an antibody, a dominant negative receptor, a decoy receptor, or a ligand or a fragment or variant thereof, which modulates the function of an immune checkpoint protein, e.g. it inhibits or reduces the activity of checkpoint inhibitors (or inhibitory checkpoint molecules) or it stimulates the activity of checkpoint stimulators (or stimulatory checkpoint molecules). Therefore checkpoint modulators as defined herein, influence the activity of checkpoint molecules.

In this context inhibitory checkpoint molecules are defined as checkpoint inhibitors and can be used synonymously. In addition stimulatory checkpoint molecules are defined as checkpoint stimulators and can be used synonymously.

Preferable inhibitory checkpoint molecules that may be inhibited by a checkpoint modulator in the context of the invention are PD-1, PD-L1, CTLA-4, PD-L2, LAG3, TIM3/HAVCR2, 2B4, A2aR, B7H3, B7H4, BTLA, CD30, CD160, GAL9, HVEM, IDO1, IDO2, KIR, LAIR1 and VISTA.

Preferable stimulatory checkpoint molecules that may be stimulated by a checkpoint modulator in the context of the invention are CD2, CD27, CD28, CD40, CD137, CD226, CD276, GITR, ICOS, OX-40 and CD70.

Preferably, the checkpoint modulator is selected from agonistic antibodies, antagonistic antibodies, ligands, dominant negative receptors, and decoy receptors or combinations thereof.

Methods for generating and using mRNA-encoded antibodies are known in the art (e.g. WO2008/083949).

Preferably, the agonistic antibody is chosen from the following list: anti-4-1BB, anti-OX40, anti-GITR, anti-CD28, anti-CD27, anti-CD-40anti-ICOS, anti-TNFRSF25, and anti-LIGHT.

OX40 is a member of the TNFR-superfamily of receptors, and is expressed on the surface of antigen-activated mammalian CD4+ and CD8+ T lymphocytes. OX40 ligand (OX40L, also known as gp34, ACT-4-L, and CD252) is a protein that specifically interacts with the OX40 receptor. The term OX40L includes the entire OX40 ligand, soluble OX40 ligand, and fusion proteins comprising a functionally active portion of OX40 ligand covalently linked to a second moiety, e.g., a protein domain. Also included within the definition of OX40L are variants which vary in amino acid sequence from naturally occurring OX4L but which retain the ability to specifically bind to the OX40 receptor. Further included within the definition of OX40L are variants which enhance the biological activity of OX40. An OX40 agonist is a molecule which induces or enhances the biological activity of OX40, e.g. signal transduction mediated by OX40. An OX40 agonist is preferably defined herein as a binding molecule capable of specific binding to OX40. Therefore, the OX40 agonist may be any agonist binding to OX40 and capable of stimulating OX40 signaling. In this context, the OX40 agonist may be an agonistic antibody binding to OX40.

OX40 agonists and anti-OX40 monoclonal antibodies are described in WO1995/021251, WO1995/012673 and WO1995/21915. Particularly preferred is the anti-OX40 antibody 9B12, a murine anti-OX40 monoclonal antibody directed against the extracellular domain of human OX40 (Weinberg et al., 2006. J. Immunother. 29(6):575-585).

Preferably, the antagonistic antibody is chosen from the list of anti-CTLA4, anti-PD1, anti-PD-L1, anti-Vista, anti-Tim-3, anti-LAG-3, and anti-BTLA.

Cytotoxic T lymphocyte antigen-4 (CTLA-4) is mainly expressed within the intracellular compartment of T cells. After a potent or long-lasting stimulus to a naive T cell via the T cell receptor (TCR), CTLA-4 is transported to the cell surface and concentrated at the immunological synapse. CTLA-4 then competes with CD28 for CD80/CD86 and down-modulates TCR signaling via effects on Akt signaling. Thus CTLA-4 functions physiologically as a signal dampener (Weber, J. 2010. Semin. Oncol. 37(5):430-9).

Particularly preferred are the anti-CTLA-4 antibodies ipilimumab (Yervoy®), tremelimumab, and AGEN-1884.

Members of the PD-1 pathway are all proteins which are associated with PD-1 signaling. On the one hand these might be proteins which induce PD-1 signaling upstream of PD-1 as e.g. the ligands of PD-1 PD-L1 and PD-L2 and the signal transduction receptor PD-1. On the other hand these might be signal transduction proteins downstream of PD-1 receptor. Particularly preferred as members of the PD-1 pathway in the context of the present invention are PD-1, PD-L1 and PD-L2.

In the context of the present invention, a PD-1 pathway antagonist is preferably defined herein as a compound capable to impair the PD-1 pathway signaling, preferably signaling mediated by the PD-1 receptor. Therefore, the PD-1 pathway antagonist may be any antagonist directed against any member of the PD-1 pathway capable of antagonizing PD-1 pathway signaling. In this context, the antagonist may be an antagonistic antibody as defined herein, targeting any member of the PD-1 pathway, preferably directed against PD-1 receptor, PD-L1 or PD-L2. This antagonistic antibody may also be encoded by a nucleic acid. Also, the PD-1 pathway antagonist may be a fragment of the PD-1 receptor blocking the activity of PD1 ligands. B7-1 or fragments thereof may act as PD1-antagonizing ligands as well. Additionally, a PD-1 pathway antagonist may be a protein comprising (or a nucleic acid coding for) an amino acid sequence capable of binding to PD-1 but preventing PD-1 signaling, e.g. by inhibiting PD-1 and B7-H1 or B7-DL interaction (WO2014127917).

Particularly preferred are the anti-PD1 antibodies Nivolumab (MDX-1106/BMS-936558/ONO-4538), (Brahmer et al., 2010. J Clin Oncol. 28(19):3167-75; PMID: 20516446); Pidilizumab (CT-011), (Berger et al., 2008. Clin Cancer Res. 14(10):3044-51; PMID: 18483370); Pembrolizumab (MK-3475, SCH 900475); AMP-224, and MED10680 (AMP-514)

Particularly preferred are the anti-PD-L1 antibodies MDX-1105/BMS-936559 (Brahmer et al. 2012. N Engl J Med. 366(26):2455-65; PMID: 22658128); atezolizumab (MPDL3280A/RG7446); durvalumab (MED14736); and avelumab (MSB0010718).

According to the present invention the at least one RNA of the inventive RNA containing composition encodes at least one antibody or fragments or variants thereof of Table 10. It is particularly preferred that the RNA containing composition comprises at least one RNA encoding the heavy chain of a particular antibody or fragments or variants thereof and at least one further RNA encoding the light chain of the same particular antibody or fragments or variants thereof.

TABLE 10

Antibodies directed against checkpoint molecules

| Name | Target |
|---|---|
| Urelumab | 4-1BB/CD137 |
| PF-05082566 | 4-1BB/CD137 |
| 8H9 | B7-H3 |
| Enoblituzumab | B7-H3 |
| Ipilimumab | CD152/CTLA-4 |
| Ticilimumab (=tremelimumab) | CD152/CTLA-4 |
| Tremelimumab | CD152/CTLA-4 |
| Varlilumab | CD27 |
| Teneliximab | CD40 |
| Vorsetuzumab mafodotin | CD70 |
| Lirilumab | KIR2D |

TABLE 10-continued

Antibodies directed against checkpoint molecules

| Name | Target |
|---|---|
| GSK-3174998 | OX40 |
| MEDI-6469 | OX40 |
| MEDI-6383 | OX40 |
| MEDI-0562 | OX40 |
| PF-04518600 | OX40 |
| RG-7888 | OX40 |
| PF-06801591 | PD-1 |
| BGBA-317 | PD-1 |
| MEDI-0680 | PD-1 |
| MK-3475 | PD-1 |
| Nivolumab | PD-1 |
| PDR-001 | PD-1 |
| Pembrolizumab | PD-1 |
| Pidilizumab | PD-1 |
| REGN-2810 | PD-1 |
| SHR-1210 | PD-1 |
| TSR-042 | PD-1 |
| MDX-1106 | PD-1 |
| Merck 3745 | PD-1 |
| CT-011 | PD-1 |
| MEDI-0680 | PD-1 |
| PDR001 | PD-1 |
| REGN2810 | PD-1 |
| BGB-108 | PD-1 |
| BGB-A317 | PD-1 |
| AMP-224 | PD-1 |
| Atezolizumab | PD-L1 (CD274) |
| Avelumab | PD-L1 (CD274) |
| BMS-936559 | PD-L1 (CD274) |
| Durvalumab | PD-L1 (CD274) |
| MEDI-4736 | PD-L1 (CD274) |
| MPDL33280A | PD-L1 (CD274) |
| YW243.55.S70 | PD-L1 (CD274) |
| MDX-1105 | PD-L1 (CD274) |
| MSB0010718C | PD-L1 (CD274) |

In a further preferred embodiment the checkpoint modulator is a decoy receptor (e.g. a soluble receptor). Preferably, the decoy receptor is a soluble PD1 receptor. In a particularly preferred embodiment the at least one RNA of the inventive RNA containing composition comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequence according to SEQ ID NO: 389 encoding a soluble PD-1 receptor.

In a further preferred embodiment of the inventive RNA containing composition the RNA, preferably an mRNA codes for at least one ligand which functions as a checkpoint modulator. Preferably, the ligand is CD40 Ligand (CD40L). In a further preferred embodiment of the inventive RNA containing composition the RNA, preferably an mRNA codes for at least one ligand which functions as a checkpoint modulator. Preferably, the ligand is CD40 Ligand (CD40L). Most preferably the at least one RNA of the inventive RNA containing composition comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequence according to SEQ ID NO: 10073 encoding CD40L.

12. Innate Immune Activators:

In this context innate immune activators may be selected from mammalian, in particular human adjuvant proteins, which typically comprise any human protein or peptide, which is capable of eliciting an innate immune response (in a mammal), e.g. as a reaction of the binding of an exogenous TLR ligand to a TLR. More preferably, human adjuvant proteins are selected from the group consisting of proteins which are components and ligands of the signalling networks of the pattern recognition receptors including TLR, NLR and RLH, including TLR1, TLR2, TLR3, TLR4, TLR5, TLR6, TLR7, TLR8, TLR9, TLR10, TLR11; NOD1, NOD2, NOD3, NOD4, NOD5, NALP1, NALP2, NALP3, NALP4, NALP5, NALP6, NALP6, NALP7, NALP7, NALP8, NALP9, NALP10, NALP11, NALP12, NALP13, NALP14, I IPAF, NAIP, CIITA, RIG-I, MDA5 and LGP2, the signal transducers of TLR signaling including adaptor proteins including e.g. Trif and Cardif; components of the Small-GTPases signalling (RhoA, Ras, Rac1, Cdc42, Rab etc.), components of the PIP signalling (PI3K, Src-Kinases, etc.), components of the MyD88-dependent signalling (MyD88, IRAK1, IRAK2, IRAK4, TIRAP, TRAF6 etc.), components of the MyD88-independent signalling (TI-CAM1, TICAM2, TRAF6, TBK1, IRF3, TAK1, IRAK1 etc.); the activated kinases including e.g. Akt, MEKK1, MKK1, MKK3, MKK4, MKK6, MKK7, ERK1, ERK2, GSK3, PKC kinases, PKD kinases, GSK3 kinases, JNK, p38MAPK, TAK1, IKK, and TAK1; the activated transcription factors including e.g. NF-κB, c-Fos, c-Jun, c-Myc, CREB, AP-1, Elk-1, ATF2, IRF-3, IRF-7.

Mammalian, in particular human adjuvant proteins may furthermore be selected from the group consisting of heat shock proteins, such as HSP10, HSP60, HSP65, HSP70, HSP75 and HSP90, gp96, Fibrinogen, TypIII repeat extra domain A of fibronectin; or components of the complement system including C1q, MBL, C1r, C1s, C2b, Bb, D, MASP-1, MASP-2, C4b, C3b, C5a, C3a, C4a, C5b, C6, C7, C8, C9, CR1, CR2, CR3, CR4, C1qR, C1INH, C4bp, MCP, DAF, H, I, P and CD59, or induced target genes including e.g. Beta-Defensin, cell surface proteins; or human adjuvant proteins including trif, flt-3 ligand, Gp96 or fibronectin, etc., or any species homolog of any of the above human adjuvant proteins. Furthermore HGMB1 may be used as adjuvant protein.

Mammalian, in particular human adjuvant proteins may furthermore comprise cytokines which induce or enhance an innate immune response, including IL-1 alpha, IL1 beta, IL-2, IL-6, IL-7, IL-8, IL-9, IL-12, IL-13, IL-15, IL-16, IL-17, IL-18, IL-21, IL-23, TNFalpha, IFNalpha, IFNbeta, IFNgamma, GM-CSF, G-CSF, M-CSF; chemokines including IL-8, IP-10, MCP-1, MIP-1alpha, RANTES, Eotaxin, CCL21; cytokines which are released from macrophages, including IL-1, IL-6, IL-8, IL-12 and TNF-alpha; as well as IL-1R1 and IL-1 alpha.

Therefore in this context it particularly preferred that the at least one RNA encodes at least one innate immune activator, preferably an adjuvant protein, more preferably a human adjuvant protein, or a fragment or variant thereof.

In this context it is particularly preferred that I constitutive active variant of an adjuvant protein is encoded by the at least one RNA, preferably a constitutive active variant of RIG-1 (ΔRIGI).

In another preferred embodiment the at least one RNA encodes HGMB1 as an innate immune activator, or a fragment or variant thereof.

According to preferred embodiments in the context of the present invention innate immune activators may be selected from any innate immune activator selected from the group consisting of CD55; Akt; ATF2; C1QBP; C1QC; Cardif; CCL11; CCL2; CCL21; CCL3; CCL5; CD59, Beta-Defensin; Cdc42; CFAD; CFAH; CFAI; CH60; CIITA; c-Jun; c-myc; CO8A; CO8B; CO8G; complement_system_component_C1INH; complement_system_component_C1qR; complement_system_component_C1s; complement_system_component_C4bp; complement_system_component_C6; complement_system_component_C7; complement_system_component_C8; complement_system_component_C9; complement_system_component_CR2; complement_system_component_CR3; complement_system_component_MASP-1; complement_system_component_MASP-2; complement_system_component_MBL; complement_system_component_MCP; CREB3; CREB3L1; CREB3L3; CREB3L4; CREB5; CRTC2; CXCL10; CXCL8; DJB11; DJB13; DJB14; DJC10; DJC12; DJC14; DJC15; DJC16; DJC17; DJC18; DJC22; DJC24; DJC25; DJC27; DJC28; DJC30; DNAJB12; DNAJC11; DNAJC21; DNJA1; DNJA2; DNJA3; DNJA4; DNJB1; DNJB2; DNJB3; DNJB4; DNJB5; DNJB6; DNJB7; DNJB8; DNJB9; DNJC1; DNJC2; DNJC3; DNJC4; DNJC5; DNJC7; DNJC8; DNJC9; Elk-1; ERK1; ERK2; Fibrinogen; fibronectin; FLT3_Ligand; FOS; G-CSF; GM-CSF; GRP94_(gp96); GSK3A; GSK3B; HS71A; HS71B; HSC70; HSP10; HSP60; HSP70; HSP75; HSP90; HSP90B1; IFNalpha; IFNB; IFNG; IKK; IL-1; IL-1_alpha; IL-1_beta; IL-12; IL-13; IL-15; IL-16; IL-17A; IL-18; IL-1R1; IL-2; IL-21; IL-23; IL-6; IL-7; IL-9; IRAK1; IRAK2; IRAK4; IRF3; IRF-7; JNK; KPCB; KPCD; KPCD1; KPCD3; KPCE; KPCG; KPCI; KPCL; KPCT; KPCZ; I_IPAF; LGP2; M-CSF; MDA5; MK11; MK12; MK13; MK14; MKK1; MKK3; MKK4; MKK6; MKK7; MSTP104; MyD88; NALP10; NALP11; NALP12; NALP13; NALP2; NALP3; NALP4; NALP5; NALP6; NALP7; NALP8; NALP9; NF-kappaB; NLRP14; NOD1; NOD2; NOD3; PI3K; PKD2; PKN1; PKN2; PKN3; PRKCA; PRKD2; Rab; Rac1; RASH; RASK; RASN; RhoA; RIG-I; Src-Kinases; Surfactant_protein_A; Surfactant_protein_D; TAK1; TBK1; TICAM1; TICAM2; TIRAP; TLR1; TLR10; TLR2; TLR3; TLR4; TLR5; TLR6; TLR7; TLR8; TLR9; TNF; TRAF6, preferably as disclosed in Table 11. Particularly preferred in this context are the RNA sequences encoding a innate immune activator according to Table 11.

TABLE 11

| | Innate immune activators (human adjuvant proteins) | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| CD55 | UniProtKB: B1AP15 | 909 | 910 | 911, 912, 913, 914, 915 |
| CD55 | UniProtKB: D3DT85 | 916 | 917 | 918, 919, 920, 921, 922 |

TABLE 11-continued

| | | | Innate immune activators (human adjuvant proteins) | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| CD55 | UniProtKB: D3DT86 | 923 | 924 | 925, 926, 927, 928, 929 |
| CD55 | UniProtKB: P08174 | 930 | 931 | 932, 933, 934, 935, 936 |
| fibronectin | UniProtKB: A0A024R516 | 1567 | 1568 | 1569, 1570, 1571, 1572, 1573 |
| fibronectin | UniProtKB: A0A024I1301 | 1574 | 1575 | 1576, 1577, 1578, 1579, 1580 |
| fibronectin | UniProtKB: A0A024RDT9 | 1581 | 1582 | 1583, 1584, 1585, 1586, 1587 |
| fibronectin | UniProtKB: A0A024RDV5 | 1588 | 1589 | 1590, 1591, 1592, 1593, 1594 |
| fibronectin | UniProtKB: A6NH44 | 1595 | 1596 | 1597, 1598, 1599, 1600, 1601 |
| fibronectin | UniProtKB: A8K6A5 | 1602 | 1603 | 1604, 1605, 1606, 1607, 1608 |
| fibronectin | UniProtKB: B2R627 | 1609 | 1610 | 1611, 1612, 1613, 1614, 1615 |
| fibronectin | UniProtKB: B3KXM5 | 1616 | 1617 | 1618, 1619, 1620, 1621, 1622 |
| fibronectin | UniProtKB: B4DIC5 | 1623 | 1624 | 1625, 1626, 1627, 1628, 1629 |
| fibronectin | UniProtKB: B4DN21 | 1630 | 1631 | 1632, 1633, 1634, 1635, 1636 |
| fibronectin | UniProtKB: B4DS98 | 1637 | 1638 | 1639, 1640, 1641, 1642, 1643 |
| fibronectin | UniProtKB: B4DTH2 | 1644 | 1645 | 1646, 1647, 1648, 1649, 1650 |
| fibronectin | UniProtKB: B4DTK1 | 1651 | 1652 | 1653, 1654, 1655, 1656, 1657 |
| fibronectin | UniProtKB: B4DU16 | 1658 | 1659 | 1660, 1661, 1662, 1663, 1664 |
| fibronectin | UniProtKB: B7Z3W5 | 1665 | 1666 | 1667, 1668, 1669, 1670, 1671 |
| fibronectin | UniProtKB: B7Z939 | 1672 | 1673 | 1674, 1675, 1676, 1677, 1678 |
| fibronectin | UniProtKB: G5E9X3 | 1679 | 1680 | 1681, 1682, 1683, 1684, 1685 |
| fibronectin | UniProtKB: Q9H382 | 1686 | 1687 | 1688, 1689, 1690, 1691, 1692 |
| FOS | UniProtKB: P01100 | 1693 | 1694 | 1695, 1696, 1697, 1698, 1699 |
| HS71A | UniProtKB: P0DMV8 | 1938 | 1939 | 1940, 1941, 1942, 1943, 1944 |
| HS71B | UniProtKB: P0DMV9 | 1945 | 1946 | 1947, 1948, 1949, 1950, 1951 |
| RASH | UniProtKB: P01112 | 3296 | 3297 | 3298, 3299, 3300, 3301, 3302 |
| RASK | UniProtKB: P01116 | 3303 | 3304 | 3305, 3306, 3307, 3308, 3309 |
| RASN | UniProtKB: P01111 | 3310 | 3311 | 3312, 3313, 3314, 3315, 3316 |
| FLT3 ligand | Genbank: AAA90950.1 | 3913 | 3914 | 3915, 3916, 3917, 3918, 3919, 3920 |
| FLT3 ligand | UniProtKB: P49771 | 3921 | 3922 | 3923, 3924, 3925, 3926, 3927, 3928 |
| G-CSF | UniProtKB: P09919 | 3929 | 3930 | 3931, 3932, 3933, 3934, 3935, 3936 |
| GM-CSF | UniProtKB: P04141 | 3945 | 3946 | 3947, 3948, 3949, 3950, 3951, 3952 |
| IFNalpha | UniProtKB: G9JKF1 | 3953 | 3954 | 3955, 3956, 3957, 3958, 3959, 3960 |
| IFNalpha | UniProtKB: P01562 | 3961 | 3962 | 3963, 3964, 3965, 3966, 3967, 3968 |
| IFNalpha | UniProtKB: P01563 | 3969 | 3970 | 3971, 3972, 3973, 3974, 3975, 3976 |
| IFNalpha | UniProtKB: P01566 | 3977 | 3978 | 3979, 3980, 3981, 3982, 3983, 3984 |
| IFNalpha | UniProtKB: P01567 | 3985 | 3986 | 3987, 3988, 3989, 3990, 3991, 3992 |
| IFNalpha | UniProtKB: P01568 | 3993 | 3994 | 3995, 3996, 3997, 3998, 3999, 4000 |

TABLE 11-continued

| | Innate immune activators (human adjuvant proteins) | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| IFNalpha | UniProtKB: P01569 | 4001 | 4002 | 4003, 4004, 4005, 4006, 4007, 4008 |
| IFNalpha | UniProtKB: P01570 | 4009 | 4010 | 4011, 4012, 4013, 4014, 4015, 4016 |
| IFNalpha | UniProtKB: P01571 | 4017 | 4018 | 4019, 4020, 4021, 4022, 4023, 4024 |
| IFNalpha | UniProtKB: P05013 | 4025 | 4026 | 4027, 4028, 4029, 4030, 4031, 4032 |
| IFNalpha | UniProtKB: P05014 | 4033 | 4034 | 4035, 4036, 4037, 4038, 4039, 4040 |
| IFNalpha | UniProtKB: P05015 | 4041 | 4042 | 4043, 4044, 4045, 4046, 4047, 4048 |
| IFNalpha | UniProtKB: P32881 | 4049 | 4050 | 4051, 4052, 4053, 4054, 4055, 4056 |
| IFNalpha | UniProtKB: Q14618 | 4057 | 4058 | 4059, 4060, 4061, 4062, 4063, 4064 |
| IFNalpha | UniProtKB: Q86UP4 | 4065 | 4066 | 4067, 4068, 4069, 4070, 4071, 4072 |
| IFNB | UniProtKB: P01574 | 4073 | 4074 | 4075, 4076, 4077, 4078, 4079, 4080 |
| IFNB | UniProtKB: Q15943 | 4081 | 4082 | 4083, 4084, 4085, 4086, 4087, 4088 |
| IFNG | UniProtKB: P01579 | 4089 | 4090 | 4091, 4092, 4093, 4094, 4095, 4096 |
| IFNG | UniProtKB: Q14609 | 4097 | 4098 | 4099, 4100, 4101, 4102, 4103, 4104 |
| IFNG | UniProtKB: Q14610 | 4105 | 4106 | 4107, 4108, 4109, 4110, 4111, 4112 |
| IFNG | UniProtKB: Q14611 | 4113 | 4114 | 4115, 4116, 4117, 4118, 4119, 4120 |
| IFNG | UniProtKB: Q14612 | 4121 | 4122 | 4123, 4124, 4125, 4126, 4127, 4128 |
| IFNG | UniProtKB: Q14613 | 4129 | 4130 | 4131, 4132, 4133, 4134, 4135, 4136 |
| IFNG | UniProtKB: Q14614 | 4137 | 4138 | 4139, 4140, 4141, 4142, 4143, 4144 |
| IFNG | UniProtKB: Q14615 | 4145 | 4146 | 4147, 4148, 4149, 4150, 4151, 4152 |
| IFNG | UniProtKB: Q8NHY9 | 4153 | 4154 | 4155, 4156, 4157, 4158, 4159, 4160 |
| IL-12 | UniProtKB: P29460 | 4193 | 4194 | 4195, 4196, 4197, 4198, 4199, 4200 |
| IL-13 | UniProtKB: P35225 | 4201 | 4202 | 4203, 4204, 4205, 4206, 4207, 4208 |
| IL-15 | UniProtKB: P40933 | 4217 | 4218 | 4219, 4220, 4221, 4222, 4223, 4224 |
| IL-16 | UniProtKB: Q14005 | 4225 | 4226 | 4227, 4228, 4229, 4230, 4231, 4232 |
| IL-17A | UniProtKB: Q16552 | 4233 | 4234 | 4235, 4236, 4237, 4238, 4239, 4240 |
| IL-18 | UniProtKB: A0A024113E0 | 4281 | 4282 | 4283, 4284, 4285, 4286, 4287, 4288 |
| IL-18 | UniProtKB: B0YJ28 | 4289 | 4290 | 4291, 4292, 4293, 4294, 4295, 4296 |
| IL-18 | UniProtKB: Q14116 | 4297 | 4298 | 4299, 4300, 4301, 4302, 4303, 4304 |
| IL-1_alpha | UniProtKB: P01583 | 4313 | 4314 | 4315, 4316, 4317, 4318, 4319, 4320 |
| IL-1_beta | UniProtKB: P01584 | 4321 | 4322 | 4323, 4324, 4325, 4326, 4327, 4328 |
| IL-21 | RefSeq: NP_001193935.1 | 4361 | 4362 | 4363, 4364, 4365, 4366, 4367, 4368 |
| IL-21 | RefSeq: NP_068575.1 | 4369 | 4370 | 4371, 4372, 4373, 4374, 4375, 4376 |
| IL-23 | UniProtKB: Q9NPF7 | 4385 | 4386 | 4387, 4388, 4389, 4390, 4391, 4392 |
| IL-2 | UniProtKB: P60568 | 4473 | 4474 | 4475, 4476, 4477, 4478, 4479, 4480 |
| IL-2 | UniProtKB: Q0GK43 | 4481 | 4482 | 4483, 4484, 4485, 4486, 4487, 4488 |
| IL-2 | UniProtKB: Q13169 | 4489 | 4490 | 4491, 4492, 4493, 4494, 4495, 4496 |

TABLE 11-continued

| Innate immune activators (human adjuvant proteins) | | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| IL-2 | UniProtKB: Q6NZ91 | 4497 | 4498 | 4499, 4500, 4501, 4502, 4503, 4504 |
| IL-2 | UniProtKB: Q6NZ93 | 4505 | 4506 | 4507, 4508, 4509, 4510, 4511, 4512 |
| IL-6 | UniProtKB: P05231 | 4593 | 4594 | 4595, 4596, 4597, 4598, 4599, 4600 |
| IL-7 | UniProtKB: A8K673 | 4601 | 4602 | 4603, 4604, 4605, 4606, 4607, 4608 |
| IL-7 | UniProtKB: P13232 | 4609 | 4610 | 4611, 4612, 4613, 4614, 4615, 4616 |
| IL-9 | UniProtKB: P15248 | 4617 | 4618 | 4619, 4620, 4621, 4622, 4623, 4624 |
| M-CSF | UniProtKB: P09603 | 4705 | 4706 | 4707, 4708, 4709, 4710, 4711, 4712 |
| CCL11 | UniProtKB: P51671 | 4833 | 4834 | 4835, 4836, 4837, 4838, 4839, 4840 |
| CCL11 | UniProtKB: Q619T4 | 4841 | 4842 | 4843, 4844, 4845, 4846, 4847, 4848 |
| CCL21 | UniProtKB: O00585 | 4937 | 4938 | 4939, 4940, 4941, 4942, 4943, 4944 |
| CCL2 | UniProtKB: P13500 | 5001 | 5002 | 5003, 5004, 5005, 5006, 5007, 5008 |
| CCL3 | UniProtKB: A0N0R1 | 5009 | 5010 | 5011, 5012, 5013, 5014, 5015, 5016 |
| CCL3 | UniProtKB: P10147 | 5017 | 5018 | 5019, 5020, 5021, 5022, 5023, 5024 |
| CCL5 | UniProtKB: D0EI67 | 5041 | 5042 | 5043, 5044, 5045, 5046, 5047, 5048 |
| CCL5 | UniProtKB: P13501 | 5049 | 5050 | 5051, 5052, 5053, 5054, 5055, 5056 |
| CXCL10 | UniProtKB: A0A024RDA4 | 5129 | 5130 | 5131, 5132, 5133, 5134, 5135, 5136 |
| CXCL10 | UniProtKB: P02778 | 5137 | 5138 | 5139, 5140, 5141, 5142, 5143, 5144 |
| CXCL8 | UniProtKB: P10145 | 5265 | 5266 | 5267, 5268, 5269, 5270, 5271, 5272 |
| TNF | UniProtKB: P01375 | 7369 | 7370 | 7371, 7372, 7373, 7374, 7375, 7376 |
| TNF | UniProtKB: Q5STB3 | 7377 | 7378 | 7379, 7380, 7381, 7382, 7383, 7384 |
| GRP94_(gp96) | UniProtKB: P14625 | 7617 | 7618 | 7619, 7620, 7621, 7622, 7623, 7624 |
| HSC70 | UniProtKB: P11142 | 7625 | 7626 | 7627, 7628, 7629, 7630, 7631, 7632 |
| HSP60 | UniProtKB: A0A024R3X4 | 7657 | 7658 | 7659, 7660, 7661, 7662, 7663, 7664 |
| HSP60 | UniProtKB: B3GQS7 | 7665 | 7666 | 7667, 7668, 7669, 7670, 7671, 7672 |
| HSP60 | UniProtKB: P10809 | 7673 | 7674 | 7675, 7676, 7677, 7678, 7679, 7680 |
| HSP60 | UniProtKB: Q0VDF9 | 7681 | 7682 | 7683, 7684, 7685, 7686, 7687, 7688 |
| HSP70 | UniProtKB: P38646 | 7689 | 7690 | 7691, 7692, 7693, 7694, 7695, 7696 |
| HSP90 | UniProtKB: P07900 | 7697 | 7698 | 7699, 7700, 7701, 7702, 7703, 7704 |
| HSP90 | UniProtKB: P08238 | 7705 | 7706 | 7707, 7708, 7709, 7710, 7711, 7712 |
| Akt | UniProtKB: B0LPE5 | 7737 | 7738 | 7739, 7740, 7741, 7742, 7743 |
| Akt | UniProtKB: P31749 | 7744 | 7745 | 7746, 7747, 7748, 7749, 7750 |
| Akt | UniProtKB: P31751 | 7751 | 7752 | 7753, 7754, 7755, 7756, 7757 |
| Akt | UniProtKB: Q9Y243 | 7758 | 7759 | 7760, 7761, 7762, 7763, 7764 |
| ATF2 | UniProtKB: P15336 | 7765 | 7766 | 7767, 7768, 7769, 7770, 7771 |
| C1QBP | UniProtKB: Q07021 | 7772 | 7773 | 7774, 7775, 7776, 7777, 7778 |
| C1QC | UniProtKB: P02747 | 7779 | 7780 | 7781, 7782, 7783, 7784, 7785 |

TABLE 11-continued

Innate immune activators (human adjuvant proteins)

| Gene Name | Protein Accession No. | Protein Sequence SEQ ID NO: | RNA Sequence wild type SEQ ID NO: | Optimized RNA Sequence SEQ ID NO: |
|---|---|---|---|---|
| Cardif | UniProtKB: Q72434 | 7786 | 7787 | 7788, 7789, 7790, 7791, 7792 |
| CD59, Beta-Defensin | UniProtKB: P13987 | 7793 | 7794 | 7795, 7796, 7797, 7798, 7799 |
| CD59, Beta-Defensin | UniProtKB: Q6FHM9 | 7800 | 7801 | 7802, 7803, 7804, 7805, 7806 |
| Cdc42 | UniProtKB: A0A024RAE4 | 7807 | 7808 | 7809, 7810, 7811, 7812, 7813 |
| Cdc42 | UniProtKB: A0A024RAE6 | 7814 | 7815 | 7816, 7817, 7818, 7819, 7820 |
| Cdc42 | UniProtKB: P60953 | 7821 | 7822 | 7823, 7824, 7825, 7826, 7827 |
| CFAD | UniProtKB: P00746 | 7828 | 7829 | 7830, 7831, 7832, 7833, 7834 |
| CFAH | UniProtKB: P08603 | 7835 | 7836 | 7837, 7838, 7839, 7840, 7841 |
| CFAI | UniProtKB: P05156 | 7842 | 7843 | 7844, 7845, 7846, 7847, 7848 |
| CH60 | RefSeq: NP_002147.2 | 7849 | 7850 | 7851, 7852, 7853, 7854, 7855 |
| CIITA | UniProtKB: Q29704 | 7856 | 7857 | 7858, 7859, 7860, 7861, 7862 |
| c-Jun | UniProtKB: B3KN68 | 7863 | 7864 | 7865, 7866, 7867, 7868, 7869 |
| c-Jun | UniProtKB: B3KNW1 | 7870 | 7871 | 7872, 7873, 7874, 7875, 7876 |
| c-Jun | UniProtKB: B3KXW5 | 7877 | 7878 | 7879, 7880, 7881, 7882, 7883 |
| c-Jun | UniProtKB: B4DED9 | 7884 | 7885 | 7886, 7887, 7888, 7889, 7890 |
| c-Jun | UniProtKB: B4DFU7 | 7891 | 7892 | 7893, 7894, 7895, 7896, 7897 |
| c-Jun | UniProtKB: B4DGE1 | 7898 | 7899 | 7900, 7901, 7902, 7903, 7904 |
| c-Jun | UniProtKB: B4DJ64 | 7905 | 7906 | 7907, 7908, 7909, 7910, 7911 |
| c-Jun | UniProtKB: B4DS36 | 7912 | 7913 | 7914, 7915, 7916, 7917, 7918 |
| c-Jun | UniProtKB: B7Z1L7 | 7919 | 7920 | 7921, 7922, 7923, 7924, 7925 |
| c-Jun | UniProtKB: G1U124 | 7926 | 7927 | 7928, 7929, 7930, 7931, 7932 |
| c-Jun | UniProtKB: G5E966 | 7933 | 7934 | 7935, 7936, 7937, 7938, 7939 |
| c-Jun | UniProtKB: O75843 | 7940 | 7941 | 7942, 7943, 7944, 7945, 7946 |
| c-Jun | UniProtKB: P05412 | 7947 | 7948 | 7949, 7950, 7951, 7952, 7953 |
| c-Jun | UniProtKB: P53677 | 7954 | 7955 | 7956, 7957, 7958, 7959, 7960 |
| c-Jun | UniProtKB: P61966 | 7961 | 7962 | 7963, 7964, 7965, 7966, 7967 |
| c-Jun | UniProtKB: Q63HQ0 | 7968 | 7969 | 7970, 7971, 7972, 7973, 7974 |
| c-Jun | UniProtKB: Q7Z5Q8 | 7975 | 7976 | 7977, 7978, 7979, 7980, 7981 |
| c-Jun | UniProtKB: Q96PC3 | 7982 | 7983 | 7984, 7985, 7986, 7987, 7988 |
| c-Jun | UniProtKB: Q9BXS5 | 7989 | 7990 | 7991, 7992, 7993, 7994, 7995 |
| c-Jun | UniProtKB: Q9Y6Q5 | 7996 | 7997 | 7998, 7999, 8000, 8001, 8002 |
| CO8A | UniProtKB: P07357 | 8003 | 8004 | 8005, 8006, 8007, 8008, 8009 |
| CO8B | UniProtKB: P07358 | 8010 | 8011 | 8012, 8013, 8014, 8015, 8016 |
| CO8G | UniProtKB: P07360 | 8017 | 8018 | 8019, 8020, 8021, 8022, 8023 |
| complement_system_component_C1INH | UniProtKB: P05155 | 8024 | 8025 | 8026, 8027, 8028, 8029, 8030 |
| complement_system_component_C1q11 | UniProtKB: Q8IXK1 | 8031 | 8032 | 8033, 8034, 8035, 8036, 8037 |

TABLE 11-continued

| Innate immune activators (human adjuvant proteins) | | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| complement_system_component_C1s | UniProtKB: P09871 | 8038 | 8039 | 8040, 8041, 8042, 8043, 8044 |
| complement_system_component_C4bp | UniProtKB: P04003 | 8045 | 8046 | 8047, 8048, 8049, 8050, 8051 |
| complement_system_component_C6 | UniProtKB: P13671 | 8052 | 8053 | 8054, 8055, 8056, 8057, 8058 |
| complement_system_component_C7 | UniProtKB: P10643 | 8059 | 8060 | 8061, 8062, 8063, 8064, 8065 |
| complement_system_component_C8 | UniProtKB: Q99618 | 8066 | 8067 | 8068, 8069, 8070, 8071, 8072 |
| complement_system_component_C9 | UniProtKB: A0A024R035 | 8073 | 8074 | 8075, 8076, 8077, 8078, 8079 |
| complement_system_component_C9 | UniProtKB: P02748 | 8080 | 8081 | 8082, 8083, 8084, 8085, 8086 |
| complement_system_component_CR2 | UniProtKB: P20023 | 8087 | 8088 | 8089, 8090, 8091, 8092, 8093 |
| complement_system_component_CR3 | UniProtKB: D3DSM0 | 8094 | 8095 | 8096, 8097, 8098, 8099, 8100 |
| complement_system_component_CR3 | UniProtKB: P05107 | 8101 | 8102 | 8103, 8104, 8105, 8106, 8107 |
| complement_system_component_MASP-1 | UniProtKB: P48740 | 8108 | 8109 | 8110, 8111, 8112, 8113, 8114 |
| complement_system_component_MASP-2 | UniProtKB: O00187 | 8115 | 8116 | 8117, 8118, 8119, 8120, 8121 |
| complement_system_component_MBL | UniProtKB: P11226 | 8122 | 8123 | 8124, 8125, 8126, 8127, 8128 |
| complement_system_component_MCP | UniProtKB: P15529 | 8129 | 8130 | 8131, 8132, 8133, 8134, 8135 |
| complement_system_component_MCP | UniProtKB: P40121 | 8136 | 8137 | 8138, 8139, 8140, 8141, 8142 |
| CREB3 | CCDS: CCDS6588.1 | 8143 | 8144 | 8145, 8146, 8147, 8148, 8149 |
| CREB3L1 | UniProtKB: Q96BA8 | 8150 | 8151 | 8152, 8153, 8154, 8155, 8156 |
| CREB3L3 | UniProtKB: Q68CJ9 | 8157 | 8158 | 8159, 8160, 8161, 8162, 8163 |
| CREB3L4 | UniProtKB: Q8TEY5 | 8164 | 8165 | 8166, 8167, 8168, 8169, 8170 |
| CREB5 | UniProtKB: Q02930 | 8171 | 8172 | 8173, 8174, 8175, 8176, 8177 |
| CRTC2 | UniProtKB: Q53ET0 | 8178 | 8179 | 8180, 8181, 8182, 8183, 8184 |
| DJB11 | UniProtKB: Q9UBS4 | 8185 | 8186 | 8187, 8188, 8189, 8190, 8191 |
| DJB13 | UniProtKB: P59910 | 8192 | 8193 | 8194, 8195, 8196, 8197, 8198 |
| DJB14 | UniProtKB: Q8TBM8 | 8199 | 8200 | 8201, 8202, 8203, 8204, 8205 |
| DJC10 | UniProtKB: Q8IXB1 | 8206 | 8207 | 8208, 8209, 8210, 8211, 8212 |
| DJC12 | UniProtKB: Q9UKB3 | 8213 | 8214 | 8215, 8216, 8217, 8218, 8219 |
| DJC14 | UniProtKB: Q6Y2X3 | 8220 | 8221 | 8222, 8223, 8224, 8225, 8226 |
| DJC15 | UniProtKB: Q9Y5T4 | 8227 | 8228 | 8229, 8230, 8231, 8232, 8233 |
| DJC16 | UniProtKB: Q9Y2G8 | 8234 | 8235 | 8236, 8237, 8238, 8239, 8240 |
| DJC17 | UniProtKB: Q9NVM6 | 8241 | 8242 | 8243, 8244, 8245, 8246, 8247 |
| DJC18 | UniProtKB: Q9H819 | 8248 | 8249 | 8250, 8251, 8252, 8253, 8254 |
| DJC22 | UniProtKB: Q8N4W6 | 8255 | 8256 | 8257, 8258, 8259, 8260, 8261 |
| DJC24 | UniProtKB: Q6P3W2 | 8262 | 8263 | 8264, 8265, 8266, 8267, 8268 |
| DJC25 | UniProtKB: Q9H1X3 | 8269 | 8270 | 8271, 8272, 8273, 8274, 8275 |
| DJC27 | UniProtKB: Q9NZQ0 | 8276 | 8277 | 8278, 8279, 8280, 8281, 8282 |
| DJC28 | UniProtKB: Q9NX36 | 8283 | 8284 | 8285, 8286, 8287, 8288, 8289 |

TABLE 11-continued

| Innate immune activators (human adjuvant proteins) | | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| DJC30 | UniProtKB: Q96LL9 | 8290 | 8291 | 8292, 8293, 8294, 8295, 8296 |
| DNAJB12 | RefSeq: NP_001002762.2 | 8297 | 8298 | 8299, 8300, 8301, 8302, 8303 |
| DNAJC11 | UniProtKB: Q9NVH1 | 8304 | 8305 | 8306, 8307, 8308, 8309, 8310 |
| DNAJC21 | UniProtKB: Q5F1R6 | 8311 | 8312 | 8313, 8314, 8315, 8316, 8317 |
| DNJA1 | UniProtKB: P31689 | 8318 | 8319 | 8320, 8321, 8322, 8323, 8324 |
| DNJA2 | UniProtKB: O60884 | 8325 | 8326 | 8327, 8328, 8329, 8330, 8331 |
| DNJA3 | UniProtKB: Q96EY1 | 8332 | 8333 | 8334, 8335, 8336, 8337, 8338 |
| DNJA4 | UniProtKB: Q8WW22 | 8339 | 8340 | 8341, 8342, 8343, 8344, 8345 |
| DNJB1 | UniProtKB: P25685 | 8346 | 8347 | 8348, 8349, 8350, 8351, 8352 |
| DNJB2 | UniProtKB: P25686 | 8353 | 8354 | 8355, 8356, 8357, 8358, 8359 |
| DNJB3 | UniProtKB: Q8WWF6 | 8360 | 8361 | 8362, 8363, 8364, 8365, 8366 |
| DNJB4 | UniProtKB: Q9UDY4 | 8367 | 8368 | 8369, 8370, 8371, 8372, 8373 |
| DNJB5 | UniProtKB: O75953 | 8374 | 8375 | 8376, 8377, 8378, 8379, 8380 |
| DNJB6 | UniProtKB: O75190 | 8381 | 8382 | 8383, 8384, 8385, 8386, 8387 |
| DNJB7 | UniProtKB: Q7Z6W7 | 8388 | 8389 | 8390, 8391, 8392, 8393, 8394 |
| DNJB8 | UniProtKB: Q8NHS0 | 8395 | 8396 | 8397, 8398, 8399, 8400, 8401 |
| DNJB9 | UniProtKB: Q9UBS3 | 8402 | 8403 | 8404, 8405, 8406, 8407, 8408 |
| DNJC1 | UniProtKB: Q96KC8 | 8409 | 8410 | 8411, 8412, 8413, 8414, 8415 |
| DNJC2 | UniProtKB: Q99543 | 8416 | 8417 | 8418, 8419, 8420, 8421, 8422 |
| DNJC3 | UniProtKB: Q13217 | 8423 | 8424 | 8425, 8426, 8427, 8428, 8429 |
| DNJC4 | UniProtKB: Q9NNZ3 | 8430 | 8431 | 8432, 8433, 8434, 8435, 8436 |
| DNJC5 | UniProtKB: Q9H3Z4 | 8437 | 8438 | 8439, 8440, 8441, 8442, 8443 |
| DNJC7 | UniProtKB: Q99615 | 8444 | 8445 | 8446, 8447, 8448, 8449, 8450 |
| DNJC8 | UniProtKB: O75937 | 8451 | 8452 | 8453, 8454, 8455, 8456, 8457 |
| DNJC9 | UniProtKB: Q8WXX5 | 8458 | 8459 | 8460, 8461, 8462, 8463, 8464 |
| Elk-1 | UniProtKB: P19419 | 8465 | 8466 | 8467, 8468, 8469, 8470, 8471 |
| Elk-1 | UniProtKB: Q8N9S0 | 8472 | 8473 | 8474, 8475, 8476, 8477, 8478 |
| ERK1 | UniProtKB: P27361 | 8479 | 8480 | 8481, 8482, 8483, 8484, 8485 |
| ERK2 | UniProtKB: P28482 | 8486 | 8487 | 8488, 8489, 8490, 8491, 8492 |
| Fibrinogen | UniProtKB: A0A024R8B4 | 8493 | 8494 | 8495, 8496, 8497, 8498, 8499 |
| Fibrinogen | UniProtKB: A4D1B8 | 8500 | 8501 | 8502, 8503, 8504, 8505, 8506 |
| Fibrinogen | UniProtKB: A8K8X4 | 8507 | 8508 | 8509, 8510, 8511, 8512, 8513 |
| Fibrinogen | UniProtKB: B4DTN2 | 8514 | 8515 | 8516, 8517, 8518, 8519, 8520 |
| Fibrinogen | UniProtKB: B4E1D3 | 8521 | 8522 | 8523, 8524, 8525, 8526, 8527 |
| Fibrinogen | UniProtKB: D3DP13 | 8528 | 8529 | 8530, 8531, 8532, 8533, 8534 |
| Fibrinogen | UniProtKB: D3DP16 | 8535 | 8536 | 8537, 8538, 8539, 8540, 8541 |

TABLE 11-continued

| | Innate immune activators (human adjuvant proteins) | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| Fibrinogen | UniProtKB: D3DSP9 | 8542 | 8543 | 8544, 8545, 8546, 8547, 8548 |
| Fibrinogen | UniProtKB: P02671 | 8549 | 8550 | 8551, 8552, 8553, 8554, 8555 |
| Fibrinogen | UniProtKB: P02675 | 8556 | 8557 | 8558, 8559, 8560, 8561, 8562 |
| Fibrinogen | UniProtKB: P02679 | 8563 | 8564 | 8565, 8566, 8567, 8568, 8569 |
| Fibrinogen | UniProtKB: Q08830 | 8570 | 8571 | 8572, 8573, 8574, 8575, 8576 |
| Fibrinogen | UniProtKB: Q14314 | 8577 | 8578 | 8579, 8580, 8581, 8582, 8583 |
| Fibrinogen | UniProtKB: Q6UXM4 | 8584 | 8585 | 8586, 8587, 8588, 8589, 8590 |
| Fibrinogen | UniProtKB: Q9UE34 | 8591 | 8592 | 8593, 8594, 8595, 8596, 8597 |
| FOS | UniProtKB: A0A024RD16 | 8598 | 8599 | 8600, 8601, 8602, 8603, 8604 |
| GSK3A | UniProtKB: P49840 | 8605 | 8606 | 8607, 8608, 8609, 8610, 8611 |
| GSK3B | UniProtKB: P49841 | 8612 | 8613 | 8614, 8615, 8616, 8617, 8618 |
| HSP10 | UniProtKB: P61604 | 8619 | 8620 | 8621, 8622, 8623, 8624, 8625 |
| HSP75 | UniProtKB: Q12931 | 8626 | 8627 | 8628, 8629, 8630, 8631, 8632 |
| HSP90B1 | UniProtKB: Q5CAQ5 | 8633 | 8634 | 8635, 8636, 8637, 8638, 8639 |
| IKK | UniProtKB: O14920 | 8640 | 8641 | 8642, 8643, 8644, 8645, 8646 |
| IKK | UniProtKB: Q14164 | 8647 | 8648 | 8649, 8650, 8651, 8652, 8653 |
| IKK | UniProtKB: Q9Y6K9 | 8654 | 8655 | 8656, 8657, 8658, 8659, 8660 |
| IL-1 | UniProtKB: O43353 | 8661 | 8662 | 8663, 8664, 8665, 8666, 8667 |
| IL-1 | UniProtKB: Q8N9C1 | 8668 | 8669 | 8670, 8671, 8672, 8673, 8674 |
| IL-1 | UniProtKB: Q8WWZ1 | 8675 | 8676 | 8677, 8678, 8679, 8680, 8681 |
| IL-1 | UniProtKB: Q9NZH7 | 8682 | 8683 | 8684, 8685, 8686, 8687, 8688 |
| IL-1 | UniProtKB: Q9UBH0 | 8689 | 8690 | 8691, 8692, 8693, 8694, 8695 |
| IL-1 | UniProtKB: Q9UHA7 | 8696 | 8697 | 8698, 8699, 8700, 8701, 8702 |
| IL-1R1 | UniProtKB: P14778 | 8703 | 8704 | 8705, 8706, 8707, 8708, 8709 |
| IL-1R1 | UniProtKB: Q6NWP5 | 8710 | 8711 | 8712, 8713, 8714, 8715, 8716 |
| IL-1R1 | UniProtKB: Q6NWP6 | 8717 | 8718 | 8719, 8720, 8721, 8722, 8723 |
| IRAK1 | UniProtKB: L8E7M9 | 8724 | 8725 | 8726, 8727, 8728, 8729, 8730 |
| IRAK1 | UniProtKB: P51617 | 8731 | 8732 | 8733, 8734, 8735, 8736, 8737 |
| IRAK2 | UniProtKB: O43187 | 8738 | 8739 | 8740, 8741, 8742, 8743, 8744 |
| IRAK4 | UniProtKB: Q69FE3 | 8745 | 8746 | 8747, 8748, 8749, 8750, 8751 |
| IRAK4 | UniProtKB: Q7Z6A7 | 8752 | 8753 | 8754, 8755, 8756, 8757, 8758 |
| IRAK4 | UniProtKB: Q7Z6A8 | 8759 | 8760 | 8761, 8762, 8763, 8764, 8765 |
| IRAK4 | UniProtKB: Q9NWZ3 | 8766 | 8767 | 8768, 8769, 8770, 8771, 8772 |
| IRF3 | UniProtKB: A0A024QZE1 | 8773 | 8774 | 8775, 8776, 8777, 8778, 8779 |
| IRF3 | UniProtKB: E2GIM5 | 8780 | 8781 | 8782, 8783, 8784, 8785, 8786 |
| IRF3 | UniProtKB: E2GIM6 | 8787 | 8788 | 8789, 8790, 8791, 8792, 8793 |

TABLE 11-continued

| | Innate immune activators (human adjuvant proteins) | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| IRF3 | UniProtKB: E2GIM7 | 8794 | 8795 | 8796, 8797, 8798, 8799, 8800 |
| IRF3 | UniProtKB: E2GIM8 | 8801 | 8802 | 8803, 8804, 8805, 8806, 8807 |
| IRF3 | UniProtKB: E2GIM9 | 8808 | 8809 | 8810, 8811, 8812, 8813, 8814 |
| IRF3 | UniProtKB: Q14653 | 8815 | 8816 | 8817, 8818, 8819, 8820, 8821 |
| IRF3 | UniProtKB: Q96GL3 | 8822 | 8823 | 8824, 8825, 8826, 8827, 8828 |
| IRF-7 | UniProtKB: Q92985 | 8829 | 8830 | 8831, 8832, 8833, 8834, 8835 |
| JNK | UniProtKB: B4DU99 | 8836 | 8837 | 8838, 8839, 8840, 8841, 8842 |
| KPCB | UniProtKB: P05771-1 | 8843 | 8844 | 8845, 8846, 8847, 8848, 8849 |
| KPCB | UniProtKB: P05771-2 | 8850 | 8851 | 8852, 8853, 8854, 8855, 8856 |
| KPCD1 | UniProtKB: Q15139 | 8857 | 8858 | 8859, 8860, 8861, 8862, 8863 |
| KPCD3 | UniProtKB: O94806 | 8864 | 8865 | 8866, 8867, 8868, 8869, 8870 |
| KPCD | UniProtKB: Q05655 | 8871 | 8872 | 8873, 8874, 8875, 8876, 8877 |
| KPCE | UniProtKB: Q02156 | 8878 | 8879 | 8880, 8881, 8882, 8883, 8884 |
| KPCG | UniProtKB: P05129 | 8885 | 8886 | 8887, 8888, 8889, 8890, 8891 |
| KPCI | UniProtKB: P41743 | 8892 | 8893 | 8894, 8895, 8896, 8897, 8898 |
| KPCL | UniProtKB: P24723 | 8899 | 8900 | 8901, 8902, 8903, 8904, 8905 |
| KPCT | UniProtKB: Q04759 | 8906 | 8907 | 8908, 8909, 8910, 8911, 8912 |
| KPCZ | UniProtKB: Q05513 | 8913 | 8914 | 8915, 8916, 8917, 8918, 8919 |
| LGP2 | UniProtKB: A0A024R1Y5 | 8920 | 8921 | 8922, 8923, 8924, 8925, 8926 |
| LGP2 | UniProtKB: Q96C10 | 8927 | 8928 | 8929, 8930, 8931, 8932, 8933 |
| LIPAF | UniProtKB: Q9NPP4 | 8934 | 8935 | 8936, 8937, 8938, 8939, 8940 |
| MDA5 | UniProtKB: Q9BYX4 | 8941 | 8942 | 8943, 8944, 8945, 8946, 8947 |
| MK11 | UniProtKB: Q15759 | 8948 | 8949 | 8950, 8951, 8952, 8953, 8954 |
| MK12 | UniProtKB: P53778 | 8955 | 8956 | 8957, 8958, 8959, 8960, 8961 |
| MK13 | UniProtKB: O15264 | 8962 | 8963 | 8964, 8965, 8966, 8967, 8968 |
| MK14 | UniProtKB: Q16539 | 8969 | 8970 | 8971, 8972, 8973, 8974, 8975 |
| MKK1 | UniProtKB: Q02750 | 8976 | 8977 | 8978, 8979, 8980, 8981, 8982 |
| MKK3 | UniProtKB: P46734 | 8983 | 8984 | 8985, 8986, 8987, 8988, 8989 |
| MKK4 | UniProtKB: P45985 | 8990 | 8991 | 8992, 8993, 8994, 8995, 8996 |
| MKK6 | UniProtKB: P52564 | 8997 | 8998 | 8999, 9000, 9001, 9002, 9003 |
| MKK7 | UniProtKB: O14733 | 9004 | 9005 | 9006, 9007, 9008, 9009, 9010 |
| MSTP104 | UniProtKB: Q7Z4D5 | 9011 | 9012 | 9013, 9014, 9015, 9016, 9017 |
| MyD88 | UniProtKB: Q99836 | 9018 | 9019 | 9020, 9021, 9022, 9023, 9024 |
| NALP10 | UniProtKB: Q86W26 | 9025 | 9026 | 9027, 9028, 9029, 9030, 9031 |
| NALP11 | UniProtKB: P59045 | 9032 | 9033 | 9034, 9035, 9036, 9037, 9038 |
| NALP12 | UniProtKB: P59046 | 9039 | 9040 | 9041, 9042, 9043, 9044, 9045 |

TABLE 11-continued

Innate immune activators (human adjuvant proteins)

| Gene Name | Protein Accession No. | Protein Sequence SEQ ID NO: | RNA Sequence wild type SEQ ID NO: | Optimized RNA Sequence SEQ ID NO: |
|---|---|---|---|---|
| NALP13 | UniProtKB: Q86W25 | 9046 | 9047 | 9048, 9049, 9050, 9051, 9052 |
| NALP2 | UniProtKB: Q8WY49 | 9053 | 9054 | 9055, 9056, 9057, 9058, 9059 |
| NALP2 | UniProtKB: Q9NX02 | 9060 | 9061 | 9062, 9063, 9064, 9065, 9066 |
| NALP3 | UniProtKB: Q96P20 | 9067 | 9068 | 9069, 9070, 9071, 9072, 9073 |
| NALP4 | UniProtKB: Q96MN2 | 9074 | 9075 | 9076, 9077, 9078, 9079, 9080 |
| NALP5 | UniProtKB: P59047 | 9081 | 9082 | 9083, 9084, 9085, 9086, 9087 |
| NALP6 | UniProtKB: P59044 | 9088 | 9089 | 9090, 9091, 9092, 9093, 9094 |
| NALP7 | UniProtKB: Q8WX94 | 9095 | 9096 | 9097, 9098, 9099, 9100, 9101 |
| NALP8 | UniProtKB: Q86W28 | 9102 | 9103 | 9104, 9105, 9106, 9107, 9108 |
| NALP9 | UniProtKB: Q7RTR0 | 9109 | 9110 | 9111, 9112, 9113, 9114, 9115 |
| NF-kappaB | UniProtKB: A3F768 | 9116 | 9117 | 9118, 9119, 9120, 9121, 9122 |
| NF-kappaB | UniProtKB: A3F769 | 9123 | 9124 | 9125, 9126, 9127, 9128, 9129 |
| NLRP14 | UniProtKB: Q86UT6 | 9130 | 9131 | 9132, 9133, 9134, 9135, 9136 |
| NLRP14 | UniProtKB: Q86W24 | 9137 | 9138 | 9139, 9140, 9141, 9142, 9143 |
| NOD1 | UniProtKB: G3XAL1 | 9144 | 9145 | 9146, 9147, 9148, 9149, 9150 |
| NOD1 | UniProtKB: Q9Y239 | 9151 | 9152 | 9153, 9154, 9155, 9156, 9157 |
| NOD2 | UniProtKB: Q9HC29 | 9158 | 9159 | 9160, 9161, 9162, 9163, 9164 |
| NOD3 | UniProtKB: C3VPR7 | 9165 | 9166 | 9167, 9168, 9169, 9170, 9171 |
| NOD3 | UniProtKB: H3BLT9 | 9172 | 9173 | 9174, 9175, 9176, 9177, 9178 |
| NOD3 | UniProtKB: Q7RTR2 | 9179 | 9180 | 9181, 9182, 9183, 9184, 9185 |
| P13K | UniProtKB: O00329 | 9186 | 9187 | 9188, 9189, 9190, 9191, 9192 |
| P13K | UniProtKB: O00459 | 9193 | 9194 | 9195, 9196, 9197, 9198, 9199 |
| P13K | UniProtKB: P27986 | 9200 | 9201 | 9202, 9203, 9204, 9205, 9206 |
| P13K | UniProtKB: P42336 | 9207 | 9208 | 9209, 9210, 9211, 9212, 9213 |
| P13K | UniProtKB: P42338 | 9214 | 9215 | 9216, 9217, 9218, 9219, 9220 |
| P13K | UniProtKB: P48736 | 9221 | 9222 | 9223, 9224, 9225, 9226, 9227 |
| P13K | UniProtKB: Q5UE93 | 9228 | 9229 | 9230, 9231, 9232, 9233, 9234 |
| P13K | UniProtKB: Q8NEB9 | 9235 | 9236 | 9237, 9238, 9239, 9240, 9241 |
| P13K | UniProtKB: Q8WYR1 | 9242 | 9243 | 9244, 9245, 9246, 9247, 9248 |
| PKD2 | UniProtKB: Q13563 | 9249 | 9250 | 9251, 9252, 9253, 9254, 9255 |
| PKN1 | UniProtKB: Q16512 | 9256 | 9257 | 9258, 9259, 9260, 9261, 9262 |
| PKN2 | UniProtKB: Q16513 | 9263 | 9264 | 9265, 9266, 9267, 9268, 9269 |
| PKN3 | UniProtKB: Q6P5Z2 | 9270 | 9271 | 9272, 9273, 9274, 9275, 9276 |
| PRKCA | UniProtKB: P17252 | 9277 | 9278 | 9279, 9280, 9281, 9282, 9283 |
| PRKD2 | RefSeq: NP_001073349.1 | 9284 | 9285 | 9286, 9287, 9288, 9289, 9290 |
| Rab | UniProtKB: P52594 | 9291 | 9292 | 9293, 9294, 9295, 9296, 9297 |

TABLE 11-continued

| Innate immune activators (human adjuvant proteins) | | | | |
|---|---|---|---|---|
| Gene Name | Protein Accession No. | Protein Sequence SEQ ID NO: | RNA Sequence wild type SEQ ID NO: | Optimized RNA Sequence SEQ ID NO: |
| Rac1 | UniProtKB: A4D2P0 | 9298 | 9299 | 9300, 9301, 9302, 9303, 9304 |
| Rac1 | UniProtKB: A4D2P1 | 9305 | 9306 | 9307, 9308, 9309, 9310, 9311 |
| Rac1 | UniProtKB: A4D2P2 | 9312 | 9313 | 9314, 9315, 9316, 9317, 9318 |
| Rac1 | UniProtKB: P63000 | 9319 | 9320 | 9321, 9322, 9323, 9324, 9325 |
| Rac1 | UniProtKB: W0UV93 | 9326 | 9327 | 9328, 9329, 9330, 9331, 9332 |
| RhoA | UniProtKB: A0A024R324 | 9333 | 9334 | 9335, 9336, 9337, 9338, 9339 |
| RhoA | UniProtKB: P61586 | 9340 | 9341 | 9342, 9343, 9344, 9345, 9346 |
| RIG-I | UniProtKB: O95786 | 9347 | 9348 | 9349, 9350, 9351, 9352, 9353 |
| RIG-I | UniProtKB: Q8IUD6 | 9354 | 9355 | 9356, 9357, 9358, 9359, 9360 |
| Src-Kinases | UniProtKB: Q9H5V8 | 9361 | 9362 | 9363, 9364, 9365, 9366, 9367 |
| Surfactant_protein_A | UniProtKB: Q8IWL1 | 9368 | 9369 | 9370, 9371, 9372, 9373, 9374 |
| Surfactant_protein_A | UniProtKB: Q8IWL2 | 9375 | 9376 | 9377, 9378, 9379, 9380, 9381 |
| Surfactant_protein_D | UniProtKB: P35247 | 9382 | 9383 | 9384, 9385, 9386, 9387, 9388 |
| TAK1 | UniProtKB: O43318 | 9389 | 9390 | 9391, 9392, 9393, 9394, 9395 |
| TAK1 | UniProtKB: P49116 | 9396 | 9397 | 9398, 9399, 9400, 9401, 9402 |
| TBK1 | UniProtKB: Q9UHD2 | 9403 | 9404 | 9405, 9406, 9407, 9408, 9409 |
| TICAM1 | UniProtKB: Q8IUC6 | 9410 | 9411 | 9412, 9413, 9414, 9415, 9416 |
| TICAM2 | UniProtKB: Q86XR7 | 9417 | 9418 | 9419, 9420, 9421, 9422, 9423 |
| TIRAP | UniProtKB: A0A024R3M4 | 9424 | 9425 | 9426, 9427, 9428, 9429, 9430 |
| TIRAP | UniProtKB: P58753 | 9431 | 9432 | 9433, 9434, 9435, 9436, 9437 |
| TLR10 | UniProtKB: A0A024R9W4 | 9438 | 9439 | 9440, 9441, 9442, 9443, 9444 |
| TLR10 | UniProtKB: D1CS19 | 9445 | 9446 | 9447, 9448, 9449, 9450, 9451 |
| TLR10 | UniProtKB: D1CS20 | 9452 | 9453 | 9454, 9455, 9456, 9457, 9458 |
| TLR10 | UniProtKB: D1CS24 | 9459 | 9460 | 9461, 9462, 9463, 9464, 9465 |
| TLR10 | UniProtKB: D1CS26 | 9466 | 9467 | 9468, 9469, 9470, 9471, 9472 |
| TLR10 | UniProtKB: D1CS27 | 9473 | 9474 | 9475, 9476, 9477, 9478, 9479 |
| TLR10 | UniProtKB: D1CS28 | 9480 | 9481 | 9482, 9483, 9484, 9485, 9486 |
| TLR10 | UniProtKB: D1CS29 | 9487 | 9488 | 9489, 9490, 9491, 9492, 9493 |
| TLR10 | UniProtKB: D1CS30 | 9494 | 9495 | 9496, 9497, 9498, 9499, 9500 |
| TLR10 | UniProtKB: Q9BXR5 | 9501 | 9502 | 9503, 9504, 9505, 9506, 9507 |
| TLR1 | UniProtKB: D1CS34 | 9508 | 9509 | 9510, 9511, 9512, 9513, 9514 |
| TLR1 | UniProtKB: D1CS35 | 9515 | 9516 | 9517, 9518, 9519, 9520, 9521 |
| TLR1 | UniProtKB: D1CS36 | 9522 | 9523 | 9524, 9525, 9526, 9527, 9528 |
| TLR1 | UniProtKB: D1CS38 | 9529 | 9530 | 9531, 9532, 9533, 9534, 9535 |
| TLR1 | UniProtKB: D1CS42 | 9536 | 9537 | 9538, 9539, 9540, 9541, 9542 |
| TLR1 | UniProtKB: D1CS43 | 9543 | 9544 | 9545, 9546, 9547, 9548, 9549 |

TABLE 11-continued

| | | | RNA | |
| | | Protein | Sequence | |
| | | Sequence | wild type | |
| | Protein | SEQ ID | SEQ ID | Optimized RNA Sequence |
| Gene Name | Accession No. | NO: | NO: | SEQ ID NO: |
| --- | --- | --- | --- | --- |
| TLR1 | UniProtKB: D1CS44 | 9550 | 9551 | 9552, 9553, 9554, 9555, 9556 |
| TLR1 | UniProtKB: Q15399 | 9557 | 9558 | 9559, 9560, 9561, 9562, 9563 |
| TLR1 | UniProtKB: Q5FWG5 | 9564 | 9565 | 9566, 9567, 9568, 9569, 9570 |
| TLR1 | UniProtKB: Q6F164 | 9571 | 9572 | 9573, 9574, 9575, 9576, 9577 |
| TLR2 | UniProtKB: O60603 | 9578 | 9579 | 9580, 9581, 9582, 9583, 9584 |
| TLR3 | UniProtKB: O15455 | 9585 | 9586 | 9587, 9588, 9589, 9590, 9591 |
| TLR4 | UniProtKB: D1CS55 | 9592 | 9593 | 9594, 9595, 9596, 9597, 9598 |
| TLR4 | UniProtKB: O00206 | 9599 | 9600 | 9601, 9602, 9603, 9604, 9605 |
| TLR5 | UniProtKB: D1CS79 | 9606 | 9607 | 9608, 9609, 9610, 9611, 9612 |
| TLR5 | UniProtKB: D1CS82 | 9613 | 9614 | 9615, 9616, 9617, 9618, 9619 |
| TLR5 | UniProtKB: D1CS83 | 9620 | 9621 | 9622, 9623, 9624, 9625, 9626 |
| TLR5 | UniProtKB: D1CS84 | 9627 | 9628 | 9629, 9630, 9631, 9632, 9633 |
| TLR5 | UniProtKB: D1CS85 | 9634 | 9635 | 9636, 9637, 9638, 9639, 9640 |
| TLR5 | UniProtKB: D1CS87 | 9641 | 9642 | 9643, 9644, 9645, 9646, 9647 |
| TLR5 | UniProtKB: D1CS88 | 9648 | 9649 | 9650, 9651, 9652, 9653, 9654 |
| TLR5 | UniProtKB: D1CS89 | 9655 | 9656 | 9657, 9658, 9659, 9660, 9661 |
| TLR5 | UniProtKB: D1CS90 | 9662 | 9663 | 9664, 9665, 9666, 9667, 9668 |
| TLR6 | UniProtKB: B6CH37 | 9669 | 9670 | 9671, 9672, 9673, 9674, 9675 |
| TLR6 | UniProtKB: B6CH42 | 9676 | 9677 | 9678, 9679, 9680, 9681, 9682 |
| TLR6 | UniProtKB: B6CH44 | 9683 | 9684 | 9685, 9686, 9687, 9688, 9689 |
| TLR6 | UniProtKB: B6CH45 | 9690 | 9691 | 9692, 9693, 9694, 9695, 9696 |
| TLR6 | UniProtKB: B6RFS7 | 9697 | 9698 | 9699, 9700, 9701, 9702, 9703 |
| TLR6 | UniProtKB: D1CS91 | 9704 | 9705 | 9706, 9707, 9708, 9709, 9710 |
| TLR6 | UniProtKB: D1CS92 | 9711 | 9712 | 9713, 9714, 9715, 9716, 9717 |
| TLR6 | UniProtKB: D1CS93 | 9718 | 9719 | 9720, 9721, 9722, 9723, 9724 |
| TLR6 | UniProtKB: D1CS96 | 9725 | 9726 | 9727, 9728, 9729, 9730, 9731 |
| TLR6 | UniProtKB: D1CS97 | 9732 | 9733 | 9734, 9735, 9736, 9737, 9738 |
| TLR6 | UniProtKB: D1CS98 | 9739 | 9740 | 9741, 9742, 9743, 9744, 9745 |
| TLR6 | UniProtKB: D1CS99 | 9746 | 9747 | 9748, 9749, 9750, 9751, 9752 |
| TLR6 | UniProtKB: D1CSA0 | 9753 | 9754 | 9755, 9756, 9757, 9758, 9759 |
| TLR7 | UniProtKB: B2R9N9 | 9760 | 9761 | 9762, 9763, 9764, 9765, 9766 |
| TLR7 | UniProtKB: D1CS68 | 9767 | 9768 | 9769, 9770, 9771, 9772, 9773 |
| TLR7 | UniProtKB: Q9NYK1 | 9774 | 9775 | 9776, 9777, 9778, 9779, 9780 |
| TLR8 | UniProtKB: Q495P6 | 9781 | 9782 | 9783, 9784, 9785, 9786, 9787 |
| TLR8 | UniProtKB: Q495P7 | 9788 | 9789 | 9790, 9791, 9792, 9793, 9794 |
| TLR8 | UniProtKB: Q9NR97 | 9795 | 9796 | 9797, 9798, 9799, 9800, 9801 |

TABLE 11-continued

Innate immune activators (human adjuvant proteins)

| Gene Name | Protein Accession No. | Protein Sequence SEQ ID NO: | RNA Sequence wild type SEQ ID NO: | Optimized RNA Sequence SEQ ID NO: |
|---|---|---|---|---|
| TLR9 | UniProtKB: B6CH46 | 9802 | 9803 | 9804, 9805, 9806, 9807, 9808 |
| TLR9 | UniProtKB: D1CS61 | 9809 | 9810 | 9811, 9812, 9813, 9814, 9815 |
| TLR9 | UniProtKB: D1CS62 | 9816 | 9817 | 9818, 9819, 9820, 9821, 9822 |
| TLR9 | UniProtKB: L0R5D6 | 9823 | 9824 | 9825, 9826, 9827, 9828, 9829 |
| TLR9 | UniProtKB: L8E8B9 | 9830 | 9831 | 9832, 9833, 9834, 9835, 9836 |
| TLR9 | UniProtKB: Q9NR96 | 9837 | 9838 | 9839, 9840, 9841, 9842, 9843 |
| TRAF6 | UniProtKB: Q9Y4K3 | 9844 | 9845 | 9846, 9847, 9848, 9849, 9850 |
| c-myc | UniProtKB: A0A0B4J1R1 | 9851 | 9852 | 9853, 9854, 9855, 9856, 9857, 9858 |
| c-myc | UniProtKB: P01106 | 9859 | 9860 | 9861, 9862, 9863, 9864, 9865, 9866 |
| c-myc | UniProtKB: Q14901 | 9867 | 9868 | 9869, 9870, 9871, 9872, 9873, 9874 |
| c-myc | UniProtKB: Q16591 | 9875 | 9876 | 9877, 9878, 9879, 9880, 9881, 9882 |

According to the present invention, in a more preferred embodiment, the inventive composition comprises at least one RNA, preferably an mRNA comprising at least one coding region encoding at least one innate immune activator or a fragment or variant thereof, wherein the at least one coding region comprises an RNA sequence being identical or at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99% identical to the RNA sequences according to the SEQ ID Nos as disclosed in Table 11.

13. Antibodies, Decoy Receptors and Dominant Negative Receptors:

According to a preferred embodiment the at least one RNA of the inventive RNA containing composition encodes at least one antibody and/or at least one dominant negative receptor and/or at least one decoy receptor or a fragment or variant thereof, modulating (e.g. inhibiting) the functionality of a protein or signaling pathway which is associated with tumor or cancer development. It is particularly preferred that the RNA containing composition comprises at least one RNA encoding the heavy chain of a particular antibody or fragments or variants thereof and at least one further RNA encoding the light chain of the same particular antibody or fragments or variants thereof.

In this context particularly preferred are the antibodies according to Table 12.

TABLE 12

Antibodies directed against proteins accociated with tumor or cancer development

| Name | Target |
|---|---|
| 3F8 | GD2 |
| Abagovomab | CA-125 imitation |
| Abciximab | Platelet glycoprotein GPIIb/IIIa |
| Adecatumumab | EpCAM (CD326) |
| Afutuzumab | CD20 |

TABLE 12-continued

Antibodies directed against proteins accociated with tumor or cancer development

| Name | Target |
|---|---|
| Alacizumab pegol | VEGFR2 |
| Alemtuzumab | CD52 |
| Altumomab pentetate | CEA |
| Amatuximab | mesothelin |
| Anatumomab mafenatox | 5T4 |
| Anetumab ravtansine | mesothelin |
| Apolizumab | HLA-DR beta |
| apomab | TRAIL-R2 (CD262) |
| Arcitumomab | CEA |
| Ascrinvacumab | ACVRL1 |
| Bavituximab | phosphatidylserine |
| Bectumomab | CD22 |
| Belimumab | BAFF |
| Besilesomab | CEA |
| Bevacizumab | VEGF-A |
| Bivatuzumab mertansine | CD44v6 |
| Blinatumomab | CD19 x CD3 |
| Brentuximab vedotin | CD30 (TNFRSF8) |
| Brontictuzumab | NOTCH1 |
| canakinumab | IL-1β |
| Cantuzumab mertansine | CanAg |
| Cantuzumab ravtansine | MUC1 (CD227) |
| Capromab pendetide | PSMA |
| Carlumab | MCP-1 |
| Catumaxomab | EpCAM x CD3 |
| cBR-doxorubicin immunoconjugate | CD174 (Lewis Y) |
| Cetuximab | EGFR (HER1/ERBB1) |
| Citatuzumab bogatox | EpCAM |
| Cixutumumab | IGF-1R |
| Clivatuzumab tetraxetan | MUC1 (CD227) |
| Codrituzumab | glypican 3 |
| Coltuximab ravtansine | CD19 |
| Conatumumab | TRAIL-R2 (CD262) |
| Dacetuzumab | CD40 |
| Dalotuzumab | IGF-1R |
| Dalotuzumab | insulin-like growth factor I receptor |
| Daratumumab | CD38 (cyclic ADP ribose hydrolase) |
| Demcizumab | DLL4 |
| Denintuzumab mafodotin | CD19 |

TABLE 12-continued

Antibodies directed against proteins accociated with tumor or cancer development

| Name | Target |
|---|---|
| Denosumab | RANKL |
| Depatuxizumab | EGFR (HER1/ERBB1) |
| Derlotuximab | histone complex |
| Detumomab | unknown (B-lymphoma cells) |
| Dinutuximab | B4GALNT1 |
| Drozitumab | TRAIL-R2 (CD262) |
| Duligotumab | HER3 (ERBB3) |
| Duligotuzumab | EGFR (HER1/ERBB1) |
| Dusigitumab | ILGF2 |
| Ecromeximab | GD3 ganglioside |
| Edrecolomab | EpCAM |
| Elgemtumab | ERBB3 |
| Elotuzumab | SLAMF7 (CD319) |
| Elsilimomab | IL-6 |
| Emactuzumab | CSF1R |
| Emibetuzumab | HGFR |
| Emibetuzumab | MET |
| Enavatuzumab | TNFRSF12A |
| Enfortumab vedotin | AGS-22M6 |
| Enoticumab | DLL4 |
| Ensituximab | MUC5AC |
| Epitumomab cituxetan | MUC1 (CD227) |
| Epratuzumab | CD22 |
| Ertumaxomab | HER2 (ERBB2/neu) × CD3 |
| Etaracizumab | integrin α5β3 |
| Faralimomab | IFNA1 |
| Farletuzumab | FOLR1 alpha |
| FBTA | CD20 × CD3 |
| Ficlatuzumab | HGFR |
| Figitumumab | IGF-1R |
| Flanvotumab | TYRP1(glycoprotein 75) |
| Fresolimumab | TGF-β |
| Futuximab | EGFR (HER1/ERBB1) |
| Galiximab | CD80 |
| Gantiumab | IGF-1R |
| Gemtuzumab ozogamicin | CD33 |
| Girentuximab | Carbonic anhydrase 9 (CA9/CAIX) |
| Glembatumumab vedotin | GPNMB |
| glycooptimized trastuzumab-GEX | HER2 (ERBB2/neu) |
| Ibritumomab tiuxetan | CD20 |
| Icrucumab | VEGFR-1 |
| Igovomab | MUC16 |
| IMAB362 | Claudin-18 (CLDN18.2) |
| Imgatuzumab | EGFR (HER1/ERBB1) |
| Indatuximab ravtansine | SDC1 |
| Indusatumab vedotin | GUCY2C |
| inebilizumab | CD19 |
| Inotuzumab ozogamicin | CD22 |
| Intetumumab | CD51 |
| Iratumumab | CD30 (TNFRSF8) |
| Isatuximab | CD38 |
| Labetuzumab | CEA |
| Lenzilumab | CSF2 |
| Lexatumumab | TRAIL-R2 (CD262) |
| Lifastuzumab vedotin | NaPi2B |
| Lilotomab satetraxetan | CD37 |
| Lintuzumab | CD33 |
| Lorvotuzumab mertansine | CD56 |
| Lucatumumab | CD40 |
| Lumiliximab | CD23 (IgE receptor) |
| Lumretuzumab | ERBB3 |
| Mapatumumab | TRAIL-R1 (CD261) |
| Margetuximab | HER2 (ERBB2/neu) |
| Matuzumab | EGFR (HER1/ERBB1) |
| Mepolizumab | IL-5 |
| Milatuzumab | CD74 |
| Minretumomab | TAG-72 |
| Mirvetuximab soravtansine | FOLR1 alpha |
| Mitumomab | GD3 (ganglioside) |
| Mogamulizumab | CCR4 |
| Moxetumomab pasudotox | CD22 |
| Nacolomab tafenatox | C242 antigen |
| Naptumomab estafenatox | 5T4 |
| Narnatumab | RON |
| Necitumumab | EGFR (HER1/ERBB1) |

TABLE 12-continued

Antibodies directed against proteins accociated with tumor or cancer development

| Name | Target |
|---|---|
| Nesvacumab | ANGPT2 (angiopoietin 2) |
| Nimotuzumab | EGFR (HER1/ERBB1) |
| Nofetumomab merpentan | EpCAM |
| binutuzumab | CD20 |
| Ocaratuzumab | CD20 |
| Ofatumumab | CD20 |
| Olaratumab | PDGFRα |
| Onartuzumab | MET |
| Ontuxizumab | CD248 (TEM1) |
| Oportuzumab monatox | EpCAM |
| Oregovomab | CA-125 |
| Otlertuzumab | CD37 |
| Panitumumab | EGFR (HER1/ERBB1) |
| Pankomab | MUC1 (tumor specific glycosylation) |
| Parsatuzumab | EGFL7 |
| Pasotuxizumab | FOLH1 |
| Patritumab | HER3 (ERBB3) |
| Pemtumomab | MUC1 (CD227) |
| Pertuzumab | HER2 (ERBB2/neu) |
| Pinatuzumab vedotin | CD22 |
| Pintumomab | adenocarcinoma antigen |
| Polatuzumab vedotin | CD79B |
| Racotumomab | NGcGM3 |
| Radretumab | EDB (fibronectin extra domain-B) |
| Ramucirumab | VEGFR2 |
| Rilotumumab | HGFR |
| Rituximab | CD20 |
| Robatumumab | IGF-1R |
| Sacituzumab govitecan | Trop-2 (tumor-associated calcium signal transducer 2/EGP-1) |
| Samalizumab | CD200 (OX-2 membrane glycoprotein) |
| Satumomab pendetide | TAG-72 |
| Seribantumab | ERBB3 |
| Seribantumab | HER3 (ERBB3) |
| SGN-CDA | CD19 |
| SGN-CDA | CD33 |
| Sibrotuzumab | FAP |
| Siltuximab | IL-6 |
| Simtuzumab | LOXL2 |
| Sofituzumab vedotin | CA 125 |
| Solitomab | EpCAM |
| Sonepcizumab | S1P (sphingosine-1-phosphate) |
| Tacatuzumab tetraxetan | AFP (alpha-fetoprotein) |
| Taplitumomab paptox | CD19 |
| Tarextumab | Notch receptor |
| Tenatumomab | TN-C (tenascin C) |
| Teprotumumab | CD221 |
| Tetulomab | CD37 |
| TGN | CD28 |
| Tigatuzumab | TRAIL-R2 (CD262) |
| Lebrikizumab | IL-13 |
| Tocilizumab | IL-6R |
| Tositumomab | CD20 |
| Tovetumab | CD140a |
| Tovetumab | PDGFRα |
| Trastuzumab | HER2 (ERBB2/neu) |
| Trastuzumab emtansine | HER2 (ERBB2/neu) |
| TRBS | GD2 |
| Tucotuzumab celmoleukin | EpCAM |
| ublituximab | CD20 |
| Ublituximab | MS4A1 |
| Ulocuplumab | CXCR4 |
| Vandortuzumab vedotin | STEAP1 |
| Vantictumab | FZD7 |
| Vanucizumab | Ang-2 (angiopoietin 2) × VEGF-A |
| Veltuzumab | CD20 |
| Vesencumab | NRP1 |
| Volociximab | integrin α5β1 |
| Votumumab | CTAA16.88 |
| Zalutumumab | EGFR (HER1/ERBB1) |
| Zanolimumab | CD4 |
| Zatuximab | HER1 (EGFR/ERBB1) |

Preferably, the neutralizing antibody is chosen from the list of anti-IL-10 and anti-TGFbeta.

Furthermore, the at least one antibody may preferably chosen from anti-CD73 antibodies or fragments or variants thereof.

In a further particularly preferred embodiment the at least one antibody is chosen from an antibody directed against CCR5/CD195 or from an antibody directed against its ligand CCL5/RANTES.

In a particularly preferred embodiment the decoy receptor is a soluble CCR5 (chemokine receptor type 5, also known as CD195).

In a further particularly preferred embodiment the dominant negative receptor is dominant negative CCR5 (chemokine receptor type 5, also known as CD195).

Furthermore, the at least one antibody may preferably chosen from anti-CD73 antibodies or fragments or variants thereof.

14. Inhibitors of Myeloid Derived Suppressor Cells (MDSCs):

Myeloid Derived Suppressor Cells (MDSC) are a heterogeneous population of immature myeloid cells that are increased in cancer and related disorders. MDSC are induced by tumor secreted growth factors. MDSC play an important part in suppression of host immune responses through several mechanisms. In addition, MDSC may also contribute to angiogenesis and tumor invasion. Therefore, MDSC inhibition is a strategy for the treatment of cancer and related disorders.

In the context of the invention, MDSC inhibition can be achieved by direct deactivation of MDSCs (e.g., anti IL-17 antibodies), by blocking differentiation of MDSCs into mature cells (e.g., IL-12), by blocking the cell development of MDSCs or by depletion of MDSCs (e.g., cytotoxic agents).

Therefore it is particularly preferred to use anti IL-17 antibodies and IL-12 as inhibitors of MDSCs.

15. IDO Pathway Inhibitors

In a further preferred embodiment of the inventive RNA containing composition the RNA, preferably mRNA codes for at least one IDO pathway inhibitor. Preferably the RNA encoding the at least one IDO pathway inhibitor encodes an inhibitory protein or dominant negative mutant protein of the IDO pathway.

As reviewed in Prendergast et al. (Prendergast G C, Smith C, Thomas S, Mandik-Nayak L, Laury-Kleintop L, Metz R, Muller A J. Indoleamine 2,3-dioxygenase pathways of pathogenic inflammation and immune escape in cancer. Cancer Immunol. Immunother. 2014 July; 63(7):721-35) indoleamine-pyrrole 2,3-dioxygenase (IDO or INDO EC 1.13.11.52) is an enzyme that in humans is encoded by the IDO1 gene. This enzyme catalyzes the degradation of the essential amino acid L-tryptophan to N-formylkynurenine. IDO is the first and rate-limiting enzyme of tryptophan catabolism through kynurenine pathway, thus causing depletion of tryptophan which can cause halted growth of microbes as well as T cells. IDO is an immunomodulatory enzyme produced by some alternatively activated macrophages and other immunoregulatory cells (also used as an immune subversion strategy by many tumors). The clinical development of IDO inhibitors may produce a novel class of immunomodulators with broad application in the treatment of advanced human cancer.

16. Proteins or Peptides that Bind Inhibitors of Apoptosis

Apoptosis is a tightly regulated cellular process and faulty regulation of apoptosis is a hallmark of human cancers. Targeting key apoptosis regulators with the goal to restore apoptosis in tumor cells has been pursued as a new cancer therapeutic strategy. XIAP, cIAP1, and cIAP2, members of inhibitor of apoptosis (IAP) proteins, are critical regulators of cell death and survival and are attractive targets for new cancer therapy. The SMAC/DIABLO protein is an endogenous antagonist of XIAP, cIAP1, and cIAP2. In the last decade, intense research efforts have resulted in the design and development of several small-molecule SMAC mimetics now in clinical trials for cancer treatment In a further preferred embodiment, the inventive composition comprises at least one RNA comprising at least one coding region that codes for at least one peptide or protein that binds inhibitors of apoptosis proteins (IAPB) and thus sensitize cancer cells to apoptotic death.

Therefore it is particularly preferred that the at least one RNA of the inventive RNA containing composition encodes at least one protein or peptide that bind inhibitors of apoptosis, such as SMAC mimetics.

Particularly preferred proteins or peptides that bind IAPB according to the present invention comprise Omi/HtrA2, Smac, Smac derived peptides, Smac/DIABLO, and XAF1 (XIAP-associated factor 1) and fragments or variants thereof.

RNA Modifications

According to one embodiment, the at least one RNA of the composition, encoding at least one of the proteins and/or peptides defined herein, may be in the form of a modified RNA, wherein any modification, as defined herein, may be introduced into the at least one RNA of the composition. Modifications as defined herein preferably lead to a stabilization of the at least one RNA of the composition of the present invention.

According to one embodiment, the at least one RNA of the composition of the present invention may thus be provided as a "stabilized RNA", that is to say as an RNA that is essentially resistant to in vivo degradation (e.g. by an exo- or endo-nuclease). Such stabilization can be effected, for example, by a modified phosphate backbone of the at least one RNA of the composition of the present invention. A backbone modification in connection with the present invention is a modification in which phosphates of the backbone of the nucleotides contained in the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the at least one RNA as defined herein.

Chemical Modifications:

The term "RNA modification" as used herein may refer to chemical modifications comprising backbone modifications as well as sugar modifications or base modifications.

In this context, a modified RNA as defined herein may contain nucleotide analogues/modifications, e.g. backbone modifications, sugar modifications or base modifications. A backbone modification in connection with the present invention is a modification, in which phosphates of the backbone of the nucleotides contained in an RNA as defined herein are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues, which are applicable for transcription and/or translation.

Sugar Modifications:

The modified nucleosides and nucleotides, which may be incorporated into a modified RNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O($CH_2CH_2O$)n$CH_2CH_2OR$; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. $NH_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified RNA can include nucleotides containing, for instance, arabinose as the sugar.

Backbone Modifications:

The phosphate backbone may further be modified in the modified nucleosides and nucleotides, which may be incorporated into a modified RNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters.

Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified RNA as described herein can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, 06-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-I-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methylcytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methylcytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methylcytidine, 4-methoxy-pseudoisocytidine, and 4-methoxy-1-methyl-pseudoisocytidine.

In other embodiments, modified nucleosides include 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8- aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, I-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group.

In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified RNA may comprise nucleoside modifications selected from 6-aza-cytidine, 2-thio-cytidine, α-thio-cytidine, Pseudo-iso-cytidine, 5-aminoallyl-uridine, 5-iodouridine, N1-methyl-pseudouridine, 5,6-dihydrouridine, α-thio-uridine, 4-thio-uridine, 6-aza-uridine, 5-hydroxyuridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Lipid Modification:

According to a further embodiment, a modified RNA as defined herein can contain a lipid modification. Such a lipid-modified RNA typically comprises an RNA as defined herein. Such a lipid-modified RNA as defined herein typically further comprises at least one linker covalently linked with that RNA, and at least one lipid covalently linked with the respective linker. Alternatively, the lipid-modified RNA comprises at least one RNA as defined herein and at least one (bifunctional) lipid covalently linked (without a linker) with that RNA. According to a third alternative, the lipid-modified RNA comprises an RNA molecule as defined herein, at least one linker covalently linked with that RNA, and at least one lipid covalently linked with the respective linker, and also at least one (bifunctional) lipid covalently linked (without a linker) with that RNA. In this context, it is particularly preferred that the lipid modification is present at the terminal ends of a linear RNA sequence.

G/C Content Optimization:

According to an especially preferred embodiment of the invention, the RNA of the inventive composition is modified. Preferably the RNA is stabilized by modifying and preferably increasing the G (guanosine)/C (cytosine) content of the RNA of the coding region thereof. Therein, the G/C content of the RNA of the coding region is increased compared to the G/C content of the coding region of its particular wild type coding sequence, i.e. the unmodified RNA. However, the encoded amino acid sequence of the RNA is preferably not modified compared to the encoded amino acid sequence of the particular wild type/unmodified RNA.

The modification of the G/C-content of the RNA of the inventive composition is based on the fact that RNA sequences having an increased G (guanosine)/C (cytosine) content are more stable than RNA sequences having an increased A (adenosine)/U (uracil) content. The codons of a coding sequence or a whole RNA might therefore be varied compared to the wild type coding sequence or RNA, such that they include an increased amount of G/C nucleotides while the translated amino acid sequence is retained. In respect to the fact that several codons code for one and the same amino acid (so-called degeneration of the genetic code), the most favourable codons for the stability can be determined (so-called alternative codon usage). Depending on the amino acid to be encoded by the at least one RNA, there are various possibilities for modification of the RNA sequence, compared to its wild-type sequence. In the case of amino acids which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the at least one mRNA of the composition of the present invention compared to its particular wild-type mRNA (i.e. the original sequence). Thus, for example, all codons for Thr occurring in the wild-type sequence can be modified to ACC (or ACG). Preferably, however, for example, combinations of the above substitution possibilities are used:

substitution of all codons coding for Thr in the original sequence (wild-type mRNA) to ACC (or ACG) and substitution of all codons originally coding for Ser to UCC (or UCG or AGC); substitution of all codons coding for Ile in the original sequence to AUC and substitution of all codons originally coding for Lys to AAG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to AAC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding region of the at least one RNA according to the invention is increased by at least 7%, more preferably by at least 15%, particularly preferably by at least 20%, compared to the G/C content of the coding region of the wild type RNA. According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for a protein or peptide as defined herein or its fragment or variant thereof or the whole sequence of the wild type RNA sequence or coding sequence are substituted, thereby increasing the G/C content of said sequence. In this context, it is particularly preferable to increase the G/C content of the at least one RNA of the inventive composition to the maximum (i.e. 100% of the substitutable codons), in particular in the coding region, compared to the wild type sequence.

According to the invention, a further preferred modification of the coding sequence of the at least one RNA of the composition is based on the finding that the translation efficiency is also determined by a different frequency in the occurrence of tRNAs in cells. Thus, if so-called "rare codons" are present in the at least one coding region of the at least one RNA of the composition of the present invention to an increased extent, the corresponding modified at least one RNA sequence is translated to a significantly poorer degree than in the case where codons coding for relatively "frequent" tRNAs are present. According to the invention, in the modified at least one RNA of the composition of the present invention, the region which codes for one of the above defined peptides or proteins is modified compared to the corresponding region of the wild-type RNA such that at least one codon of the wild-type sequence, which codes for a tRNA which is relatively rare in the cell, is exchanged for a codon, which codes for a tRNA which is relatively frequent in the cell and carries the same amino acid as the relatively rare tRNA. By this modification, the sequence of the at least one coding region of the at least one RNA of the composition of the present invention is modified such that codons for which frequently occurring tRNAs are available are inserted. In other words, according to the invention, by this modification all codons of the wild-type sequence which code for a tRNA which is relatively rare in the cell can in each case be exchanged for a codon which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons which use for the particular amino acid the tRNA which occurs the most frequently, e.g. the Gly codon, which uses the tRNA, which occurs the most frequently in the (human) cell, are particularly preferred. According to the invention, it is particularly preferable to link the sequential G/C content which is increased, in particular maximized, in the modified at least one RNA of the composition of the present invention, with the "frequent" codons without modifying the amino acid sequence of the protein encoded by the coding region of the RNA. This preferred embodiment allows provision of a particularly efficiently translated and stabilized (modified) at least one RNA of the composition of the present invention. The determination of a modified at least one RNA of the composition of the present invention as described above (increased G/C content; exchange of tRNAs) can be carried out using the computer program explained in WO 02/098443—the disclosure content of which is included in its full scope in the present invention. Using this computer program, the nucleotide sequence of any desired coding RNA can be modified with the aid of the genetic code or the degenerative nature thereof such that a maximum G/C content results, in combination with the use of codons which code for tRNAs occurring as frequently as possible in the cell, the amino acid sequence coded by the modified at least one RNA preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the at least one RNA of the composition of the present invention is increased compared to the A/U content in the environment of the ribosome binding site of its particular wild-type RNA. This modification (an increased A/U content around the ribosome binding site) increases the efficiency of ribosome binding to the at least one RNA. An effective binding of the ribosomes to the ribosome binding site (Kozak sequence: GCCGCCACCAUGG (SEQ ID NO: 10.071), the AUG forms the start codon) in turn has the effect of an efficient translation of the at least one RNA. According to a further embodiment of the present invention the at least one RNA of the composition of the present invention may be modified with respect to potentially destabilizing sequence elements. Particularly, the coding region and/or the 5' and/or 3' untranslated region of this RNA may be modified compared to the particular wild-type RNA such that it contains no destabilizing sequence elements, the coded amino acid sequence of the modified at least one RNA preferably not being modified compared to its particular wild-type RNA. It is known that, for example, in sequences of eukaryotic RNAs destabilizing sequence elements (DSE) occur, to which signal proteins bind and regulate enzymatic degradation of RNA in vivo. For further stabilization of the modified at least one RNA, optionally in the region which encodes for a protein or peptide as defined herein, one or more such modifications compared to the corresponding region of the wild-type RNA can therefore be carried out, so that no or substantially no destabilizing sequence elements are contained there. According to the invention, DSE present in the untranslated regions (3'- and/or 5'-UTR) can also be eliminated from the at least one RNA of the composition of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The at least one RNA of the composition of the present invention is therefore preferably modified compared to the wild-type RNA such that the at least one RNA contains no such destabilizing sequences. This also applies to those sequence motifs which are recognized by possible endonucleases, e.g. the sequence GAACAAG, which is contained in the 3'-UTR segment of the gene which codes for the transferrin receptor (Binder et al., EMBO J. 1994, 13: 1969 to 1980). These sequence motifs are also preferably removed in the at least one RNA of the composition of the present invention.

Adaptation to Human Codon Usage:

According to the invention, a further preferred modification of the at least one RNA of the composition of the present invention is based on the finding that codons coding for the same amino acid occur in different frequencies. According to the invention, in the modified at least one RNA of the composition of the present invention, the region which codes for one of the above defined peptides or proteins (coding sequence) is preferably modified compared to the corresponding region of the wild-type RNA such that the frequency of the codons coding for the same amino acid corresponds to the naturally occurring frequency of that codon present in the human coding usage as e.g. shown in Table 13.

This means, for example, that for the amino acid Alanine (Ala) present in the amino acid sequence of the encoded protein according to the invention, the wild type coding sequence is adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 13).

TABLE 13

Human codon usage table (most frequent codon marked with an asterisk)

| Amino acid | codon | fraction | /1000 |
|---|---|---|---|
| Ala | GCG | 0.10 | 7.4 |
| Ala | GCA | 0.22 | 15.8 |
| Ala | GCT | 0.28 | 18.5 |
| Ala | GCC* | 0.40 | 27.7 |
| Cys | TGT | 0.42 | 10.6 |
| Cys | TGC* | 0.58 | 12.6 |
| Asp | GAT | 0.44 | 21.8 |
| Asp | GAC* | 0.56 | 25.1 |
| Glu | GAG* | 0.59 | 39.6 |
| Glu | GAA | 0.41 | 29.0 |
| Phe | TTT | 0.43 | 17.6 |
| Phe | TTC* | 0.57 | 20.3 |
| Gly | GGG | 0.23 | 16.5 |
| Gly | GGA | 0.26 | 16.5 |
| Gly | GGT | 0.18 | 10.8 |
| Gly | GGC* | 0.33 | 22.2 |
| His | CAT | 0.41 | 10.9 |
| His | CAC* | 0.59 | 15.1 |
| Ile | ATA | 0.14 | 7.5 |
| Ile | ATT | 0.35 | 16.0 |
| Ile | ATC* | 0.52 | 20.8 |
| Lys | AAG* | 0.60 | 31.9 |
| Lys | AAA | 0.40 | 24.4 |
| Leu | TTG | 0.12 | 12.9 |
| Leu | TTA | 0.06 | 7.7 |
| Leu | CTG* | 0.43 | 39.6 |
| Leu | CTA | 0.07 | 7.2 |
| Leu | CTT | 0.12 | 13.2 |
| Leu | CTC | 0.20 | 19.6 |
| Met | ATG* | 1 | 22.0 |
| Asn | AAT | 0.44 | 17.0 |
| Asn | AAC* | 0.56 | 19.1 |
| Pro | CCG | 0.11 | 6.9 |
| Pro | CCA | 0.27 | 16.9 |
| Pro | CCT | 0.29 | 17.5 |
| Pro | CCC* | 0.33 | 19.8 |
| Gln | CAG* | 0.73 | 34.2 |
| Gln | CAA | 0.27 | 12.3 |
| Arg | AGG | 0.22 | 12.0 |
| Arg | AGA* | 0.21 | 12.1 |
| Arg | CGG | 0.19 | 11.4 |
| Arg | CGA | 0.10 | 6.2 |
| Arg | CGT | 0.09 | 4.5 |

TABLE 13-continued

Human codon usage table (most frequent codon marked with an asterisk)

| Amino acid | codon | fraction | /1000 |
|---|---|---|---|
| Arg | CGC | 0.19 | 10.4 |
| Ser | AGT | 0.14 | 12.1 |
| Ser | AGC* | 0.25 | 19.5 |
| Ser | TCG | 0.06 | 4.4 |
| Ser | TCA | 0.15 | 12.2 |
| Ser | TCT | 0.18 | 15.2 |
| Ser | TCC | 0.23 | 17.7 |
| Thr | ACG | 0.12 | 6.1 |
| Thr | ACA | 0.27 | 15.1 |
| Thr | ACT | 0.23 | 13.1 |
| Thr | ACC* | 0.38 | 18.9 |
| Val | GTG* | 0.48 | 28.1 |
| Val | GTA | 0.10 | 7.1 |
| Val | GTT | 0.17 | 11.0 |
| Val | GTC | 0.25 | 14.5 |
| Trp | TGG* | 1 | 13.2 |
| Tyr | TAT | 0.42 | 12.2 |
| Tyr | TAC* | 0.58 | 15.3 |
| Stop | TGA* | 0.61 | 1.6 |
| Stop | TAG | 0.17 | 0.8 |
| Stop | TAA | 0.22 | 1.0 |

Codon-Optimization:

According to a particularly preferred embodiment it is preferred, that all codons of the wild-type sequence of the coding region of the at least one RNA of the inventive composition which code for a tRNA which is relatively rare in the cell is in each case exchanged for a codon which codes for a tRNA which is relatively frequent in the cell and which, in each case, carries the same amino acid as the relatively rare tRNA. Therefore it is particularly preferred that the most frequent codons are used for each encoded amino acid (see Table 13, most frequent codons are marked with asterisks).

This means, for example, that for the amino acid Alanine (Ala) present in the amino acid sequence of the encoded peptide or protein according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

C-Enrichment:

According to another embodiment, the at least one RNA of the composition of the present invention may be modified by increasing the C content of the RNA, preferably of the coding region of the at least one RNA.

In a particularly preferred embodiment of the present invention, the C content of the coding region of the at least one RNA of the composition of the present invention is modified, particularly increased, compared to the C content of the coding region of its particular wild-type RNA, i.e. the unmodified mRNA. The amino acid sequence encoded by the at least one RNA is preferably not modified as compared to the amino acid sequence encoded by the particular wild-type RNA In a preferred embodiment of the present invention, the modified RNA is modified such that at least 10%, 20%, 30%, 40%, 50%, 60%, 70% or 80%, or at least 90% of the theoretically maximal cytosine-content or even a maximal cytosine-content is achieved.

In further preferred embodiments, at least 10%, 20%, 30%, 40%, 50%, 60%, 70%, 80%, 90% or even 100% of the codons of the target RNA wild type sequence, which are "cytosine content optimizable" are replaced by codons with a higher cytosine-content as present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target RNA is modified such that at least 80%, or at least 90% of the theoretically maximal cytosine-content or even a maximal cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than 1 codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized equally frequent under in vivo conditions. Depending on each single organism, a typical codon usage profile is established.

The term "cytosine content-optimizable codon" as used within the context of the present invention refers to codons, which exhibit a lower amount of cytosines than other codons coding for the same amino acid. Accordingly, any wild type codon, which may be replaced by another codon coding for the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C-content and reflects a C-enriched modified RNA sequence. A C-maximized RNA sequence contains C-optimized codons for all potentially C-optimizable codons. Accordingly, 100% or all of the theoretically replaceable C-optimizable codons are under such conditions actually replaced by C-optimized codons over the entire length of the coding region.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or the codon UGU that codes for Cys may be exchanged by the codon UGC encoding the same amino acid, and/or the codon GAU which codes for Asp may be exchanged by the codon GAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Ile may be exchanged by the codon AUC, and/or any of the codons UUG, UUA, CUG, CUA, CUU coding for Leu may be exchanged by the codon CUC encoding the same amino acid, and/or the codon AAU that codes for Asn may be exchanged by the codon AAC encoding the same amino acid, and/or any of the codons CCG, CCA, CCU coding for Pro may be exchanged by the codon CCC encoding the same amino acid, and/or any of the codons AGG, AGA, CGG, CGA, CGU coding for Arg may be exchanged by the codon CGC encoding the same amino acid, and/or any of the codons AGU, AGC, UCG, UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon GUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding region results in a C-maximized coding sequence. In the context of the invention at least 70% of the non C-optimized codons are replaced by C-optimized codons of the wild type sequence are replaced by C-optimized codons, preferably at least 80%, more preferably at least 90% within the coding region. It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in the C-optimized RNAs of the invention, at least 50% of the C-optimizable wild type codons for any given amino acid are replaced by C-optimized codons, e.g. any modified C-enriched RNA preferably contains at least 50% C-optimized codons at C-optimizable wild type codon positions coding for any single of the above mentioned amino acids Ala, Cys, Asp, Phe, Gly, His, Ile, Leu, Asn, Pro, Arg, Ser, Thr, Val and Tyr, preferably at least 60%.

In this context codons coding for amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, whereby both code for the same amino acid. Accordingly, the relatively rare codon GAA coding for Glu may be exchanged by the relative frequent codon GAG coding for the same amino acid, and/or the relatively rare codon AAA coding for Lys may be exchanged by the relative frequent codon AAG coding for the same amino acid, and/or the relatively rare codon CAA coding for Gln is exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The substitutions listed above may obviously be used individually but also in all possible combinations in order to optimize the cytosine-content of the modified RNA compared to the wild type RNA sequence.

Accordingly, the region of the modified RNA coding for the peptide or protein may be changed compared to the coding region of the wild type RNA in such a way that an amino acid encoded by at least two or more codons, of which one comprises one additional cytosine, such a codon may be exchanged by the C-optimized codon comprising one additional cytosine, whereby the amino acid is unaltered compared to the wild type sequence.

Substitutions, additions or eliminations of bases are preferably carried out using a DNA matrix for preparation of the nucleic acid molecule by techniques of the well known site directed mutagenesis or with an oligonucleotide ligation. In such a process, for preparation of the at least one RNA as defined herein a corresponding DNA molecule may be transcribed in vitro. This DNA matrix preferably comprises a suitable promoter, e.g. a T7 or SP6 promoter, for in vitro transcription, which is followed by the desired nucleotide sequence for the at least one RNA to be prepared and a termination signal for in vitro transcription. The DNA molecule, which forms the matrix of the at least one RNA of interest, may be prepared by fermentative proliferation and subsequent isolation as part of a plasmid which can be replicated in bacteria. Plasmids which may be mentioned as suitable for the present invention are e.g. the plasmids pT7Ts (GenBank accession number U26404; Lai et al., Development 1995, 121: 2349 to 2360), pGEM® series, e.g. pGEM®-1 (GenBank accession number X65300; from Promega) and pSP64 (GenBank accession number X65327); cf. also Mezei and Storts, Purification of PCR Products, in: Griffin and Griffin (ed.), PCR Technology: Current Innovation, CRC Press, Boca Raton, Fla., 2001.

Fragments and Variants

In the context of the invention additionally to the here disclosed peptides and proteins, which show a certain degree of identity of sequence, are incorporated. Therefore fragments and variants of the proteins and peptides as defined herein are disclosed herewith in the context of the present invention.

Furthermore fragments and variants of nucleic acids as defined herein are therefore disclosed herewith in the context of the present invention.

Mono-Bi-Multicistronic, Self Cleaving Peptides Etc:

The coding region of the at least one RNA of the inventive composition may occur as a mono-, di-, or even multicistronic RNA, i.e. an RNA sequence which carries the coding sequences of one, two or more proteins or peptides. Such coding sequences of the di-, or even multicistronic RNAs may be separated by at least one internal ribosome entry site (IRES) sequence. Thus, the at least one RNA according to the invention may further comprise one or more internal ribosome entry site (IRES) sequences or IRES-motifs, which may separate several open reading frames, especially if the RNA encodes for two or more peptides or proteins (bi- or multicistronic RNA). For example, the internal ribosome entry site sequence may be derived from EMCV (encephalomyocarditis virus) or from FMDV (Foot and mouth disease virus). Furthermore self-cleaving signal peptides may be used which induce the cleavage of the resulting polypeptide which comprises several proteins or peptides, e.g. a self-cleaving signal peptide sequence derived from F2A peptide from FMDV.

Combinations of Different Coding Sequences

In a preferred embodiment, the inventive composition comprises at least one, two, three, four, five, six, seven, eight, nine, ten or more RNAs, each comprising at least one, two, three, four, five, six, seven, eight, nine, ten or more coding regions encoding at least one or more cytokine as defined above and/or at least one or more chemokine as defined above, and/or at least one or more suicide gene product as defined above, and/or at least one or more immunogenic peptide or protein as defined above, and/or at least one or more apoptosis inducer as defined above, and/or at least one or more angiogenesis inhibitor as defined above, and/or at least one or more heat shock protein as defined above, and/or at least one or more tumor antigen as defined above, and/or at least one or more β-catenin inhibitor as defined above, and/or at least one or more STING pathway activator as defined above, and/or at least one or more checkpoint modulator as defined above, and/or at least one or more innate immune activator, and/or at least one or more antibody as defined above, and/or at least one dominant negative receptor and/or at least one or more decoy receptor, and/or at least one or more inhibitor of myeloid derived suppressor cells (MDSCs), and/or at least one or more IDO pathway inhibitor, and/or at least one or more protein or peptide that bind apoptosis inhibitors as defined above, or variants or fragments thereof.

Untranslated Regions (UTRs)

By a further embodiment the at least one RNA of the inventive composition preferably comprises at least one of the following structural elements: a 5'- and/or 3'-untranslated region element (UTR element), particularly a 5'-UTR element which comprises or consists of a nucleic acid sequence which is derived from the 5'-UTR of a TOP gene or from a fragment, homolog or a variant thereof, or a 5'- and/or 3'-UTR element which may be derivable from a gene that provides a stable mRNA or from a homolog, fragment or variant thereof; a histone stem-loop structure, preferably a histone stem-loop in its 3' untranslated region; a 5'-CAP structure; a poly-A tail (poly(A) sequence); or a poly(C) sequence.

In a preferred embodiment the at least one RNA comprises at least one 5'- or 3'-UTR element. In this context an UTR element comprises or consists of a nucleic acid sequence which is derived from the 5'- or 3'-UTR of any naturally occurring gene or which is derived from a fragment, a homolog or a variant of the 5'- or 3'-UTR of a gene. Preferably the 5'- or 3'-UTR element used according to the present invention is heterologous to the coding region of the RNA of the inventive composition. Even if 5'- or 3'-UTR elements derived from naturally occurring genes are preferred, also synthetically engineered UTR elements may be used in the context of the present invention.

In a particularly preferred embodiment the at least one RNA comprises at least one 5'-untranslated region element (5'-UTR element) which comprises or consists of a nucleic acid sequence which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'-TOP, as defined above.

In some embodiments, the nucleic acid sequence of the 5'-UTR element which is derived from a 5'-UTR of a TOP gene terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of mRNA of the inventive composition is provided by the coding region.

The nucleic acid sequence which is derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence which is derived from a nucleic acid sequence selected from the group consisting of SEQ ID Nos. 1-1363, SEQ ID NO. 1395, SEQ ID NO. 1421 and SEQ ID NO. 1422 of the patent application WO2013/143700, whose disclosure is incorporated herein by reference, from the homologs of SEQ ID Nos. 1-1363, SEQ ID NO. 1395, SEQ ID NO. 1421 and SEQ ID NO. 1422 of the patent application WO2013/143700, from a variant thereof, or preferably from a corresponding RNA sequence. The term "homologs of SEQ ID Nos. 1-1363, SEQ ID NO. 1395, SEQ ID NO. 1421 and SEQ ID NO. 1422 of the patent application WO2013/143700" refers to sequences of other species than *homo sapiens*, which are homologous to the sequences according to SEQ ID Nos. 1-1363, SEQ ID NO. 1395, SEQ ID NO. 1421 and SEQ ID NO. 1422 of the patent application WO2013/143700.

In a preferred embodiment, the 5'-UTR element comprises or consists of a nucleic acid sequence which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID Nos. 1-1363, SEQ ID NO. 1395, SEQ ID NO. 1421 and SEQ ID NO. 1422 of the patent application WO2013/143700, from the homologs of SEQ ID Nos. 1-1363, SEQ ID NO. 1395, SEQ ID NO. 1421 and SEQ ID NO. 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5'-TOP to the nucleotide position immediately 5' to the start codon (located at the 3' end of the sequences), e.g. the nucleotide position immediately 5' to the ATG sequence, of a nucleic acid sequence selected from SEQ ID Nos. 1-1363, SEQ ID NO. 1395, SEQ ID NO. 1421 and SEQ ID NO. 1422 of the patent application WO2013/143700, from the homologs of SEQ ID Nos. 1-1363, SEQ ID NO. 1395, SEQ ID NO. 1421 and SEQ ID NO. 1422 of the patent application WO2013/143700, from a variant thereof, or a corresponding RNA sequence.

In a particularly preferred embodiment, the 5'-UTR element comprises or consists of a nucleic acid sequence which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'-TOP motif. As described above, the sequence extending from position 5 to the nucleotide immediately 5' to the ATG (which is located at the 3'end of the sequences) corresponds to the 5'-UTR of said sequences.

Preferably, the 5'-UTR element comprises or consists of a nucleic acid sequence which is derived from a 5'-UTR of a TOP gene encoding a ribosomal large protein (RPL) or from a homolog or variant of a 5'-UTR of a TOP gene encoding a ribosomal large protein (RPL). For example, the 5'-UTR element comprises or consists of a nucleic acid sequence which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'-TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'-TOP of said gene.

A preferred sequence for a 5'-UTR element corresponds to SEQ ID No. 1368 of the patent application WO2013/143700.

Accordingly, in a particularly preferred embodiment, the 5'-UTR element comprises or consists of a nucleic acid sequence which has an identity of at least about 20%, preferably of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence as mentioned above (according to SEQ ID NO. 10.051 (5'-UTR of human ribosomal protein Large 32 lacking the 5' terminal oligopyrimidine tract: GGCGCTGCCTACGGAGGTGGCAGCCATCTCCT-TCTCGGCATC; corresponding to SEQ ID No. 1368 of the patent application WO2013/143700)) or preferably to a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO. 10.052 or more preferably to a corresponding RNA sequence, wherein, preferably, the fragment is as described above, i.e. being a continuous stretch of nucleotides representing at least 20% etc. of the full-length 5'-UTR.

Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the mRNA of the inventive composition comprises a 5'-UTR element which comprises or consists of a nucleic acid sequence which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'-TOP of said genes, and wherein optionally the 5'-UTR element starts at its 5'-end with a nucleotide located at position 1, 2, 3, 4, 5, 6, 7, 8, 9 or 10 downstream of the 5' terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit Vlc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit Vlc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'-UTR element does not comprise the 5'-TOP of said gene.

In this context particularly preferred are 5'-UTR elements comprising a nucleic acid sequence according to SEQ ID Nos. 10.051-10.054.

Accordingly, in a particularly preferred embodiment, the 5'-UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 1368, or SEQ ID NOs 1412-1420 of the patent application WO2013/143700, or a corresponding RNA sequence, or wherein the at least one 5'-UTR element comprises or consists of a fragment of a nucleic acid sequence which has an identity of at least about 20%, preferably of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 1368, or SEQ ID NOs 1412-1420 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence which has an identity of at least about 20%, preferably of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 10.053 (5'-UTR of ATP5A1 lacking the 5' terminal oligopyrimidine tract: GCGGCTCGGCCATTTTGTCCCAGTCA-GTCCGGAGGCTGCGGCTGCAGAAGTACCGCCT-GCG-GAGTAACTGCAAAG; corresponding to SEQ ID No. 1414 of the patent application WO2013/143700 (5'-UTR of ATP5A1 lacking the 5' terminal oligopyrimidine tract) or preferably to a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO. 26 (of the patent application WO2013/143700) or more preferably to a corresponding RNA sequence, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In a further preferred embodiment, the at least one RNA of the inventive composition further comprises at least one 3'-UTR element which comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

The term '3'-UTR element' refers to a nucleic acid sequence which comprises or consists of a nucleic acid sequence that is derived from a 3'-UTR or from a variant of a 3'-UTR. A 3'-UTR element in the sense of the present invention may represent the 3'-UTR of an mRNA. Thus, in the sense of the present invention, preferably, a 3'-UTR element may be the 3'-UTR of an mRNA, preferably of an artificial mRNA, or it may be the transcription template for a 3'-UTR of an mRNA. Thus, a 3'-UTR element preferably is a nucleic acid sequence which corresponds to the 3'-UTR of an mRNA, preferably to the 3'-UTR of an artificial mRNA, such as an mRNA obtained by transcription of a genetically engineered vector construct. Preferably, the 3'-UTR element fulfils the function of a 3'-UTR or encodes a sequence which fulfils the function of a 3'-UTR.

Preferably, the inventive mRNA comprises a 3'-UTR element which may be derivable from a gene that relates to an mRNA with an enhanced half-life (that provides a stable mRNA), for example a 3'-UTR element as defined and described below. Preferably, the 3'-UTR element, is a nucleic acid sequence derived from a 3'-UTR of a gene, which preferably encodes a stable mRNA, or from a homolog, a fragment or a variant of said gene In a particularly preferred embodiment, the 3'-UTR element comprises or consists of a nucleic acid sequence which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID No. 1369-1390 of the patent application WO2013/143700 whose disclosure is incorporated herein by reference. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene, most preferably a human albumin gene according to SEQ ID NO. 10063 (according SEQ ID No: 1369 of the patent application WO2013/143700). The mRNA sequence may comprise or consist of a nucleic acid sequence which is derived from the 3'-UTR of the human albumin gene according to GenBank Accession number NM_000477.5, or from a fragment or variant thereof.

In this context it is particularly preferred that the mRNA of the inventive composition comprises a 3'-UTR element comprising a corresponding RNA sequence derived from the nucleic acids according to SEQ ID No. 1369-1390 of the patent application WO2013/143700 or a fragment, homolog or variant thereof.

Most preferably the 3'-UTR element comprises the nucleic acid sequence derived from a fragment of the human albumin gene (albumin7 3'UTR) according to SEQ ID NO. 10065 (according to SEQ ID No: 1376 of the patent application WO2013/143700).

In this context it is particularly preferred that the 3'-UTR element of the at least one RNA of the inventive composition comprises or consists of a corresponding RNA sequence of the nucleic acid sequence according to SEQ ID NO. 10066.

In another particularly preferred embodiment, the 3'-UTR element comprises or consists of a nucleic acid sequence which is derived from a 3'-UTR of an α-globin gene, preferably a vertebrate α- or β-globin gene, more preferably a mammalian α- or β-globin gene, most preferably a human α- or β-globin gene according to SEQ ID NO. 10055 (corresponding to SEQ ID No. 1370 of the patent application WO2013/143700 (3'-UTR of Homo sapiens hemoglobin, alpha 1 (HBA1))), or according to SEQ ID NO. 10057 (corresponding to SEQ ID No. 1371 of the patent application WO2013/143700 (3'-UTR of Homo sapiens hemoglobin, alpha 2 (HBA2))), and/or according to SEQ ID NO. 10059 (corresponding to SEQ ID No. 1372 of the patent application WO2013/143700 (3'-UTR of Homo sapiens hemoglobin, beta (HBB)).

For example, the 3'-UTR element may comprise or consist of the center, α-complex-binding portion of the 3'-UTR of an α-globin gene, according to SEQ ID NO. 10061 (corresponding to SEQ ID No. 1393 of the patent application WO2013/143700).

In this context it is particularly preferred that the 3'-UTR element of the RNA of the inventive composition comprises or consists of a corresponding RNA sequence of the nucleic acid sequence according to SEQ ID NO. 10062, according to the above or a homolog, a fragment or variant thereof.

The term 'a nucleic acid sequence which is derived from the 3'-UTR of a [ . . . ] gene' preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term 'a nucleic acid sequence which is derived from a variant of the 3'-UTR of a [ . . . ] gene' preferably refers to a nucleic acid sequence which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

Preferably, the at least one 5'-UTR element and the at least one 3'-UTR element act synergistically to increase protein production from the RNA of the inventive composition as described above.

Histone Stem Loop:

In a particularly preferred embodiment, the at least one RNA of the inventive composition comprises a histone stem-loop sequence/structure. Such histone stem-loop sequences are preferably selected from histone stem-loop sequences as disclosed in WO 2012/019780, whose disclosure is incorporated herewith by reference.

A histone stem-loop sequence, suitable to be used within the present invention, is preferably selected from at least one of the following formulae (I) or (II):

formula (I) (stem-loop sequence without stem bordering elements):

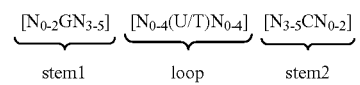

stem1    loop    stem2 formula (II) (stem-loop sequence with stem bordering elements):

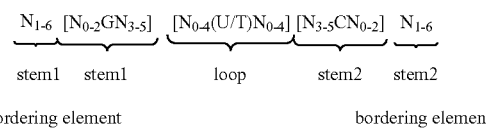

stem1    stem1    loop    stem2    stem2 bordering element                bordering element wherein:

stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5} CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one or more bases in one stem do not have a complementary base in the reverse complementary sequence of the other stem.

According to a further preferred embodiment of the first inventive aspect, the inventive mRNA sequence may comprise at least one histone stem-loop sequence according to at least one of the following specific formulae (Ia) or (IIa):

formula (Ia) (stem-loop sequence without stem bordering elements):

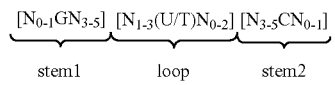

formula (IIa) (stem-loop sequence with stem bordering elements):

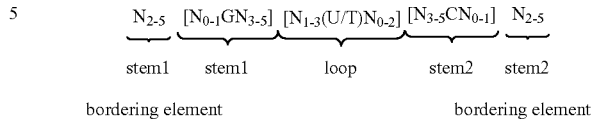

wherein N, C, G, T and U are as defined above.

According to a further more particularly preferred embodiment of the first aspect, the at least one RNA may comprise at least one histone stem-loop sequence according to at least one of the following specific formulae (Ib) or (IIb):

formula (Ib) (stem-loop sequence without stem bordering elements):

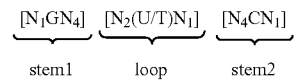

formula (IIb) (stem-loop sequence with stem bordering elements):

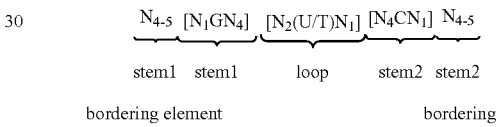

wherein N, C, G, T and U are as defined above.

A particular preferred histone stem-loop sequence is the sequence according to SEQ ID No: 8.

More preferably the stem-loop sequence is the corresponding RNA sequence of the nucleic acid sequence according to SEQ ID NO: 9

Poly(A)

In a particularly preferred embodiment, the at least one RNA of the inventive composition comprises additionally to the coding region encoding at least one peptide or protein as described above or a fragment or variant thereof, a poly(A) sequence, also called poly-A tail, preferably at the 3' terminus of the RNA. When present, such a poly(A) sequence comprises a sequence of about 25 to about 400 adenosine nucleotides, preferably a sequence of about 50 to about 400 adenosine nucleotides, more preferably a sequence of about 50 to about 300 adenosine nucleotides, even more preferably a sequence of about 50 to about 250 adenosine nucleotides, most preferably a sequence of about 60 to about 250 adenosine nucleotides. In this context the term "about" refers to a deviation of ±10% of the value(s) it is attached to. This poly(A) sequence is preferably located 3' of the coding region comprised in the RNA according to the invention.

Preferably, the poly(A) sequence in at least one RNA of the composition is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the at least one RNA using commercially available polyadenylation kits and corresponding protocols known in the art.

Alternatively, the at least one RNA of the inventive composition optionally comprises a polyadenylation signal, which is defined herein as a signal, which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C)

According to a further preferred embodiment, the RNA of the inventive composition can be modified by a sequence of at least 10 cytosines, preferably at least 20 cytosines, more preferably at least 30 cytosines (so-called "poly(C) sequence"). Particularly, the RNA may contain a poly(C) sequence of typically about 10 to 200 cytosine nucleotides, preferably about 10 to 100 cytosine nucleotides, more preferably about 10 to 70 cytosine nucleotides or even more preferably about 20 to 50 or even 20 to 30 cytosine nucleotides. This poly(C) sequence is preferably located 3' of the coding region, more preferably 3' of an optional poly(A) sequence comprised in the RNA according to the present invention.

5'-Cap

According to another preferred embodiment of the invention, a modified RNA molecule as defined herein, can be modified by the addition of a so-called "5' cap" structure, which preferably stabilizes the RNA as described herein. A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified RNA in this context. Accordingly, a modified RNA of the present invention may comprise a m7GpppN as 5'-cap, but additionally the modified RNA typically comprises at least one further modification as defined herein.

Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

Secretory Signal Sequence:

According to another particularly preferred embodiment, the at least one RNA of the composition may additionally or alternatively encode a secretory signal peptide. Such secretory signal sequences are peptide stretches, which typically exhibit a length of about 15 to 30 amino acids and are preferably located at the N-terminus of the encoded peptide, without being limited thereto. Secretory signal sequences as defined herein preferably allow the transport of the encoded peptide or protein as encoded by the at least one coding sequence of the at least one RNA of the composition into a defined cellular compartment, preferably the cell surface, the endoplasmic reticulum (ER) or the endosomal-lysosomal compartment. Examples of secretory signal sequences as defined herein include, without being limited thereto, secretory signal sequences of classical or non-classical MHC-molecules (e.g. signal sequences of MHC I and II molecules, e.g. of the MHC class I molecule HLA-A*0201), secretory signal sequences of cytokines or immunoglobulines as defined herein, secretory signal sequences of the invariant chain of immunoglobulines or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartment.

Any of the above modifications regarding the coding sequence and/or regarding the RNA as defined above may be applied to the coding sequence and/or the RNA of the composition of the present invention, and further to any RNA as used in the context of the present invention and may be, if suitable or necessary, be combined with each other in any combination, provided, these combinations of modifications do not interfere with each other in the respective at least one RNA. A person skilled in the art will be able to take his choice accordingly.

Production of mRNA and RNA

The RNA may be prepared using any method known in the art, including synthetic methods (chemical synthesis of RNA) such as e.g. solid phase synthesis, as well as in vitro methods, such as RNA in vitro transcription reactions.

Combinations:

According to the present invention it is particularly preferred to combine RNA encoded peptides or proteins. In this context particularly preferred are the following combinations:

RNA, preferably mRNA coding for at least one cytokine+
  RNA, preferably mRNA coding for at least one chemokine RNA, preferably mRNA coding for at least one cytokine+
  RNA, preferably mRNA coding for at least one suicide gene product RNA, preferably mRNA coding for at least one cytokine+
  RNA, preferably mRNA coding for at least one immunogenic protein or peptide RNA, preferably mRNA coding for at least one cytokine+
  RNA, preferably mRNA coding for at least one apoptosis inducer RNA, preferably mRNA coding for at least one cytokine+
  RNA, preferably mRNA coding for at least one angiogenesis inhibitor RNA, preferably mRNA coding for at least one cytokine+RNA, preferably mRNA coding for at least one heat shock protein RNA, preferably mRNA coding for at least one cytokine+RNA, preferably mRNA coding for at least one tumor antigen RNA, preferably mRNA coding for at least one cytokine+RNA, preferably mRNA coding for at least one β-catenin inhibitor RNA, preferably mRNA coding for at least one cytokine+RNA, preferably mRNA coding for at least one activator of the STING pathway RNA, preferably mRNA coding for at least one cytokine+RNA, preferably mRNA coding for at least one checkpoint modulator RNA, preferably mRNA coding for at least one cytokine+RNA, preferably mRNA coding for at least one innate immune activator RNA, preferably mRNA coding for at least one cytokine+RNA, preferably mRNA coding for at least one antibody RNA, preferably mRNA coding for at least one cytokine+RNA, preferably mRNA coding for at least one decoy receptor RNA, preferably mRNA coding for at least one cytokine+RNA, preferably mRNA coding for at least one inhibitor of myeloid derived suppressor cells (MDSCs)

RNA, preferably mRNA coding for at least one cytokine+RNA, preferably mRNA coding for at least one IDO pathway inhibitor RNA, preferably mRNA coding for at least one cytokine+RNA, preferably mRNA coding for at least one protein or peptide that bind inhibitors of apoptosis.

Furthermore, particularly preferred are the following embodiments:

RNA, preferably mRNA coding for IL-2 and/or RNA, preferably mRNA coding for IL-12+mRNA coding for thymidine kinase (approach: cytokines+suicide gene product)

RNA, preferably mRNA coding for IL-2 and/or RNA, preferably mRNA coding for IL-12

RNA, preferably mRNA coding for IL-12 and/or RNA, preferably mRNA coding for CD40L RNA, preferably mRNA coding for IL-15 and/or RNA, preferably mRNA coding for IL-12

RNA, preferably mRNA coding for IL-2+RNA, preferably mRNA coding for Influenza NP protein RNA, preferably mRNA coding for IL-2 and/or RNA, preferably mRNA coding for IL-12+RNA, preferably mRNA coding for cytochrome c/caspase 3 (cytokines+apoptosis induction)

RNA, preferably mRNA coding for CD40L+RNA, preferably mRNA coding for IL-12+RNA, preferably mRNA coding for ΔRIGI It has to be understood that the RNA molecules of the inventive composition may code for one or more different peptides or proteins (e.g. cytokines, chemokines, suicide gene products, immunogenic proteins or peptides, apoptosis inducers, angiogenesis inhibitors, heat shock proteins, tumor antigens, β-catenin inhibitors, activators of the STING pathway, checkpoint modulators, innate immune activators, antibodies, dominant negative receptors and decoy receptors, inhibitors of myeloid derived suppressor cells (MDSCs), IDO pathway inhibitors, and proteins or peptides that bind inhibitors of apoptosis. as described above. Several RNA sequences may be combined in one inventive RNA containing composition. Moreover it is possible that the RNA sequence or sequences of the inventive composition code for variants or fragments of the wild type protein sequence or for one or more parts or fragments of the wild type protein sequence or variants thereof.

Non Coding RNA

According to the invention the at least one RNA of the inventive RNA containing composition may comprise at least one non-coding RNA, which is preferably selected from the group consisting of small interfering RNA (siRNA), antisense RNA (asRNA), circular RNA (circRNA), ribozymes, aptamers, riboswitches, immunostimulating/immunostimulatory RNA RNA, transfer RNA (tRNA), ribosomal RNA (rRNA), small nuclear RNA (snRNA), small nucleolar RNA (snoRNA), microRNA (miRNA), and Piwi-interacting RNA (piRNA).

Immunostimulatory/Immunostimulating RNA (isRNA):

Likewise, according to a further alternative, the at least one RNA of the inventive RNA containing composition is an immunostimulatory/immunostimulating RNA, which preferably elicits an innate immune response. Such an immunostimulatory RNA may be any (double-stranded or single-stranded) RNA, e.g. a coding RNA, as defined herein. In a preferred embodiment, the immunostimulatory RNA is a non-coding RNA. Preferably, the immunostimulatory RNA may be a single-stranded, a double-stranded or a partially double-stranded RNA, more preferably a single-stranded RNA, and/or a circular or linear RNA, more preferably a linear RNA. More preferably, the immunostimulatory RNA may be a (linear) single-stranded RNA. Even more preferably, the immunostimulatory RNA may be a (long) (linear) single-stranded) non-coding RNA. In this context it is particular preferred that the isRNA carries a triphosphate at its 5'-end which is the case for in vitro transcribed RNA. An immunostimulatory RNA may also occur as a short RNA oligonucleotide as defined herein.

An immunostimulatory RNA as used herein may furthermore be selected from any class of RNA molecules, found in nature or being prepared synthetically, and which can induce an innate immune response and may support an adaptive immune response induced by an antigen. In this context, an immune response may occur in various ways. A substantial factor for a suitable (adaptive) immune response is the stimulation of different T cell sub-populations. T-lymphocytes are typically divided into two sub-populations, the T-helper 1 (Th1) cells and the T-helper 2 (Th2) cells, with which the immune system is capable of destroying intracellular (Th1) and extracellular (Th2) pathogens (e.g. antigens). The two Th cell populations differ in the pattern of the effector proteins (cytokines) produced by them. Thus, Th1 cells assist the cellular immune response by activation of macrophages and cytotoxic T cells. Th2 cells, on the other hand, promote the humoral immune response by stimulation of B-cells for conversion into plasma cells and by formation of antibodies (e.g. against antigens). The Th1/Th2 ratio is therefore of great importance in the induction and maintenance of an adaptive immune response. In connection with the present invention, the Th1/Th2 ratio of the (adaptive) immune response is preferably shifted in the direction towards the cellular response (Th1 response) and a cellular immune response is thereby induced. According to one example, the innate immune system which may support an adaptive immune response may be activated by ligands of Toll-like receptors (TLRs). TLRs are a family of highly conserved pattern recognition receptor (PRR) polypeptides that recognize pathogen-associated molecular patterns (PAMPs) and play a critical role in innate immunity in mammals. Currently at least thirteen family members, designated TLR1-TLR13 (Toll-like receptors: TLR1, TLR2, TLR3, TLR4, TLR5, TLR6, TLR7, TLR8, TLR9, TLR10, TLR11, TLR12 or TLR13), have been identified. Furthermore, a number of specific TLR ligands have been identified. Furthermore, it has been reported that ligands for certain TLRs include certain nucleic acid molecules and that certain types of RNA are immunostimulatory in a sequence-independent or sequence-dependent manner, wherein these various immunostimulatory RNAs may e.g. stimulate TLR3, TLR7, or TLR8, or intracellular receptors such as RIG-I, MDA-5, etc.

Preferably, an immunostimulatory nucleic acid, preferably an immunostimulatory RNA (isRNA), as used herein, may comprise any RNA sequence known to be immunostimulatory, including, without being limited thereto, RNA sequences representing and/or encoding ligands of TLRs, preferably selected from human family members TLR1-TLR10 or murine family members TLR1-TLR13, more preferably selected from (human) family members TLR1-TLR10, even more preferably from TLR7 and TLR8, ligands for intracellular receptors for RNA (such as RIG-I or MDA-5, etc.) (see e.g. Meylan, E., Tschopp, J. (2006). Toll-like receptors and RNA helicases: two parallel ways to trigger antiviral responses. Mol. Cell 22, 561-569), or any other immunostimulatory RNA sequence. Furthermore, (classes of) immunostimulatory RNA molecules, used as a further compound of the inventive vaccine, may include any other RNA capable of eliciting an immune response. Without being limited thereto, such an immunostimulatory RNA may include ribosomal RNA (rRNA), transfer RNA (tRNA), messenger RNA (mRNA), and viral RNA (vRNA). Such an immunostimulatory RNA may comprise a length of 1000 to 5000, of 500 to 5000, of 5 to 5000, or of 5 to 1000, 5 to 500, 5 to 250, of 5 to 100, of 5 to 50 or of 5 to 30 nucleotides.

An immunostimulatory RNA as used herein may furthermore be selected from any class of RNA molecules, found in nature or being prepared synthetically, and which can induce an innate immune response and may support an adaptive immune response induced by an antigen. In this context, an immune response may occur in various ways. A substantial factor for a suitable (adaptive) immune response is the stimulation of different T-cell sub-populations. T-lymphocytes are typically divided into two sub-populations, the T-helper 1 (Th1) cells and the T-helper 2 (Th2) cells, with which the immune system is capable of destroying intracellular (Th1) and extracellular (Th2) pathogens (e.g. antigens). The two Th cell populations differ in the pattern of the effector proteins (cytokines) produced by them. Thus, Th1 cells assist the cellular immune response by activation of macrophages and cytotoxic T-cells. Th2 cells, on the other hand, promote the humoral immune response by stimulation of B-cells for conversion into plasma cells and by formation of antibodies (e.g. against antigens). The Th1/Th2 ratio is therefore of great importance in the induction and maintenance of an adaptive immune response. In connection with the present invention, the Th1/Th2 ratio of the (adaptive) immune response is preferably shifted in the direction towards the cellular response (Th1 response) and a cellular immune response is thereby induced. According to one example, the innate immune system which may support an adaptive immune response, may be activated by ligands of Toll-like receptors (TLRs). TLRs are a family of highly conserved pattern recognition receptor (PRR) polypeptides that recognize pathogen-associated molecular patterns (PAMPs) and play a critical role in innate immunity in mammals. Currently at least thirteen family members, designated TLR1-TLR13 (Toll-like receptors: TLR1, TLR2, TLR3, TLR4, TLR5, TLR6, TLR7, TLR8, TLR9, TLR10, TLR11, TLR12 or TLR13), have been identified. Furthermore, a number of specific TLR ligands have been identified. It was e.g. found that unmethylated bacterial DNA and synthetic analogs thereof (CpG DNA) are ligands for TLR9 (Hemmi H et al. (2000) Nature 408:740-5; Bauer S et al. (2001) Proc Natl Acad Sci USA 98, 9237-42). Furthermore, it has been reported that ligands for certain TLRs include certain nucleic acid molecules and that certain types of RNA are immunostimulatory in a sequence-independent or sequence-dependent manner, wherein these various immunostimulatory RNAs may e.g. stimulate TLR3, TLR7, or TLR8, or intracellular receptors such as RIG-I, MDA-5, etc. E.g. Lipford et al. determined certain G,U-containing oligoribonucleotides as immunostimulatory by acting via TLR7 and TLR8 (see WO 03/086280). The immunostimulatory G,U-containing oligoribonucleotides described by Lipford et al. were believed to be derivable from RNA sources including ribosomal RNA, transfer RNA, messenger RNA, and viral RNA.

According to a particularly preferred embodiment, such immunostimulatory nucleic acid sequences is preferably RNA preferably consisting of or comprising a nucleic acid of the following formula (III) or (IV):

$$G_lX_mG_n, \quad \text{(formula (III))}$$

wherein:

G is guanosine, uracil or an analogue of guanosine or uracil;

X is guanosine, uracil, adenosine, thymidine, cytosine or an analogue of the above-mentioned nucleotides;

l is an integer from 1 to 40, wherein when l=1 G is guanosine or an analogue thereof, when l>1 at least 50% of the nucleotides are guanosine or an analogue thereof;

m is an integer and is at least 3;

wherein when m=3 X is uracil or an analogue thereof, when m>3 at least 3 successive uracils or analogues of uracil occur;

n is an integer from 1 to 40, wherein when n=1 G is guanosine or an analogue thereof, when n>1 at least 50% of the nucleotides are guanosine or an analogue thereof.

$$C_lX_mC_n, \quad \text{(formula (IV))}$$

wherein:

C is cytosine, uracil or an analogue of cytosine or uracil;

X is guanosine, uracil, adenosine, thymidine, cytosine or an analogue of the above-mentioned nucleotides;

l is an integer from 1 to 40, wherein when l=1 C is cytosine or an analogue thereof, when l>1 at least 50% of the nucleotides are cytosine or an analogue thereof;

m is an integer and is at least 3;

wherein when m=3 X is uracil or an analogue thereof, when m>3 at least 3 successive uracils or analogues of uracil occur;

n is an integer from 1 to 40, wherein when n=1 C is cytosine or an analogue thereof, when n>1 at least 50% of the nucleotides are cytosine or an analogue thereof.

The nucleic acids of formula (II) or (III), which may be used as immunostimulatory RNA may be relatively short nucleic acid molecules with a typical length of approximately from 5 to 100 (but may also be longer than 100 nucleotides for specific embodiments, e.g. up to 200 nucleotides), from 5 to 90 or from 5 to 80 nucleotides, preferably a length of approximately from 5 to 70, more preferably a length of approximately from 8 to 60 and, more preferably a length of approximately from 15 to 60 nucleotides, more preferably from 20 to 60, most preferably from 30 to 60 nucleotides. If the nucleic acid of the inventive nucleic acid cargo complex has a maximum length of e.g. 100 nucleotides, m will typically be <=98. The number of nucleotides G in the nucleic acid of formula (III) is determined by l or n. l and n, independently of one another, are each an integer from 1 to 40, wherein when l or n=1 G is guanosine or an analogue thereof, and when l or n>1 at least 50% of the nucleotides are guanosine or an analogue thereof. For example, without implying any limitation, when l or n=4 Gl or Gn can be, for example, a GUGU, GGUU, UGUG, UUGG, GUUG, GGGU, GGUG, GUGG, UGGG or GGGG, etc.; when l or n=5 Gl or Gn can be, for example, a GGGUU, GGUGU, GUGGU, UGGGU, UGGUG, UGUGG, UUGGG, GUGUG, GGGGU, GGGUG, GGUGG, GUGGG, UGGGG, or GGGGG, etc.; etc. A nucleotide adjacent to Xm in the nucleic acid of formula (III) according to the invention is preferably not a uracil. Similarly, the number of nucleotides C in the nucleic acid of formula (IV) according to the invention is determined by l or n. l and n, independently of one another, are each an integer from 1 to 40, wherein when l or n=1 C is cytosine or an analogue thereof, and when l or n>1 at least 50% of the nucleotides are cytosine or an analogue thereof. For example, without implying any limitation, when l or n=4, Cl or Cn can be, for example, a CUCU, CCUU, UCUC, UUCC, CUUC, CCCU, CCUC, CUCC, UCCC or CCCC, etc.; when l or n=5 Cl or Cn can be, for example, a CCCUU, CCUCU, CUCCU, UCCCU, UCCUC, UCUCC, UUCCC, CUCUC, CCCCU, CCCUC, CCUCC, CUCCC, UCCCC, or CCCCC, etc.; etc. A nucleotide adjacent to Xm in the nucleic acid of formula (III) according to the invention is preferably not a uracil. Preferably, for formula (II), when l or n>1, at least 60%, 70%, 80%, 90% or even 100% of the nucleotides are guanosine or an analogue thereof, as defined above. The remaining nucleotides to 100% (when guanosine constitutes less than 100% of the nucleotides) in the flanking sequences G1 and/or Gn are uracil or an analogue thereof, as defined hereinbefore. Also preferably, l and n, independently of one another, are each an integer from 2 to 30, more preferably an integer from 2 to 20 and yet more preferably an integer from 2 to 15. The lower limit of l or n can be varied if necessary and is at least 1, preferably at least 2, more preferably at least 3, 4, 5, 6, 7, 8, 9 or 10. This definition applies correspondingly to formula (III).

According to a particularly preferred embodiment, a nucleic acid according to any of formulas (III) or (IV) above, which may be used as immunostimulatory RNA, may be selected from a sequence consisting or comprising any of the following sequences SEQ ID NOs 298-381.

or from a sequence having at least 60%, 70%, 80%, 90%, or even 95% sequence identity with any of these sequences According to a further particularly preferred embodiment, such immunostimulatory nucleic acid sequences particularly isRNA consist of or comprise a nucleic acid of formula (V) or (VI):

$$(NuG_lX_mG_nN_v)_a, \qquad \text{(formula (V))}$$

wherein:

G is guanosine (guanine), uridine (uracil) or an analogue of guanosine (guanine) or uridine (uracil), preferably guanosine (guanine) or an analogue thereof;

X is guanosine (guanine), uridine (uracil), adenosine (adenine), thymidine (thymine), cytidine (cytosine), or an analogue of these nucleotides (nucleosides), preferably uridine (uracil) or an analogue thereof;

N is a nucleic acid sequence having a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides);

a is an integer from 1 to 20, preferably from 1 to 15, most preferably from 1 to 10;

l is an integer from 1 to 40, wherein when l=1, G is guanosine (guanine) or an analogue thereof, when l>1, at least 50% of these nucleotides (nucleosides) are guanosine (guanine) or an analogue thereof;

m is an integer and is at least 3;

wherein when m=3, X is uridine (uracil) or an analogue thereof, and when m>3, at least 3 successive uridines (uracils) or analogues of uridine (uracil) occur;

n is an integer from 1 to 40, wherein when n=1, G is guanosine (guanine) or an analogue thereof, when n>1, at least 50% of these nucleotides (nucleosides) are guanosine (guanine) or an analogue thereof;

u,v may be independently from each other an integer from 0 to 50, preferably wherein when u=0, v≥1, or when v=0, u 1;

wherein the nucleic acid molecule of formula (IV) has a length of at least 50 nucleotides, preferably of at least 100 nucleotides, more preferably of at least 150 nucleotides, even more preferably of at least 200 nucleotides and most preferably of at least 250 nucleotides.

$$(NuC_lX_mC_nN_v)_a, \qquad \text{(formula (VI))}$$

wherein:

C is cytidine (cytosine), uridine (uracil) or an analogue of cytidine (cytosine) or uridine (uracil), preferably cytidine (cytosine) or an analogue thereof;

X is guanosine (guanine), uridine (uracil), adenosine (adenine), thymidine (thymine), cytidine (cytosine) or an analogue of the above-mentioned nucleotides (nucleosides), preferably uridine (uracil) or an analogue thereof;

N is each a nucleic acid sequence having independent from each other a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides);

a is an integer from 1 to 20, preferably from 1 to 15, most preferably from 1 to 10;

l is an integer from 1 to 40, wherein when l=1, C is cytidine (cytosine) or an analogue thereof, when l>1, at least 50% of these nucleotides (nucleosides) are cytidine (cytosine) or an analogue thereof;

m is an integer and is at least 3;

wherein when m=3, X is uridine (uracil) or an analogue thereof, when m>3, at least 3 successive uridines (uracils) or analogues of uridine (uracil) occur;

n is an integer from 1 to 40, wherein when n=1, C is cytidine (cytosine) or an analogue thereof, when n>1, at least 50% of these nucleotides (nucleosides) are cytidine (cytosine) or an analogue thereof.

u, v may be independently from each other an integer from 0 to 50, preferably wherein when u=0, v≥1, or when v=0, u≥1;

wherein the nucleic acid molecule of formula (V) according to the invention has a length of at least 50 nucleotides, preferably of at least 100 nucleotides, more preferably of at least 150 nucleotides, even more preferably of at least 200 nucleotides and most preferably of at least 250 nucleotides.

For formula (VI), any of the definitions given above for elements N (i.e. Nu and Nv) and X (Xm), particularly the core structure as defined above, as well as for integers a, I, m, n, u and v, similarly apply to elements of formula (VI) correspondingly, wherein in formula (VI) the core structure is defined by CIXmCn. The definition of bordering elements Nu and Nv is identical to the definitions given above for Nu and Nv.

According to a very particularly preferred embodiment, the nucleic acid molecule, preferably immunostimulating RNA according to formula (V) may be selected from e.g. any of the sequences according to SEQ ID NOs 382-395 or from a sequence having at least 60%, 70%, 80%, 90%, or even 95% sequence identity with any of these sequences.

In this context particularly preferred are immunostimulating RNAs according to SEQ ID NOs 5, 394 and 10072.

R2025:

```
                                      (SEQ ID NO: 5 and 394)
GGGAGAAAGCUCAAGCUUAUCCAAGUAGGCUGGUCACCUGUACAACGUAG

CCGGUAUUUUUUUUUUUUUUUUUUUUUUGACCGUCUCAAGGUCCAAGUUA

GUCUGCCUAUAAAGGUGCGGAUCCACAGCUGAUGAAAGACUUGUGCGGUA

CGGUUAAUCUCCCCUUUUUUUUUUUUUUUUUUUUAGUAAAUGCGUCUAC

UGAAUCCAGCGAUGAUGCUGGCCCAGAUCUUCGACCACAAGUGCAUAUAG

UAGUCAUCGAGGGUCGCCUUUUUUUUUUUUUUUUUUUUUUUGGCCCAGUU

CUGAGACUUCGCUAGAGACUACAGUUACAGCUGCAGUAGUAACCACUGCG

GCUAUUGCAGGAAAUCCCGUUCAGGUUUUUUUUUUUUUUUUUUUUCCGC

UCACUAUGAUUAAGAACCAGGUGGAGUGUCACUGCUCUCGAGGUCUCACG

AGAGCGCUCGAUACAGUCCUUGGAAGAAUCUUUUUUUUUUUUUUUUUUUU

UUGUGCGACGAUCACAGAGAACUUCUAUUCAUGCAGGUCUGCUCUAG
```

R3630:

```
                                           (SEQ ID NO. 10072)
GGGAGAAAGCUCAAGCUUAUCCAAGUAGGCUGGUCACCUGUACAACGUAG

CCGGUAUUUUUUUUUUUUUUUUUUUUUUGACCGUCUCAAGGUCCAAGUUA

GUCUGCCUAUAAAGGUGCGGAUCCACAGCUGAUGAAAGACUUGUGCGGUA

CGGUUAAUCUCCCCUUUUUUUUUUUUUUUUUUUUAGUAAAUGCGUCUAC

UGAAUCCAGCGAUGAUGCUGGCCCAGAUCUUCGACCACAAGUGCAUAUAG

UAGUCAUCGAGGGUCGCCUUUUUUUUUUUUUUUUUUUUUUUGGCCCAGUU
```

-continued
```
CUGAGACUUCGCUAGAGACUACAGUUACAGCUGCAGUAGUAACCACUGCG

GCUAUUGCAGGAAAUCCCGUUCAGGUUUUUUUUUUUUUUUUUUUUCCGC

UCACUAUGAUUAAGAACCAGGUGGAGUGUCACUGCUCUCGAGGUCUCACG

AGAGCGCUCGAUACAGUGCUUGGAAGAAUCUUUUUUUUUUUUUUUUUUUU

UUGUGCGACGAUCACAGAGAACUUCUAUUCAUGCAGGUCUGCUCUAG.
```

According to another very particularly preferred embodiment, the nucleic acid molecule according to formula (VI) may be selected from e.g. any of the sequences according to SEQ ID NO 396 or 397, or from a sequence having at least 60%, 70%, 80%, 90%, or even 95% sequence identity with any of these sequences.

All modifications disclosed in the context of coding RNA may also be applied in the context of non-coding RNA if applicable.

Combination of Coding and Non-Coding RNA

In particularly preferred embodiments the inventive RNA containing composition comprises at least one RNA encoding at least one peptide or protein and at least one non-coding RNA as defined above, preferably at least one immunostimulating RNA.

Particularly preferred are the following embodiments:

Immunostimulating RNA preferably according to SEQ ID Nos 5, 394, or 10072+RNA, preferably mRNA coding for at least one cytokine, preferably IL-2, IL-12, IL-15 or CD40L Immunostimulating RNA preferably according to SEQ ID Nos 5, 394, or 10072+RNA, preferably mRNA coding for at least one chemokine Immunostimulating RNA preferably according to SEQ ID Nos 5, 394, or 10072+RNA, preferably mRNA coding for at least one suicide gene product, preferably Herpes simplex virus thymidine kinase Immunostimulating RNA preferably according to SEQ ID Nos 5, 394, or 10072+RNA, preferably mRNA coding for at least one immunogenic protein or peptide, preferably Influenza NP protein Immunostimulating RNA preferably according to SEQ ID Nos 5, 394, or 10072+RNA, preferably mRNA coding for at least one apoptosis inducer, preferably cytochrome c or caspase 3

Immunostimulating RNA preferably according to SEQ ID Nos 5, 394, or 10072+RNA, preferably mRNA coding for at least one angiogenesis inducer Immunostimulating RNA preferably according to SEQ ID Nos 5, 394, or 10072+RNA, preferably mRNA coding for at least one heat shock protein Immunostimulating RNA preferably according to SEQ ID Nos 5, 394, or 10072+RNA, preferably mRNA coding for at least one tumor antigen Immunostimulating RNA preferably according to SEQ ID Nos 5, 394, or 10072+RNA, preferably mRNA coding for at least one β-catenin inhibitor Immunostimulating RNA preferably according to SEQ ID Nos 5, 394, or 10072+RNA, preferably mRNA coding for at least one activator of the STING pathway Immunostimulating RNA preferably according to SEQ ID Nos 5, 394, or 10072+RNA, preferably mRNA coding for at least one checkpoint modulator, preferably an antibody directed against PD-1, PD-L1 or CTLA4

Immunostimulating RNA preferably according to SEQ ID Nos 5, 394, or 10072+RNA, preferably mRNA coding for at least one innate immune activator, preferably a constitutive active variant of RIG-1

Immostimulating RNA preferably according to SEQ ID Nos 5, 394, or 10072+RNA, preferably mRNA coding for at least one antibody Immostimulating RNA preferably according to SEQ ID Nos 5, 394, or 10072+RNA, preferably mRNA coding for at least one decoy receptor, preferably a soluble PD-1 receptor Immostimulating RNA preferably according to SEQ ID Nos 5, 394, or 10072+RNA, preferably mRNA coding for at least one inhibitor of myeloid derived suppressor cells (MDSCs)

Immostimulating RNA preferably according to SEQ ID Nos 5, 394, or 10072+RNA, preferably mRNA coding for at least one IDO pathway inhibitor Immostimulating RNA preferably according to SEQ ID Nos XY or YY+RNA, preferably mRNA coding for at least one protein or peptide that bind inhibitors of apoptosis.

More particularly preferred are the following embodiments:

Immostimulating RNA preferably according SEQ ID Nos 5, 394, or 10072+RNA, preferably mRNA coding for at least one cytokine, preferably IL-2, IL-12, IL-15 or CD40L+RNA, preferably mRNA coding for at least one immunogenic protein or peptide, preferably Influenza NP protein Immostimulating RNA preferably according to SEQ ID Nos 5, 394, or 10072+RNA, preferably mRNA coding for at least one cytokine, preferably IL-2, IL-12, IL-15 or CD40L+RNA, preferably mRNA coding for at least one innate immune activator, preferably a constitutive active variant of RIG-1

Immostimulating RNA preferably according to SEQ ID Nos 5, 394, or 10072+RNA, preferably mRNA coding for at least one cytokine, preferably IL-2, IL-12, or IL-15, +RNA, preferably mRNA coding for at least one further cytokine, preferably CD40L.

Formulation and Complexation

The at least one RNA of the inventive composition may be administered naked without being associated with any further vehicle, carrier, transfection or complexation agent.

In a preferred embodiment, the RNA of the inventive composition is formulated together with further compounds for increasing the transfection efficiency and/or the immunostimulatory properties of the RNA. Such compounds are termed herein carriers, vehicles, transfection or complexation agents. Preferably, the RNA is formulated together with one or more cationic or polycationic compounds, preferably with cationic or polycationic polymers, cationic or polycationic peptides or proteins, cationic or polycationic polysaccharides, cationic or polycationic lipids and/or with a polymeric carrier. Such cationic or polycationic polymers, cationic or polycationic peptides or proteins, cationic or polycationic polysaccharides, cationic or polycationic lipids or polymeric carriers are useful as carriers, vehicles, transfection or complexation agents of nucleic acids in the context of the present invention. Accordingly, in a further embodiment of the invention it is preferred that the at least one RNA or any other nucleic acid comprised in the inventive composition is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of RNA or nucleic acid to cationic or polycationic compound and/or with a polymeric carrier; or optionally in a nitrogen/phosphate ratio of RNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9.

The ratio of the at least one RNA as described above, and the cationic or polycationic compound, may be calculated on the basis of the nitrogen/phosphate ratio (N/P-ratio) of all these components. In the context of the present invention, an N/P-ratio is preferably in the range of about 0.01-4, 0.01-2, 0.1-2 or 0.1-1.5 regarding the ratio of nucleic acids:cationic or polycationic peptide contained in the inventive vaccine, and most preferably in the range of about 0.1-1. Such an N/P ratio is preferably designed to provide good transfection properties in vivo and transport into and through cell membranes. Preferably, for this purpose, cationic or polycationic compound and/or polymeric carriers as used herein, are based on peptide sequences.

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, proline-rich peptides, arginine-rich peptides, lysine-rich peptides, MPG-peptide(s), Pep-1, L-oligomers, Calcitonin peptide(s), Antennapedia-derived peptides (particularly from *Drosophila antennapedia*), pAntp, pIsl, FGF, Lactoferrin, Transportan, Buforin-2, Bac715-24, SynB, SynB(1), pVEC, hCT-derived peptides, SAP, or histones.

In this context protamine is particularly preferred.

Additionally, preferred cationic or polycationic proteins or peptides may be selected from the following proteins or peptides having the following total formula (VII):

$$(Arg)_l;(Lys)_m;(His)_n;(Orn)_o;(Xaa)_x,\qquad \text{(formula VII)}$$

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO 2009/030481 is incorporated herewith by reference.

A polymeric carrier used according to the invention might be a polymeric carrier formed by disulfide-crosslinked cationic components.

According to a further particularly preferred embodiment, cationic or polycationic peptides or proteins of the polymeric carrier, having the empirical sum formula (VII) as shown above and which comprise or are additionally modified to comprise at least one —SH moeity, may be, without being restricted thereto, selected from the subgroup consisting of generic formulas Arg7 (also termed as R7), Arg9 (also termed R9), Arg12 (also termed as R12).

According to a one further particularly preferred embodiment, the cationic or polycationic peptide or protein of the polymeric carrier, when defined according to formula {(Arg)l;(Lys)m;(His)n;(Orn)o;(Xaa)x} (formula (VII)) as shown above and which comprise or are additionally modified to comprise at least one —SH moeity, may be, without being restricted thereto, selected from subformula (VIIa):

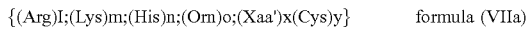

{(Arg)l;(Lys)m;(His)n;(Orn)o;(Xaa')x(Cys)y}    formula (VIIa)

wherein (Arg)l;(Lys)m;(His)n;(Orn)o; and x are as defined herein, Xaa' is any amino acid selected from native (=naturally occurring) or non-native amino acids except of Arg, Lys, His, Orn or Cys and y is any number selected from 0, 1, 2, 3, 4, 5, 6, 7, 8, 9, 10, 11, 12, 13, 14, 15, 16, 17, 18, 19, 20, 21-30, 31-40, 41-50, 51-60, 61-70, 71-80 and 81-90, provided that the overall content of Arg (Arginine), Lys (Lysine), His (Histidine) and Orn (Ornithine) represents at least 10% of all amino acids of the oligopeptide.

This embodiment may apply to situations, wherein the cationic or polycationic peptide or protein of the polymeric carrier, e.g. when defined according to empirical formula (Arg)l;(Lys)m;(His)n;(Orn)o;(Xaa)x (formula (VII)) as shown above, comprises or has been modified with at least one cysteine as —SH moiety in the above meaning such that the cationic or polycationic peptide as cationic component carries at least one cysteine, which is capable to form a disulfide bond with other components of the polymeric carrier.

Exemplary examples may comprise any of the following sequences:

Cys(Arg7), Cys(Arg8), Cys(Arg9), Cys(Arg10), Cys(Arg11), Cys(Arg12), Cys(Arg13), Cys(Arg14), Cys(Arg15), Cys(Arg16), Cys(Arg17), Cys(Arg18), Cys(Arg19), Cys(Arg20).

According to another particularly preferred embodiment, the cationic or polycationic peptide or protein of the polymeric carrier, when defined according to formula {(Arg)l;(Lys)m;(His)n;(Orn)o;(Xaa)x} (formula (VII)) as shown above, may be, without being restricted thereto, selected from subformula (VIIb):

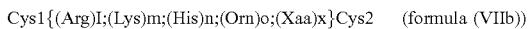

Cys1{(Arg)l;(Lys)m;(His)n;(Orn)o;(Xaa)x}Cys2    (formula (VIIb))

wherein empirical formula {(Arg)l;(Lys)m;(His)n;(Orn) o;(Xaa)x} (formula (VII)) is as defined herein and forms a core of an amino acid sequence according to (semiempirical) formula (I) and wherein Cys1 and Cys2 are Cysteines proximal to, or terminal to (Arg)l;(Lys)m;(His)n;(Orn)o; (Xaa)x. Exemplary examples may comprise any of the above sequences flanked by two Cys and following sequences:

Cys(Arg7)Cys, Cys(Arg8)Cys, Cys(Arg9)Cys, Cys(Arg10)Cys, Cys(Arg11)Cys, Cys(Arg12)Cys, Cys(Arg13) Cys, Cys(Arg14)Cys, Cys(Arg15)Cys, Cys(Arg16)Cys, Cys(Arg17)Cys, Cys(Arg18)Cys, Cys(Arg19)Cys, Cys(Arg20) Cys (SEQ ID NOs: 10-23):

This embodiment may apply to situations, wherein the cationic or polycationic peptide or protein of the polymeric carrier, e.g. when defined according to empirical formula (Arg)l;(Lys)m;(His)n;(Orn)o;(Xaa)x (formula (VII)) as shown above, has been modified with at least two cysteines as —SH moieties in the above meaning such that the cationic or polycationic peptide of the inventive polymeric carrier cargo complex as cationic component carries at least two (terminal) cysteines, which are capable to form a disulfide bond with other components of the polymeric carrier.

In a preferred embodiment, the polymeric carrier is formed by, comprises or consists of the peptide CysArg12Cys (SEQ ID NO: 15) or CysArg12 (CR-RRRRRRRRRRR).

According to a second alternative, at least one cationic (or polycationic) component of the polymeric carrier may be selected from e.g. any (non-peptidic) cationic or polycationic polymer suitable in this context, provided that this (non-peptidic) cationic or polycationic polymer exhibits or is modified to exhibit at least one —SH-moiety, which provide for a disulfide bond linking the cationic or polycationic polymer with another component of the polymeric carrier as defined herein. Thus, likewise as defined herein, the polymeric carrier may comprise the same or different cationic or polycationic polymers.

In the specific case that the cationic component of the polymeric carrier comprises a (non-peptidic) cationic or polycationic polymer the cationic properties of the (non-peptidic) cationic or polycationic polymer may be determined upon its content of cationic charges when compared to the overall charges of the components of the cationic polymer. Preferably, the content of cationic charges in the cationic polymer at a (physiological) pH as defined herein is at least 10%, 20%, or 30%, preferably at least 40%, more preferably at least 50%, 60% or 70%, but also preferably at least 80%, 90%, or even 95%, 96%, 97%, 98%, 99% or 100%, most preferably at least 30%, 40%, 50%, 60%, 70%, 80%, 90%, 95%, 96%, 97%, 98%, 99% or 100%, or may be in the range of about 10% to 90%, more preferably in the range of about 30% to 100%, even preferably in the range of about 50% to 100%, e.g. 50, 60, 70, 80%, 90% or 100%, or in a range formed by any two of the afore mentioned values, provided, that the content of all charges, e.g. positive and negative charges at a (physiological) pH as defined herein, in the entire cationic polymer is 100%.

Preferably, the (non-peptidic) cationic component of the polymeric carrier represents a cationic or polycationic polymer, typically exhibiting a molecular weight of about 0.1 or 0.5 kDa to about 100 kDa, preferably of about 1 kDa to about 75 kDa, more preferably of about 5 kDa to about 50 kDa, even more preferably of about 5 kDa to about 30 kDa, or a molecular weight of about 10 kDa to about 50 kDa, even more preferably of about 10 kDa to about 30 kDa. Additionally, the (non-peptidic) cationic or polycationic polymer typically exhibits at least one —SH-moiety, which is capable to form a disulfide linkage upon condensation with either other cationic components or other components of the polymeric carrier as defined herein.

In the above context, the (non-peptidic) cationic component of the polymeric carrier may be selected from acrylates, modified acrylates, such as pDMAEMA (poly(dimethylaminoethyl methylacrylate)), chitosanes, aziridines or 2-ethyl-2-oxazoline (forming oligo ethylenimines or modified oligoethylenimines), polymers obtained by reaction of bisacrylates with amines forming oligo beta aminoesters or poly amido amines, or other polymers like polyesters, polycarbonates, etc. Each molecule of these (non-peptidic) cationic or polycationic polymers typically exhibits at least one —SH-moiety, wherein these at least one —SH-moiety may be introduced into the (non-peptidic) cationic or polycationic polymer by chemical modifications, e.g. using imonothiolan, 3-thio propionic acid or introduction of —SH-moieties containing amino acids, such as cysteine or any further (modified) amino acid. Such —SH-moieties are preferably as already defined above.

The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context the disclosure of WO 2012/013326 is incorporated herewith by reference.

In this context the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable to complex an RNA or a nucleic acid as defined according to the present invention, and thereby preferably condensing the RNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the RNA of the inventive composition or any further nucleic acid comprised in the inventive composition contains at least one —SH moiety, most preferably at least one cysteine residue or any further chemical group exhibiting an —SH moiety, capable to form a disulfide linkage upon condensation with at least one further cationic or polycationic protein, peptide or polymer as cationic component of the polymeric carrier as mentioned herein.

As defined above, the polymeric carrier, which may be used to complex the RNA of the inventive composition or any further nucleic acid comprised in the inventive composition may be formed by disulfide-crosslinked cationic (or polycationic) components.

Nucleic acids complexed with such polymeric carriers are also termed herein as "polymeric carrier cargo complexes".

In this context it is particularly preferred that if immunostimulating RNA is used in the context of the present invention that this immunostimulating RNA is complexed with a polymeric carrier as defined above. Preferably, the immunostimulating RNA, (e.g. comprising an RNA sequence according to any of formulae III-VI), most preferably comprising an RNA sequence according to SEQ ID NOs. 5, 394, or 10072, is complexed with a polymeric carrier comprising or formed by disulfide-crosslinked peptides according to formula VII, VIIa or VIIb, preferably a polymeric carrier formed by Cys(Arg12)Cys or Cys(Arg12). Such a particularly preferred embodiment is termed herein also as "RNAdjuvant".

In a further particular embodiment, the polymeric carrier which may be used to complex the RNA or any further nucleic acid comprised in the inventive composition may be selected from a polymeric carrier molecule according to generic formula (VIII):

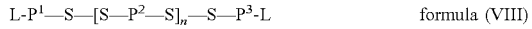   formula (VIII)

wherein,

P$^1$ and P$^3$ are different or identical to each other and represent a linear or branched hydrophilic polymer chain, each P$^1$ and P$^3$ exhibiting at least one —SH-moiety, capable to form a disulfide linkage upon condensation with component P$^2$, or alternatively with (AA), (AA)$_x$, or [(AA)$_x$]$_z$ if such components are used as a linker between P$^1$ and P$^2$ or P$^3$ and P$^2$ and/or with further components (e.g. (AA), (AA)$_x$, [(AA)$_x$]$_z$, or L), the linear or branched hydrophilic polymer chain selected independent from each other from polyethylene glycol (PEG), poly-N-(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

P$^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each P$^2$ exhibiting at least two —SH-moieties, capable to form a disulfide linkage upon condensation with further components P$^2$ or component(s) P$^1$ and/or P$^3$ or alternatively with further components (e.g. (AA), (AA)$_x$, or [(AA)$_x$]$_z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components P$^1$ and P$^2$, P$^2$ and P$^2$, or P$^2$ and P$^3$, or optionally of further components as defined herein (e.g. L, (AA), (AA)$_x$, [(AA)$_x$]$_z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context the disclosure of WO 2011/026641 and WO 2012/116811 is incorporated herewith by reference. Each of hydrophilic polymers $P^1$ and $P^3$ typically exhibits at least one —SH-moiety, wherein the at least one —SH-moiety is capable to form a disulfide linkage upon reaction with component $P^2$ or with component (AA) or $(AA)_x$, if used as linker between $P^1$ and $P^2$ or $P^3$ and $P^2$ as defined below and optionally with a further component, e.g. L and/or (AA) or $(AA)_x$, e.g. if two or more —SH-moieties are contained. The following subformulae "$P^1$—S—S—$P^2$" and "$P^2$—S—S—$P^3$" within the generic formula above, wherein any of S, $P^1$ and $P^3$ are as defined herein, typically represent a situation, wherein one —SH-moiety of hydrophilic polymers $P^1$ and $P^3$ was condensed with one —SH-moiety of component $P^2$ of the generic formula above, wherein both sulphurs of these —SH-moieties form a disulfide bond —S—S—. These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH-moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "-Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^3$ may be modified with a —SH moiety, preferably via a chemical reaction with a compound carrying a —SH moiety, such that each of the hydrophilic polymers $P^1$ and $P^3$ carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers $P^1$ and $P^3$ as defined herein. Such non-amino compounds may be attached to the hydrophilic polymers $P^1$ and $P^3$ of the polymeric carrier via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

As defined above, ligands (L), may be optionally used in the polymeric carrier molecule according to generic formula (VIII), e.g. for direction of the inventive carrier polymer and its entire "cargo" (the adjuvant component and/or the antigen of the inventive composition or vaccine composition) into specific cells. They may be selected independent from the other from RGD, Transferrin, Folate, a signal peptide or signal sequence, a localization signal or sequence, a nuclear localization signal or sequence (NLS), an antibody, a cell penetrating peptide (CPP), (e.g. TAT, KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues) or any such molecule as further defined below, etc. Particularly preferred are cell penetrating peptides (CPPs), which induce a pH-mediated conformational change in the endosome and lead to an improved release of the inventive polymeric carrier (in complex with a nucleic acid) from the endosome by insertion into the lipid layer of the liposome. Such called CPPs or cationic peptides for transportation, may include, without being limited thereto protamine, nucleoline, spermine or spermidine, poly-L-lysine (PLL), basic polypeptides, poly-arginine, chimeric CPPs, such as Transportan, or MPG peptides, HIV-binding peptides, Tat, HIV-1 Tat (HIV), Tat-derived peptides, oligoarginines, members of the penetratin family, e.g. Penetratin, Antennapedia-derived peptides (particularly from *Drosophila antennapedia*), pAntp, pIsI, etc., antimicrobial-derived CPPs e.g. Buforin-2, Bac715-24, Syn B, SynB(1), pVEC, hCT-derived peptides, SAP, MAP, PpTG20, Proline-rich peptides, Loligomers, Arginine-rich peptides, Calcitonin-peptides, FGF, Lactoferrin, poly-L-Lysine, poly-Arginine, histones, VP22 derived or analog peptides, Pestivirus Erns, HSV, VP22 (Herpes simplex), MAP, KALA or protein transduction domains (PTDs, PpT620, prolin-rich peptides, arginine-rich peptides, lysine-rich peptides, Pep-1, L-oligomers, Calcitonin peptide(s), etc. Particularly preferred in this context is mannose as ligand to target antigen presenting cells which carries on their cell membrane mannose receptors. In a further preferred aspect of the first embodiment of the present invention galactose as optional ligand can be used to target hepatocytes. Such ligands may be attached to component $P^1$ and/or $P^3$ by reversible disulfide bonds as defined below or by any other possible chemical attachment, e.g. by amide formation (e.g. carboxylic acids, sulphonic acids, amines, etc), by Michael addition (e.g. maleinimide moieties, α,β unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components.

In the context of formula (VIII) of the present invention components $P^1$ and $P^3$ represent a linear or branched hydrophilic polymer chain, containing at least one —SH-moiety, each $P^1$ and $P^3$ independently selected from each other, e.g. from polyethylene glycol (PEG), poly-N-(2-hydroxypropyl) methacrylamide, poly-2-(methacryloyloxy)ethyl phosphorylcholines, poly(hydroxyalkyl L-asparagine) or poly(hydroxyalkyl L-glutamine). $P^1$ and $P^3$ may be identical or different to each other. Preferably, each of hydrophilic polymers $P^1$ and $P^3$ exhibits a molecular weight of about 1 kDa to about 100 kDa, preferably of about 1 kDa to about 75 kDa, more preferably of about 5 kDa to about 50 kDa, even more preferably of about 5 kDa to about 25 kDa. Additionally, each of hydrophilic polymers $P^1$ and $P^3$ typically exhibits at least one —SH-moiety, wherein the at least one —SH-moiety is capable to form a disulfide linkage upon reaction with component $P^2$ or with component (AA) or $(AA)_x$, if used as linker between $P^1$ and $P^2$ or $P^3$ and $P^2$ as defined below and optionally with a further component, e.g. L and/or (AA) or $(AA)_x$, e.g. if two or more —SH-moieties are contained. The following subformulae "$P^1$—S—S—$P^2$" and "$P^2$—S—S—$P^3$" within generic formula (VII) above (the brackets are omitted for better readability), wherein any of S, $P^1$ and $P^3$ are as defined herein, typically represent a situation, wherein one —SH-moiety of hydrophilic polymers $P^1$ and $P^3$ was condensed with one —SH-moiety of component $P^2$ of generic formula (VII) above, wherein both sulphurs of these —SH-moieties form a disulfide bond —S—S— as defined herein in formula (VII). These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH-moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "-Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^3$ may be modified with a —SH moiety, preferably via a chemical reaction with a compound carrying a —SH moiety, such that each of the hydrophilic polymers $P^1$ and $P^3$ carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers $P^1$ and $P^3$ as defined herein. Such non-amino compounds may be attached to the hydrophilic polymers $P^1$ and $P^3$ of formula (VII) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

According to one preferred alternative, such further functional peptides or proteins may comprise so called cell penetrating peptides (CPPs) or cationic peptides for transportation. Particularly preferred are CPPs, which induce a pH-mediated conformational change in the endosome and lead to an improved release of the inventive polymeric carrier (in complex with a nucleic acid) from the endosome by insertion into the lipid layer of the liposome. Such called cell penetrating peptides (CPPs) or cationic peptides for transportation, may include, without being limited thereto protamine, nucleoline, spermine or spermidine, poly-L-lysine (PLL), basic polypeptides, poly-arginine, chimeric CPPs, such as Transportan, or MPG peptides, HIV-binding peptides, Tat, HIV-1 Tat (HIV), Tat-derived peptides, oligoarginines, members of the penetratin family, e.g. Penetratin, Antennapedia-derived peptides (particularly from *Drosophila antennapedia*), pAntp, pIsl, etc., antimicrobial-derived CPPs e.g. Buforin-2, Bac715-24, Syn B, SynB(1), pVEC, hCT-derived peptides, SAP, MAP, PpTG20, Proline-rich peptides, Loligomers, Arginine-rich peptides, Calcitonin-peptides, FGF, Lactoferrin, poly-L-Lysine, poly-Arginine, histones, VP22 derived or analog peptides, Pestivirus Erns, HSV, VP22 (Herpes simplex), MAP, KALA or protein transduction domains (PTDs, PpT620, prolin-rich peptides, arginine-rich peptides, lysine-rich peptides, Pep-1, L-oligomers, Calcitonin peptide(s), etc.

According to a further preferred embodiment of the present invention, each of hydrophilic polymers $P^1$ and $P^3$ of formula (VIII) of the polymeric carrier used according to the present invention may also contain at least one further functional moiety, which allows attaching further components as defined herein, e.g. a ligand as defined above, or functionalities which allow the attachment of further components, e.g. by amide formation (e.g. carboxylic acids, sulphonic acids, amines, etc), by Michael addition (e.g maleinimide moieties, unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. Further functional moieties may comprise an amino acid component (AA) as defined herein or $(AA)_x$, wherein (AA) is preferably an amino component as defined above. In the above context, x is preferably an integer and may be selected from a range of about 1 to 100, preferably from a range of about 1 to 50, more preferably 1 to 30, and even more preferably selected from a number comprising 1, 2, 3, 4, 5, 6, 7, 8, 9, 10, 11, 12, 13, 14 or 15-30, e.g. from a range of about 1 to 30, from a range of about 1 to 15, or from a number comprising 1, 2, 3, 4, 5, 6, 7, 8, 9, 10, 11, 12, 13, 14 or 15, or may be selected from a range formed by any two of the afore mentioned values. Most preferably, x is 1. Such an amino acid component (AA) or $(AA)_x$ may be contained in every part of the inventive polymeric carrier according to formula (VIII) above and therefore may be attached to all components of the inventive polymeric carrier according to formula (VII). It is particularly preferred that amino acid component (AA) or $(AA)_x$ is present as a ligand or part of the repetitive component $[S-P^2-S]_n$ within formula (VIII) of the inventive polymeric carrier.

In the context of the entire formula (VIII) of the polymeric carrier may be preferably defined as follows:

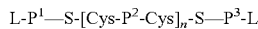

L-P$^1$—S-[Cys-P$^2$-Cys]$_n$-S—P$^3$-L wherein L, $P^1$, $P^2$, $P^3$ and n are as defined herein, S is sulphur and each Cys provides for one —SH-moiety for the disulfide bond.

According to a particular embodiment, the polymeric carrier according to formula (VII) as defined above, may comprise at least one amino acid component (AA) or $(AA)_x$, as defined above. Such an amino acid component (AA) or $(AA)_x$ may be contained in every part of the inventive polymeric carrier according to formula (VIII) above and therefore may be attached to all components of the polymeric carrier according to formula (VIII). It is particularly preferred that amino acid component (AA) or $(AA)_x$ is present as a ligand or part of the repetitive component $[S-P^2-S]_n$ within formula (VIII) of the polymeric carrier. The amino acid component (AA) or $(AA)_x$ preferably contains or is flanked (e.g. terminally) by at least one —SH containing moiety, which allows introducing this component (AA) or $(AA)_x$ via a disulfide bond into the polymeric carrier according to formula (VIII) as defined herein. Such a —SH-containing moiety may be any —SH containing moiety (or, of course, one sulphur of a disulfide bond), e.g. a cysteine residue. In the specific case that the —SH containing moiety represents a cysteine, the amino acid component $(AA)_x$ may also be read as -Cys-$(AA)_x$- or -Cys-$(AA)_x$-Cys- wherein Cys represents Cysteine and provides for the necessary —SH-moiety for a disulfide bond. The —SH containing moiety may be also introduced into the amino acid component $(AA)_x$ using any of modifications or reactions as shown above for components $P^1$, $P^2$ or $P^3$. In the specific case that the amino acid component $(AA)_x$ is linked to two components of the polymeric carrier according to formula (VIII) it is preferred that (AA) or $(AA)_x$ contains at least two —SH-moieties, e.g. at least two Cysteines, preferably at its terminal ends. This is particularly preferred if (AA) or $(AA)_x$ is part of the repetitive component $[S-P^2-S]_n$. Alternatively, the amino acid component (AA) or $(AA)_x$ is introduced into the polymeric carrier according to formula (VIII) as defined herein via any chemical possible addition reaction. Therefore the amino acid component (AA) or $(AA)_x$ contains at least one further functional moiety, which allows attaching same to a further component as defined herein, e.g. component $P^1$ or $P^3$, $P^2$, L, or a further amino acid component (AA) or $(AA)_x$, etc. Such functional moieties may be selected from functionalities which allow the attachment of further components, e.g. functionalities as defined herein, e.g. by amide formation (e.g. carboxylic acids, sulphonic acids, amines, etc), by Michael addition (e.g maleinimide moieties, α,β unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components.

The amino acid component (AA) or $(AA)_x$ in the polymeric carrier of formula (VIII) may also occur as a mixed repetitive amino acid component $[(AA)_x]_z$, wherein the number of amino acid components (AA) or $(AA)_x$ is further defined by integer z. In this context, z may be selected from a range of about 1 to 30, preferably from a range of about 1 to 15, more preferably 1 to 10 or 1 to 5 and even more preferably selected from a number selected from 1, 2, 3, 4, 5, 6, 7, 8, 9, 10, 11, 12, 13, 14 or 15, or may be selected from a range formed by any two of the afore mentioned values.

According to a specific and particularly preferred alternative, the amino acid component (AA) or $(AA)_x$, preferably written as S-$(AA)_x$-S or [S-$(AA)_x$-S] may be used to modify component $P^2$, particularly the content of component S—$P^2$—S in repetitive component $[S-P^2-S]_n$ of the polymeric carrier of formula (VIII) above. This may be represented in the context of the entire polymeric carrier according to formula (VIII) e.g. by following formula (VIIIa):

L-P$^1$—S—{[S—P$^2$—S]$_a$[S-(AA)$_x$-S]$_b$}—S—P$^3$-L, wherein x, S, L, AA, $P^1$, $P^2$ and $P^3$ are preferably as defined herein. In formula (VIIIa) above, any of the single components [S—P$^2$—S] and [S-(AA)$_x$-S] may occur in any order in the subformula {[S—P$^2$—S]$_a$[S-(AA)$_x$-S]$_b$}. The numbers of single components [S—P$^2$—S] and [S-(AA)$_x$-S] in the subformula {[S—P$^2$—S]$_a$[S-(AA)$_x$-S]$_b$} are determined by integers a and b, wherein a+b=n. n is an integer and is defined as above for formula (VIII).

a is an integer, typically selected independent from integer b from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 3 to 20, 4 to 20, 5 to 20, or 10 to 20, or a range of about 3 to 15, 4 to 15, 5 to 15, or 10 to 15, or a range of about 6 to 11 or 7 to 10. Most preferably, a is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

b is an integer, typically selected independent from integer a from a range of about 0 to 50 or 1 to 50, preferably from a range of about 0, 1, 2 or 3 to 30, more preferably from a range of about 0, 1, 2, 3, 4, or 5 to 25, or a range of about 0, 1, 2, 3, 4, or 5 to 20, or a range of about 0, 1, 2, 3, 4, or 5 to 15, or a range of about 0, 1, 2, 3, 4, or 5 to 10, including e.g. a range of about 3 to 20, 4 to 20, 5 to 20, or 10 to 20, or a range of about 3 to 15, 4 to 15, 5 to 15, or 10 to 15, or a range of about 6 to 11 or 7 to 10. Most preferably, b is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context it is particularly preferred that the RNA, preferably mRNA of the inventive composition is complexed at least partially with a cationic or polycationic compound and/or a polymeric carrier, preferably cationic proteins or peptides. In this context the disclosure of WO 2010/037539 and WO 2012/113513 is incorporated herewith by reference. Partially means that only a part of the RNA is complexed with a cationic compound and that the rest of the RNA is (comprised in the inventive composition) in uncomplexed form ("free"). Preferably the ratio of complexed RNA to:free RNA (in the inventive composition) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed RNA to free RNA in the inventive composition is selected from a ratio of about 1:1 (w/w).

The so called "(adjuvant) component", which may be used to together with the RNA, preferably mRNA in the inventive composition, is preferably prepared according to a first step by complexing the at least one (m)RNA of the (adjuvant) component with a cationic or polycationic compound and/or with a polymeric carrier, preferably as defined herein, in a specific ratio to form a stable complex. In this context, it is highly preferable, that no free cationic or polycationic compound or polymeric carrier or only a neglectably small amount thereof remains in the (adjuvant) component after complexing the (m)RNA. Accordingly, the ratio of the (m)RNA and the cationic or polycationic compound and/or the polymeric carrier in the (adjuvant) component is typically selected in a range that the (m)RNA is entirely complexed and no free cationic or polycationic compound or polymeric carrier or only a neglectably small amount thereof remains in the composition. Preferably the ratio of the (adjuvant) component, i.e. the ratio of the (m)RNA to the cationic or polycationic compound and/or the polymeric carrier, preferably as defined herein, is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the (m)RNA to the cationic or polycationic compound and/or the polymeric carrier, preferably as defined herein, in the (adjuvant) component, may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of RNA:cationic or polycationic compound and/or polymeric carrier, preferably as defined herein, in the complex, and most preferably in the range of about 0.7-1.5, preferably provided the cationic or polycationic compound in the complex is a cationic or polycationic cationic or polycationic protein or peptide and/or the polymeric carrier is as defined herein. Such ratios, particularly weight and/or N/P ratios may also be applied to ratios of the at least one RNA as defined herein to a cationic or polycationic polymer or a polymeric carrier as defined herein used to complex the at least one RNA.

In this context, the N/P ratio is a measure of the ionic charge of the cationic (side chain) component of the cationic or polycationic compound or. In particular, if the cationic properties of the cationic compound are generated by nitrogens (e.g. of the amino acid side chains), the N/P ratio expresses the ratio of basic nitrogen atoms to phosphate residues in the nucleotide backbone, considering that (side chain) nitrogen atoms in the cationic compound contribute to positive charges and phosphate of the phosphate backbone of the nucleic acid contribute to the negative charge. The N/P-ratio is defined as the nitrogen/phosphate ratio (N/P-ratio) of the entire complex of nucleic acid and cationic or polycationic compound. This is typically illustrative for the content/amount of cationic compounds and characteristic for the content/amount of nucleic acids bound or complexed. It may be calculated on the basis that, for example, 1 μg RNA typically contains about 3 nmol phosphate residues, provided that RNA exhibits a statistical distribution of bases. Additionally, 1 nmol peptide typically contains about x nmol nitrogen residues, dependent on the molecular weight and the number of its (cationic) amino acids.

According to a particularly preferred embodiment the inventive composition comprises a polymeric carrier cargo complex comprising or consisting of
  a) as a carrier a polymeric carrier formed by disulfide-crosslinked cationic components preferably as defined above, more preferably according to formula VII, VIIa, VIIb or VIII, and
  b) as a cargo at least one nucleic acid molecule, preferably an immunostimulating RNA, most preferably an RNA comprising an RNA sequence according to SEQ ID NOs. 5, 394, or 10072, preferably for use as a medicament, more preferably for use as an immunostimulating agent or adjuvant, preferably for the treatment of cancer or tumor diseases, wherein the polymeric carrier cargo complex is preferably administered intratumorally.

In a preferred embodiment, the inventive RNA containing composition comprises a polymeric carrier cargo complex, comprising:
  a) as a carrier a polymeric carrier formed by disulfide-crosslinked cationic components, preferably as defined above, more preferably according to formula VII, VIIa, VIIb or VIII, and
  a) b) as a cargo at least one first nucleic acid molecule, preferably an immunostimulating RNA, most preferably an RNA comprising an RNA sequence according to SEQ ID NOs. 5, 394, or 10072,
  for use as an immunostimulating agent or as an adjuvant, and at least one second nucleic acid molecule, preferably an RNA and more preferably an mRNA encoding at least one protein or a peptide most preferably as disclosed above for coding RNA, and wherein the inventive composition is preferably administered intratumorally.

In a preferred embodiment, the invention relates to a polymeric carrier cargo complex, comprising:
  a) as a carrier a polymeric carrier formed by disulfide-crosslinked cationic components, preferably as defined above, more preferably according to formula VII, VIIa, VIIb or VIII, and
  a) b) as a cargo at least one first nucleic acid molecule, preferably an immunostimulating RNA, most preferably an RNA comprising an RNA sequence according to SEQ ID NOs. 5, 394, or 10072,
  for use as an immunostimulating agent or as an adjuvant, wherein the polymeric carrier cargo complex is administered in combination with at least one second nucleic acid molecule, preferably an RNA and more preferably an mRNA encoding at least one protein or a peptide most preferably as disclosed above for coding RNA, and
  wherein the polymeric carrier cargo complex and the second nucleic acid molecule are preferably administered intratumorally.

Such preferred combinations of at least one first nucleic acid, preferably an immunostimulating RNA and at least one second nucleic acid, preferably an RNA, and more preferably an mRNA encoding at least one protein or peptide are disclosed above in the context of "combinations of coding and non-coding RNA".

As used herein, the term "first nucleic acid molecule" refers to a nucleic molecule, which is used as a cargo in the polymeric carrier cargo complex and is thus associated with the polymeric carrier. The term "second nucleic acid molecule", as used herein, typically refers to a nucleic acid, which is not part of the polymeric carrier cargo complex and which encodes at least one peptide or protein.

In the context of the present invention immunostimulating agents or adjuvants are understood as compounds, which are preferably efficient in inducing an innate immune response, particularly in inducing the anti-viral cytokine IFN-alpha.

Adjuvants or immunostimulating agents usually act via their capability to induce an innate immune response. The innate immune system forms the dominant system of host defense in most organisms and comprises barriers such as humoral and chemical barriers including, e.g., inflammation, the complement system and cellular barriers. The innate immune system is typically based on a small number of receptors, called pattern recognition receptors. They recognize conserved molecular patterns that distinguish foreign organisms, like viruses, bacteria, fungi and parasites, from cells of the host. Such pathogen-associated molecular patterns (PAMP) include viral nucleic acids, components of bacterial and fungal walls, flagellar proteins, and more. The first family of pattern recognition receptors (PAMP receptors) studied in detail was the Toll-like receptor (TLR) family. TLRs are transmembrane proteins which recognize ligands of the extracellular milieu or of the lumen of endosomes. Following ligand-binding they transduce the signal via cytoplasmic adaptor proteins which leads to triggering of a host-defence response and entailing production of antimicrobial peptides, proinflammatory chemokines and cytokines, antiviral cytokines, etc. (see e.g. Meylan, E., J. Tschopp, et al. (2006), Nature 442(7098): 39-44). Further relevant components of the immune system include e.g. the endosomal TLRs, cytoplasmic receptors, Type I interferons and cytoplasmic receptors. Therefore, the immunostimulating agents or adjuvants are defined herein preferably as inducers of an innate immune response, which activate pattern recognition receptors (PAMP receptors). Hereby, a cascade of signals is elicited, which e.g. may result in the release of cytokines (e.g. IFN-alpha) supporting the innate immune response. Accordingly, it is preferably a feature of an immunostimulating agent or adjuvant to bind to such receptors and activate such PAMP receptors. Ideally, such as an agent or adjuvant additionally supports the adaptive immune response by e.g. shifting the immune response such that the preferred class of Th cells is activated. Depending on the disease or disorder to be treated a shift to a Th1-based immune response may be preferred or, in other cases, a shift to a Th2 immune response may be preferred. Furthermore, adjuvants are usually defined as compounds that can increase and/or modulate the intrinsic immunogenicity of an antigen.

The term "immunostimulating agent" is typically understood not to include agents as e.g. antigens (of whatever chemical structure), which elicit an adaptive/cytotoxic immune response, e.g. a "humoral" or "cellular" immune response, in other words elicit immune responses (and confer immunity by themselves) which are characterized by a specific response to structural properties of an antigen recognized to be foreign by immune competent cells. Rather "immunostimulating agent" is typically understood to mean agents/compounds/complexes which do not trigger any adaptive immune response by themselves, but which may exclusively enhance such an adaptive immune response in an unspecific way, by e.g. activating "PAMP" receptors and thereby triggering the release of cytokines which support the actual adaptive immune response. Accordingly, any immunostimulation by agents (e.g. antigens) which evoke an adaptive immune response by themselves (conferring immunity by themselves directly or indirectly) is typically disclaimed by the phrase "immunostimulating agent".

The term "adjuvant" is also understood not to comprise agents which confer immunity by themselves.

Accordingly, adjuvants do not by themselves confer immunity, but assist the immune system in various ways to enhance the antigen-specific immune response by e.g. promoting presentation of an antigen to the immune system. Hereby, an adjuvant may preferably e.g. modulate the antigen-specific immune response by e.g. shifting the dominating Th2-based antigen specific response to a more Th1-based antigen specific response or vice versa. Accordingly, the terms "immunostimulating agent" and "adjuvant" in the context of the present invention are typically understood to mean agents, compounds or complexes which do not confer immunity by themselves, but exclusively support the immune response in an unspecific way (in contrast to an antigen-specific immune response) by effects, which modulate the antigen-specific (adaptive cellular and/or humoral immune response) by unspecific measures, e.g. cytokine expression/secretion, improved antigen presentation, shifting the nature of the arms of the immune response etc. Accordingly, any agents evoking by themselves immunity are typically disclaimed by the terms "adjuvant" or "immunostimulating agent".

The use of the polymeric carrier cargo complex optionally in combination with a second nucleic acid molecule, preferably an RNA, allows provision of a more efficient and/or safer medicament. Advantageously, the polymeric carrier cargo complex is suited for in vivo delivery of nucleic acids, in particular for compacting and stabilizing a nucleic acid for the purposes of nucleic acid transfection, such as exhibiting one or more reduced negative side effects of high-molecular weight polymers as discussed above, such as poor biodegradability or high toxicity, agglomeration, low transfection activity in vivo, etc. The polymeric carrier cargo complex also provides for improved nucleic acid transfer in vivo, particularly via intratumoral routes, including serum stability, salt stability, efficiency of uptake, reduced complement activation, nucleic acid release, etc. Such a polymeric carrier cargo complex furthermore may support induction and maintenance of an adaptive immune response by initiating or boosting a parallel innate immune response. It has been found that an improved adaptive immune response can further be obtained, in particular when the polymeric carrier cargo complex is administered in combination with a second nucleic acid molecule, preferably an RNA, encoding a protein or peptide, or when the polymeric carrier cargo complex is co-formulated in a pharmaceutical composition with a second nucleic acid molecule, preferably an RNA, encoding a protein or peptide, preferably an antigenic peptide or protein. It has proven as particularly beneficial in this respect to administer the inventive composition comprising the polymeric carrier cargo complex optionally in combination with the second nucleic acid molecule as defined herein via an intratumoral route. Additionally, the polymeric carrier cargo complex may exhibit improved storage stability, particularly during lyophilisation.

In particular embodiments, the polymeric carrier cargo complex as defined above enhances the immune response against a protein or peptide, which is encoded by a second nucleic acid molecule, preferably an RNA, more preferably an mRNA, that is administered in combination with the polymeric carrier cargo complex, preferably via an intratumoral route of administration.

The polymeric carrier cargo complex and/or the second nucleic acid molecule encoding a peptide or protein are preferably provided together with a pharmaceutically acceptable carrier and/or vehicle. In the context of the present invention, a pharmaceutically acceptable carrier typically includes the liquid or non-liquid material, which is mixed with the polymeric carrier cargo complex and/or the second nucleic acid molecule. If the polymeric carrier cargo complex and/or the second nucleic acid molecule are provided in liquid form, the carrier will typically be pyrogen-free water; isotonic saline or buffered aqueous solutions, e.g phosphate, citrate etc. buffered solutions. Ringer or Ringer-Lactate solution is particularly preferred as a liquid basis.

The phrase "administered in combination" as used herein refers to a situation, where the polymeric carrier cargo complex is administered to a subject before, concomittantly or after the administration of the second nucleic acid molecule encoding a protein or peptide to the same subject. Preferably, the time interval between the administration of the polymeric carrier cargo complex and the at least one second nucleic acid molecule, preferably an RNA, encoding a protein or peptide is less than about 48 hours, more preferably less than about 24 hours, 12 hours, 6 hours, 4 hours, 2 hours, 1 hour, most preferably less than about 30 minutes, 15 minutes or 5 minutes. In a particularly preferred embodiment, the phrase "administered in combination" refers to concomitant administration of the polymeric carrier cargo complex and the at least one second nucleic acid molecule, i.e. the simultaneous administration of both components or the administration of both components within a time frame that typically comprises less than 5 minutes. The phrase "administered in combination" does not only refer to a situation, where the pharmaceutical carrier cargo complex is in physical contact with the at least one second nucleic acid molecule or formulated together with said second nucleic acid molecule. The phrase "administered in combination" as used herein comprises also the separate administration of the polymeric carrier cargo complex and the second nucleic acid molecule (e.g. by two separate injections), as long as the time interval between the two administrations does not exceed the interval as defined above. Alternatively, the polymeric carrier cargo complex and the second nucleic acid molecule may be administered in combination by mixing the polymeric carrier cargo complex and the second nucleic acid molecule prior to administration and administering the mixture to a subject. When the polymeric carrier cargo complex is formulated together with the second nucleic acid molecule or when a composition as defined herein is used, the polymeric carrier cargo complex and the second nucleic acid molecule may further, independently from each other, administered in combination via any of the administration routes as described herein.

The polymeric carrier cargo complex comprises as a cargo at least one nucleic acid molecule. In the context of the present invention, such a nucleic acid molecule may be any suitable nucleic acid, selected e.g. from any (single-stranded or double-stranded) DNA, preferably, without being limited thereto, e.g. genomic DNA, single-stranded DNA molecules, double-stranded DNA molecules, coding DNA, DNA primers, DNA probes, immunostimulatory/immunostimulating DNA, a (short) DNA oligonucleotide ((short) oligodesoxyribonucleotides), viral DNA, or may be selected e.g. from any PNA (peptide nucleic acid) or may be selected e.g. from any (single-stranded or double-stranded) RNA, preferably, without being limited thereto, a (short) RNA oligonucleotide ((short) oligoribonucleotide), a coding RNA, a messenger RNA (mRNA), a viral RNA, replicons, an immunostimulatory/immunostimulating RNA, a small interfering RNA (siRNA), an antisense RNA, a micro RNA, a small nuclear RNA (snRNA), a small-hairpin (sh) RNA or riboswitches, ribozymes or aptamers; etc. The nucleic acid molecule of the polymeric carrier cargo complex may also be a ribosomal RNA (rRNA), a transfer RNA (tRNA), a messenger RNA (mRNA), or a viral RNA (vRNA). Preferably, the nucleic acid molecule of the polymeric carrier cargo complex is an RNA. More preferably, the nucleic acid molecule of the polymeric carrier cargo complex is a (linear) single-stranded RNA, even more preferably an mRNA or an immunostimulatory/immunostimulating RNA.

Furthermore, the nucleic acid of the polymeric carrier cargo complex may be a single- or a double-stranded nucleic acid molecule or a partially double-stranded or partially single stranded nucleic acid, which are at least partially self complementary (both of these partially double-stranded or partially single stranded nucleic acid molecules are typically formed by a longer and a shorter single-stranded nucleic acid molecule or by two single stranded nucleic acid molecules, which are about equal in length, wherein one single-stranded nucleic acid molecule is in part complementary to the other single-stranded nucleic acid molecule and both thus form a double-stranded nucleic acid molecule in this region, i.e. a partially double-stranded or partially single stranded nucleic acid molecule. Preferably, the nucleic acid molecule may be a single-stranded nucleic acid molecule. Furthermore, the nucleic acid molecule may be a circular or linear nucleic acid molecule, preferably a linear nucleic acid molecule.

According to one alternative, the nucleic acid molecule of the inventive polymeric carrier cargo complex may be a coding nucleic acid, e.g. a DNA or RNA. Moreover, the polymeric carrier cargo complex may be administered in combination with at least one second nucleic acid molecule, which encodes a protein or a peptide.

According to one embodiment, the at least one first nucleic acid molecule and the at least one second nucleic acid molecule are both coding nucleic acid molecules. Preferably, the at least one first and the at least one second nucleic acid molecule each encode a different peptide or protein. In one embodiment, the first nucleic acid molecule has a sequence, which is distinct from the sequence of the second nucleic acid molecule, which is administered in combination with the polymeric carrier cargo complex. Alternatively, the first nucleic acid molecule and the second nucleic acid molecule may comprise the same sequence or be identical.

In the case of the at least one first nucleic acid molecule and/or of the second nucleic acid molecule, such a coding DNA or RNA may be any DNA or RNA as defined herein. Preferably, such a coding DNA or RNA may be a single- or a double-stranded DNA or RNA, more preferably a single-stranded DNA or RNA, and/or a circular or linear DNA or RNA, more preferably a linear DNA or RNA. Furthermore such a coding DNA or RNA may be a genomic DNA, a viral RNA or DNA, a replicon, a plasmid DNA or an mRNA. Even more preferably, the coding DNA or RNA may be a (linear) single-stranded DNA or RNA. Most preferably, the nucleic acid molecule according to the present invention may be a linear single-stranded messenger RNA (mRNA). Such an mRNA may occur as a mono-, di-, or even multicistronic RNA, i.e. an RNA which carries the coding sequences of one, two or more proteins or peptides. Such coding sequences in di-, or even multicistronic mRNA may be separated by at least one IRES sequence, e.g. as defined herein.

In a preferred embodiment, the at least one second nucleic acid molecule encodes a therapeutically active protein or an antigen as defined herein, preferably as disclosed in the context of "coding RNA". In a particularly preferred embodiment, the at least one second nucleic acid molecule, which is administered in combination with the polymeric carrier cargo complex, encodes a peptide or a protein, which is capable of eliciting an immune response, preferably an adaptive immune response, after administration, especially intratumoral administration, to a host. Alternatively, the at least one second nucleic acid molecule encodes at least one therapeutically active peptide or protein, preferably selected from the group consisting of cytokines, chemokines, suicide gene products, immunogenic proteins or peptides, apoptosis inducers, angiogenesis inhibitors, heat shock proteins, tumor antigens, β-catenin inhibitors, activators of the STING pathway, checkpoint modulators, innate immune activators, antibodies, dominant negative receptors and decoy receptors, inhibitors of myeloid derived suppressor cells (MDSCs), IDO pathway inhibitors, and proteins or peptides that bind inhibitors of apoptosis.

In a particular embodiment, the first nucleic acid molecule of the herein defined polymeric carrier cargo complex and/or the second nucleic acid molecule administered in combination with the polymeric carrier cargo complex may contain backbone modifications, sugar modifications or base modifications. A backbone modification in connection with the present invention is a modification in which phosphates of the backbone of the nucleotides contained in the nucleic acid molecule of the inventive polymeric carrier cargo complex are chemically modified. A sugar modification in connection with the present invention is a chemical modification of the sugar of the nucleotides of the first nucleic acid molecule of the inventive polymeric carrier cargo complex and/or of the second nucleic acid molecule administered in combination with the polymeric carrier cargo complex. Furthermore, a base modification in connection with the present invention is a chemical modification of the base moiety of the nucleotides of the nucleic acid molecule of the inventive polymeric carrier cargo complex and/or of the second nucleic acid molecule administered in combination with the polymeric carrier cargo complex. Such modifications are disclosed above in the context of "RNA modifications".

According to a further embodiment, the first nucleic acid molecule of the herein defined polymeric carrier cargo complex and/or the second nucleic acid molecule administered in combination with the polymeric carrier cargo complex can contain a lipid modification. Such a lipid-modified nucleic acid typically comprises a nucleic acid as defined herein. Such a lipid-modified first nucleic acid molecule of the polymeric carrier cargo complex or a lipid-modified second nucleic acid molecule administered in combination with the polymeric carrier cargo complex typically further comprises at least one linker covalently linked with that nucleic acid molecule, and at least one lipid covalently linked with the respective linker. Alternatively, the lipid-modified nucleic acid molecule comprises at least one nucleic acid molecule as defined herein and at least one (bifunctional) lipid covalently linked (without a linker) with that nucleic acid molecule. According to a third alternative, the lipid-modified nucleic acid molecule comprises a nucleic acid molecule as defined herein, at least one linker covalently linked with that nucleic acid molecule, and at least one lipid covalently linked with the respective linker, and also at least one (bifunctional) lipid covalently linked (without a linker) with that nucleic acid molecule.

According to a further preferred embodiment, the at least one RNA of the inventive composition is complexed with lipids to form one or more liposomes, lipoplexes, or lipid nanoparticles. Therefore, in one embodiment, the inventive composition comprises liposomes, lipoplexes, and/or lipid nanoparticles comprising the at least one RNA.

Lipid-based formulations have been increasingly recognized as one of the most promising delivery systems for RNA due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane. Lipoplexes can be prepared by directly mixing positively charged lipids at physiological pH with negatively charged nucleic acids.

Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Cationic liposomes have been traditionally the most commonly used non-viral delivery systems for oligonucleotides, including plasmid DNA, antisense oligos, and siRNA/small hairpin RNA-shRNA). Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dioleoyl-sn-glycero-3-phosphatidylcholine (DOPC)-based nanoliposomes were developed. (Adv Drug Deliv Rev. 2014 February; 66: 110-116.).

Therefore, in one embodiment the at least one RNA of the inventive composition is complexed with cationic lipids and/or neutral lipids and thereby forms liposomes, lipid nanoparticles, lipoplexes or neutral lipid-based nanoliposomes.

Preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicyl-spermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxy-propyl-oxymethyloxy)ethyl]trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amido-amine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

Additional Pharmaceutically Active Compounds:

Furthermore the inventive composition may comprise at least one additional pharmaceutically active component/compound. Alternatively or in addition to that, the at least one additional pharmaceutically active component/compound may be co-administered concomitant to the composition according to the invention. Therefore, the at least one additional pharmaceutically active component/compound may be administered in combination with the at least one RNA of the inventive composition or with the RNA containing composition according to the invention.

The phrases "administered in combination", co-administration or "concomitant administration" as used herein refers to a situation, where the inventive composition or an ingredient thereof is administered to a subject before, concomittantly or after the administration of a further pharmaceutically active component to the same subject. The time interval between the administration of the inventive composition or an ingredient thereof and the at least one second pharmaceutically active component depends on the nature and biological effect of the particular pharmaceutically active component and can be determined by a physician. Preferably the time interval is less than about 48 hours, more preferably less than about 24 hours, 12 hours, 6 hours, 4 hours, 2 hours, 1 hour, most preferably less than about 30 minutes, 15 minutes or 5 minutes. In a particularly preferred embodiment, the phrase "administered in combination" refers to concomitant administration of the inventive composition or an ingredient thereof and the at least one second pharmaceutically active component, i.e. the simultaneous administration of both compounds or the administration of both compounds within a time frame that typically comprises less than 5 minutes. The phrase "administered in combination" does not only refer to a situation, where the inventive composition or an ingredient thereof is in physical contact with the at least one second pharmaceutically active component or formulated together with said second pharmaceutically active component. The phrase "administered in combination" as used herein comprises also the separate administration of the inventive composition or an ingredient thereof and the second pharmaceutically active component (e.g. by two separate injections). Alternatively, the inventive composition or an ingredient thereof and the second pharmaceutically active component may be administered in combination by mixing the inventive composition or an ingredient thereof and the second pharmaceutically active component prior to administration and administering the mixture to a subject. When the inventive composition or an ingredient thereof is formulated together with the second pharmaceutically active component or when a composition as defined herein is used, the inventive composition or an ingredient thereof and the second pharmaceutically active component may further, independently from each other, administered in combination via any of the administration routes as described herein.

A pharmaceutically active component/compound in this connection is a compound that has a therapeutic effect to heal, ameliorate or prevent a particular indication or disease, namely a tumor or cancer disease. Such compounds include, without implying any limitation, peptides or proteins, preferably as defined herein, nucleic acids, preferably as defined herein, (therapeutically active) low molecular weight organic or inorganic compounds (molecular weight less than 5000, preferably less than 1000), sugars, antigens or antibodies, preferably as defined herein, therapeutic agents already known in the prior art, antigenic cells, antigenic cellular fragments, cellular fractions, cell wall components (e.g. polysaccharides), modified, attenuated or de-activated (e.g. chemically or by irradiation) pathogens (virus, bacteria etc.), adjuvants, etc.

In a preferred embodiment, the inventive composition additionally comprises at least one further pharmaceutically active component/compound, wherein the at least one additional pharmaceutically active component is selected from cytokines, chemokines, suicide gene products, immunogenic proteins or peptides, apoptosis inducers, angiogenesis inhibitors, heat shock proteins, tumor antigens, β-catenin inhibitors, activators of the STING pathway, checkpoint modulators, innate immune activators, antibodies, dominant negative receptors and decoy receptors, inhibitors of myeloid derived suppressor cells (MDSCs), IDO pathway inhibitors, proteins or peptides that bind inhibitors of apoptosis, anti-bacterial agents, anti-viral agents, adjuvants, chemotherapeutic agents and kinase inhibitors.

Alternatively, or in addition to that, the at least one additional pharmaceutically active component may be co-administered concomitant to the at least one RNA of the RNA containing composition or the inventive composition or may be used in combination with the at least one RNA of the RNA containing composition or the inventive composition.

In this context protein-based cytokines, chemokines, suicide gene products, immunogenic proteins or peptides, apoptosis inducers, angiogenesis inhibitors, heat shock proteins, tumor antigens, β-catenin inhibitors, activators of the STING pathway, checkpoint modulators, innate immune activators, antibodies, dominant negative receptors and decoy receptors, inhibitors of myeloid derived suppressor cells (MDSCs), IDO pathway inhibitors, and proteins or peptides that bind inhibitors of apoptosis or fragments and variants thereof as disclosed above in the context of "coding RNA" may be used as additional pharmaceutically active component. Alternatively, nucleic acids encoding these proteins or fragments or variants thereof may be used as additional pharmaceutically active component.

1. Cytokines:

In this context protein-based cytokines, or fragments and variants thereof as disclosed above in the context of "coding RNA" may be used as additional pharmaceutically active component. Alternatively, nucleic acids encoding these proteins or fragments or variants thereof may be used as additional pharmaceutically active component.

Preferably the cytokine is an interleukin (IL). One or more interleukins may be chosen e.g. from the following list: IL-1α, IL-1β, IL-1ra (antagonist), IL-2, IL-3, IL-4, IL-5, IL-6, IL-7, IL-8, IL-9, IL-10; IL-11, IL-12, IL-13, IL14, IL-15, IL-16, IL-17A, IL-17B, EL-17C, IL-17D, IL-17E, IL-17F, IL-18, IL-19, IL-20, IL-21, IL-22, IL-23, IL-24, IL-25, IL-26, IL-27, IL-28A/B, IL-29, IL-30, IL-31, IL-32, IL-33, IL-35. Moreover the cytokine may be one or more cytokines chosen from the TNF family, e.g. chosen from the following list: TNF, especially TNFα, LTα, LTβ, LIGHT, TWEAK, APRIL, BAFF, TL1A, GITRL, OX40L, CD40L (CD154), FASL, CD27L, CD30L, 4-1BBL, TRAIL, RANK ligand. Further examples of preferred cytokines may be chosen from the following list: FLT3 ligand, G-CSF, GM-CSF, IFNα/β/ω, IFNγ, LIF, M-CSF, MIF, OSM, Stem Cell Factor, TGFβ1, TGFβ2, TGFβ3, TSLP ligand.

Particularly preferred are cytokines chosen from the following list: IL-12, IL-15, IL-2, IFNγ, TNFα, IL-18, IFNα, IL-1β, IL-32, IL-7, IL-21, IL-8, GM-CSF.

In this context particularly preferred are cytokines as disclosed in Table 1 above.

In a particularly preferred embodiment, the at least one RNA of the RNA containing composition is an immunostimulating RNA, preferably according to SEQ ID NOs. 5, 394, or 10072, and is combined with at least one cytokine as defined above, preferably IL-2, IL-12, CD40L or IL-15 or a fragment or variant thereof.

1. Chemokines

In this context protein-based chemokines, or fragments and variants thereof as disclosed above in the context of "coding RNA" may be used as additional pharmaceutically active component. Alternatively, nucleic acids encoding these proteins or fragments or variants thereof may be used as additional pharmaceutically active component.

Preferred chemokines may be chosen from the following list: CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CCL1, CCL2, CCL3, CCL4, CCL5, CCL6, CCL7, CCL8, CCL9/10, CCL11, CCL12, CCL13, CCL14, CCL15, CCL16, CCL17, CCL18, CCL19, CCL20, CCL21, CCL22, CCL23, CCL24, CCL25, CCL26, CCL27, CCL28, XCL1, XCL2, CX3CL1.

In this context particularly preferred are chemokines as disclosed in Table 2 above.

In a particularly preferred embodiment, the at least one RNA of the RNA containing composition is an immunostimulating RNA, preferably according to SEQ ID NOs. 5, 394, or 10072 and is combined with at least one chemokine as defined above or a fragment or variant thereof.

2. Suicide Enzymes

In this context protein-based suicide enzymes, or fragments and variants thereof as disclosed above in the context of "coding RNA" may be used as additional pharmaceutically active component. Alternatively, nucleic acids encoding these proteins or fragments or variants thereof may be used as additional pharmaceutically active component.

The suicide enzyme is preferably a nucleotide metabolizing enzyme. Preferably the suicide enzyme is used in combination with a prodrug which is a substrate of the suicide enzyme, and which is converted to a cytotoxic compound by the suicide enzyme. One or more preferred suicide enzymes may be chosen from the following list: thymidine kinase, preferably a viral thymidine kinase, more preferably Herpes simplex virus thymidine kinase, Varicella zoster thymidine kinase; a plant thymidine kinase, preferably a tomato thymidine kinase; cytosine deaminase, preferably bacterial cytosine deaminase or Yeast cytosine deaminase; deoxynucleoside kinase, preferably *Drosophila melanogaster* deoxynucleoside kinase; deoxycytidine kinase, preferably a mammalian deoxycytidine kinase, purine nucleoside phosphorylase, preferably a bacterial purine nucleoside phosphorylase.

In this context particularly preferred are suicide enzymes (suicide gene products) as disclosed in Table 3 and 4 above.

In a particularly preferred embodiment, the at least one RNA of the RNA containing composition is an immunostimulating RNA, preferably according to SEQ ID NOs. 5, 394, or 10072 and is combined with at least one suicide enzyme as defined above or a fragment or variant thereof.

3. Immunogenic Proteins or Peptides

In this context protein-based immunogenic proteins or peptides, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

The immunogenic protein or peptide is preferably a pathogenic antigen to utilize preexisting immunity against such antigens for treatment of tumor and/or cancer diseases. The memory immune response is triggered and the immune system is strengthened for attacking tumor cells.

Preferred examples of immunogenic proteins or peptides for this embodiment of the invention are proteins or peptides of widespread pathogens, i.e. pathogens with which every organism, in particular mammals, preferably humans, has a high probability of being infected at least once in his/her lifetime. These include, for example, any structural or non-structural protein or peptide of:

influenza virus type A or B or any other orthomyxovirus (influenza type C), picornaviruses, such as rhinovirus or hepatitis A virus, togaviruses, such as alphavirus or rubivirus, e.g. Sindbis, Semliki-Forest or rubeolavirus (measles virus), rubella virus (German measles virus), coronaviruses, in particular subtypes HCV-229E or HCV-0C43, rhabdoviruses, such as rabies virus, paramyxoviruses, such as mumps virus, reoviruses, such as group A, B or C rotavirus,
hepadnaviruses, such as hepatitis B virus,
papoviruses, such as human papillomaviruses (HPV) of any serotype, especially from 1 to 75,
adenoviruses, in particular type 1 to 47,
herpesviruses, such as Herpes simplex virus 1, 2 or 3,
cytomegalovirus (CMV), preferably CMVpp65,
Epstein Barr virus (EBV),
vaccinia viruses and
the bacterium Chiamydophila *pneumoniae* (*Chlamydia pneumoniae*).

Further examples of preferred immunogenic proteins or peptides are proteins or peptides of pathogens which only seldom infect an organism. These proteins or peptide include, for example, any structural or non-structural protein or peptide of:

Flaviviruses, such as dengue virus type 1 to 4, yellow fever virus, West Nile virus, Japanese encephalitis virus hepatitis C virus,
caliciviruses,
filoviruses, such as Ebola virus,
bornaviruses,
bunyaviruses, such as Rift Valley fever virus,
arenaviruses, such as LCMV (lymphocytic choriomeningitis virus) or hemorrhagic fever viruses,
retroviruses, such as HIV and
parvoviruses.

In a particularly preferred embodiment, the at least one RNA of the RNA containing composition is an immunostimulating RNA, preferably according to SEQ ID NOs. 5, 394, or 10072 and is combined with at least one immunogenic protein or peptide as defined above, preferably influenza nucleoprotein (NP) or a fragment or variant thereof.

4. Apoptosis Inducers:

In this context protein-based apoptosis inducers, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

Preferably, an apoptosis inducer is chosen from the group consisting of the Bcl-2 family and tumor suppressor protein p53 and ligands of transmembrane death receptors, especially the TNF (tumor necrosis factor) receptor gene superfamily, pro-apoptic receptor agonists and Beclin-1.

A particularly preferred apoptosis inducer in the context of the present invention is Beclin-1 (derived from the BECN1 gene).

Further preferred examples of apoptosis inducers may be chosen from the following list: Bcl-10, Bax, Bak, Bid, Bad, Bim, Bik, Blk, Cytochrome c, Caspases, especially Caspase 3, Caspase 6, Caspase 7, Caspase 8, Caspase 9, Death domain, especially of Fas, preferably FasL, TNFα, Apo2L/TRAIL, agonist of DR4 and/or DR5, Apo3L, DR4 agonistic antibody, DR5 agonistic antibody, protein kinase R (PKR) (preferably constitutive active PKR), Granzyme B.

In this context particularly preferred are apoptosis inducers as disclosed in Table 5 and 6 above.

In a particularly preferred embodiment, the at least one RNA of the RNA containing composition is an immunostimulating RNA, preferably according to SEQ ID NOs. 5, 394, or 10072 and is combined with at least one apoptosis inducer as defined above, or a fragment or variant thereof.

5. Angiogenesis Inhibitors

In this context protein-based angiogenesis inducers, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

Preferred examples of angiogenesis inhibitors according to the invention may be chosen from the following list: interferon alpha (IFN-α), (interferon beta) IFN-β, interferon gamma (IFN-γ), CXCL9, CXCL10, interleukin 12 (IL-12), platelet factor 4 (PF-4), tumor necrosis factor alpha (TNF-α), soluble fms-like tyrosine kinase 1 (sFLT-1), Fetal Liver Kinase 1 (FLK-1), Angiostatin, Endostatin, Vasostatin, Canstatin, Tumstatin, 16 kD prolacin fragment, tissue inhibitor of metalloproteinases 1 (TIMP-1), tissue inhibitor of metalloproteinases 2 (TIMP-2), tissue inhibitor of metalloproteinases 3 (TIMP-3), thrombospondin 1 (TSP-1), thrombospondin 2 (TSP-2), Maspin, PEX, soluble Tyrosine-protein kinase receptor 1 (sTie1), soluble Angiopoietin-1 receptor 2 (sTie2), Angiopoietin-1, Angiopoietin-2, Antivascular endothelial growth factor receptor 2 (VEGFR2) antibody (e.g. Alacizumab, Ramucirumab), Anti-vascular endothelial growth factor (VEGF) antibody (e.g. Brolucizumab, Ranibizumab, Bevacizumab), and Anti-vascular endothelial growth factor receptor 1 (VEGFR1) antibody (e.g. Icrucumab).

In this context particularly preferred are angiogenesis inhibitors as disclosed in Table 7 above.

In a particularly preferred embodiment, the at least one RNA of the RNA containing composition is an immunostimulating RNA, preferably according to SEQ ID NOs. 5, 394, or 10072 and is combined with at least one angiogenesis inhibitor as defined above, or a fragment or variant thereof.

6. Heat Shock Proteins:

In this context protein-based heat-shock proteins, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

Preferably, the heat shock protein may be chosen from the following list: HSP27, HSP47 (serpin H1), HSP60, HSP70, HSC70, GRP78 (BiP), HSP90, HSP110, GRP94 (gp96), GRP170 (ORP150), PDI/PDIA, CRT/CALR.

In this context particularly preferred are heat shock proteins as disclosed in Table 8 above.

In a particularly preferred embodiment, the at least one RNA of the RNA containing composition is an immunostimulating RNA, preferably according to SEQ ID NOs. 5, 394, or 10072 and is combined with at least one heat shock protein as defined above, or a fragment or variant thereof.

7. Tumour Antigens:

In this context protein-based tumor antigens, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

In this context particularly preferred are tumor antigens as disclosed in Table 9 above.

In a particularly preferred embodiment, the at least one RNA of the RNA containing composition is an immunostimulating RNA, preferably according to SEQ ID NOs. 5, 394, or 10072 and is combined with at least one tumor antigen as defined above, or a fragment or variant thereof.

8. β-Catenin Inhibitors:

In this context protein-based β-catenin inhibitors, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

Particular preferred β-catenin inhibitors according to the present invention comprise TAT-NLS-BLBD-6, axin-1, TCF-4, GSK-3b, DKK-1, Dvl-1 derivatives or fragments thereof.

Chemical β-Catenin Inhibitors:

According to the present invention, the at least one additional active pharmaceutical ingredient which may be contained in the inventive composition, and/or which may be co-administered, or which may be combined with the inventive composition may be a chemical β-catenin inhibitors. Chemical β-catenin inhibitors are known in the art that may be administered according to the present invention. Preferably the chemical β-catenin inhibitor is chosen from the following list: PKF118-310, CGP049090, PKF115-584, PKF222-815, PKF118-744, ICG001, CCT036477, XAV939, acyl hydrazones (HQBA), molecules with 2,3,6-trisubstituted pyrido[2,3,-b]pyrazine core skeletons, carnosic acid, CCT031374, iCRT-3,5,14, NC043, Ibuprofin, aspirin.

The following table 13 summarizes examples of small molecular inhibitors of β-catenin signaling which are particularly preferred in this context.

In a particularly preferred embodiment, the at least one RNA of the RNA containing composition is an immunostimulating RNA, preferably according to SEQ ID NOs. 5, 394, or 10072 and is combined with at least one β-catenin inhibitor as defined above, or a fragment or variant thereof.

9. Activators of the STING Pathway

In this context protein-based activators of the STING pathway, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component. Preferably, the at least one activator (stimulator) of the STING pathway is chosen from an activating protein or a constitutively active protein of the STING pathway, preferably DDX41, STING, cGAS, IRF3, TBK1 or STAT6 or a fragment or variant thereof.

Chemical STING-Pathway Activators:

In a further preferred embodiment the optional additional pharmaceutically active component may be selected from chemical activators of the STING pathway which are preferably selected from cyclic dinucleotides and xanthenone analogs.

Table 14 shows examples of chemical STING agonists. Further examples of STING agonists are disclosed in WO2014189805.

TABLE 14

Activators of STING pathway

| Class of STING activator | examples |
|---|---|
| cyclic dinucleotides | 3'3'-cGAMP, 2'3'-cGAMP, 2'2'-cGAMP, c-di-APM, c-di-GMP, c-di-IMP, c-di-UMP |
| xanthenone analogs | DMXAA, 5,6-dimethylxanthenone-4-acetic acid |

In a particularly preferred embodiment, the at least one RNA of the RNA containing composition is an immunostimulating RNA, preferably according to SEQ ID NOs. 5,

TABLE 13

β-catenin inhibitors

| Inhibitor | Target | Reference |
|---|---|---|
| PKF118-310, CGP049090, PKF115-584, PKF222-815 and PKF118-744 | beta-catenin—TCF interaction | Lepourcelet et al., 2004. Cancer Cell 5:91-102 |
| ICG001 | beta-catenin—CBP interaction | Emami et al., 2004. Proc Natl Acad Sci USA 101:12682-7 |
| CCT036477 | beta-catenin—TCF interaction | Ewan et al., 2010. Cancer Res. 70:5963-73 |
| XAV939 | Tankyrase | Huang et al., 2009. Nature 461:614-20 |
| acyl hydrazones (HQBA) | Iron chelators | Song et al., 2011. Cancer Res. 71:7628-39; Coombs et al., 2012. Oncogene 31:213-25 |
| molecules with 2,3,6-trisubstituted pyrido[2,3,-b] pyrazine core skeletons | beta-catenin | Gong et al., 2011. Bioorg Med Chem. 19:5639-47 |
| carnosic acid | beta-catenin/BCL9 | de la Roche et al., Nat Commun. 3:680 |
| CCT031374 | beta-catenin | Thorne et al., 2010. Nat Chem Biol. 6:829-36 |
| iCRT-3,5,14, NC043 | beta-catenin—TCF interaction | Wang et al., 2011. Cell Res. 21:730-40; Gonsalves et al., 2011. Proc Natl Acad Sci USA 108:5954-63 |
| Ibuprofin, aspirin | Cox2 Inhibitors | Greenspan et al., 2011. Cancer Prev Res. 4:161-71 |

394, or 10072 and is combined with at least one STING pathway activator as defined above, or a fragment or variant thereof.

10. Checkpoint Modulators

In this context protein-based checkpoint modulators, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

In preferred embodiments of the present invention the checkpoint modulator is a modulator of B7-1/CD80, B7-2/CD86, B7-H1/PD-L1, B7-H2, B7-H3, B7-H4, B7-H6, B7-H7/HHLA2, BTLA, CD28, CD28H/IGPR-1, CTLA-4, ICOS, PD-1, PD-L2/B7-DC, PDCD6, VISTA/B7-H5/PD-1H, BTN1A1/Butyrophilin, BTN2A1, BTN2A2/Butyrophilin 2A2, BTN3A1/2, BTN3A2, BTN3A3, BTNL2/Butyrophilin-like 2, BTNL3, BTNL4, BTNL6, BTNL8, BTNL9, BTNL10, CD277/BTN3A1, LAIR1, LAIR2, CD96, CD155/PVR, CRTAM, DNAM-1/CD226, Nectin-2/CD112, Nectin-3, TIGIT, LILRA3/CD85e, LILRA4/CD85g/ILT7, LILRB1/CD85j/ILT2, LILRB2/CD85d/ILT4, LILRB3/CD85a/ILT5, LILRB4/CD85k/ILT3, 4-1BB/TNFRSF9/CD137, 4-1BB Ligand/TNFSF9, BAFF/BLyS/TNFSF13B, BAFF R/TNFRSF13C, CD27/TNFRSF7, CD27 Ligand/TNFSF7, CD30/TNFRSF8, CD30 Ligand/TNFSF8, CD40/TNFRSF5, CD40 Ligand/TNFSF5, DR3/TNFRSF25, GITR/TNFRSF18, GITR Ligand/TNFSF18, HVEM/TNFRSF14, LIGHT/TNFSF14, Lymphotoxin-alpha/TNF-beta, OX40/TNFRSF4, OX40 Ligand/TNFSF4, RELT/TNFRSF19L, TACI/TNFRSF13B, TL1A/TNFSF15, TNF-alpha, TNF RII/TNFRSF1B, 2B4/CD244/SLAMF4, BLAME/SLAMF8, CD2, CD2F-10/SLAMF9, CD48/SLAMF2, CD58/LFA-3, CD84/SLAMF5, CD229/SLAMF3, CRACC/SLAMF7, NTB-A/SLAMF6, SLAM/CD150, TIM-1/KIM-1/HAVCR, TIM-3, TIM-4, CD7, CD96, CD160, CD200, CD300a/LMIR1, CRTAM, DAP12, Dectin-1/CLEC7A, DPPIV/CD26, EphB6, Integrin alpha 4 beta 1, Integrin alpha 4 beta 7/LPAM-1, LAG-3, TIM-1/KIM-1/HAVCR, TIM-4, TSLP R, or any combinations thereof.

Preferably, the checkpoint modulator is selected from agonistic antibodies, antagonistic antibodies, ligands, dominant negative receptors and decoy receptors or combinations thereof.

Preferably, the agonistic antibody is chosen from the following list: anti-4-1BB, anti-OX40, anti-GITR, anti-CD28, anti-CD27, anti-CD-40anti-ICOS, anti-TNFRSF25, and anti-LIGHT.

Preferably, the antagonistic antibody is chosen from the list of anti-CTLA4, anti-PD1, anti-PD-L1, anti-Vista, anti-Tim-3, anti-LAG-3, and anti-BTLA.

Particularly preferred are the anti-CTLA-4 antibodies ipilimumab (Yervoy®), tremelimumab, and AGEN-1884.

Particularly preferred are the anti-PD1 antibodies Nivolumab (MDX-1106/BMS-936558/ONO-4538), (Brahmer et al., 2010. J Clin Oncol. 28(19):3167-75; PMID: 20516446); Pidilizumab (CT-011), (Berger et al., 2008. Clin Cancer Res. 14(10):3044-51; PMID: 18483370); Pembrolizumab (MK-3475, SCH 900475); AMP-224, and MED10680 (AMP-514).

Particularly preferred are the anti-PD-L1 antibodies MDX-1105/BMS-936559 (Brahmer et al. 2012. N Engl J Med. 366(26):2455-65; PMID: 22658128); atezolizumab (MPDL3280A/RG7446); durvalumab (MED14736); and avelumab (MSB0010718).

According to the present invention checkpoint modulators according to Table 15 are particularly preferred:

TABLE 15

Antibodies directed against immune checkpoint proteins

| Name | Target |
|---|---|
| Urelumab | 4-1BB/CD137 |
| PF-05082566 | 4-1BB/CD137 |
| 8H9 | B7-H3 |
| Enoblituzumab | B7-H3 |
| Ipilimumab | CD152/CTLA-4 |
| Ticilimumab (=tremelimumab) | CD152/CTLA-4 |
| Tremelimumab | CD152/CTLA-4 |
| Varlilumab | CD27 |
| Teneliximab | CD40 |
| Vorsetuzumab mafodotin | CD70 |
| Lirilumab | KIR2D |
| GSK-3174998 | OX40 |
| MEDI-6469 | OX40 |
| MEDI-6383 | OX40 |
| MEDI-0562 | OX40 |
| PF-04518600 | OX40 |
| RG-7888 | OX40 |
| PF-06801591 | PD-1 |
| BGBA-317 | PD-1 |
| MEDI-0680 | PD-1 |
| MK-3475 | PD-1 |
| Nivolumab | PD-1 |
| PDR-001 | PD-1 |
| Pembrolizumab | PD-1 |
| Pidilizumab | PD-1 |
| REGN-2810 | PD-1 |
| SHR-1210 | PD-1 |
| TSR-042 | PD-1 |
| MDX-1106 | PD-1 |
| Merck 3745 | PD-1 |
| CT-011 | PD-1 |
| MEDI-0680 | PD-1 |
| PDR001 | PD-1 |
| REGN2810 | PD-1 |
| BGB-108 | PD-1 |
| BGB-A317 | PD-1 |
| AMP-224 | PD-1 |
| Atezolizumab | PD-L1 (CD274) |
| Avelumab | PD-L1 (CD274) |
| BMS-936559 | PD-L1 (CD274) |
| Durvalumab | PD-L1 (CD274) |
| MEDI-4736 | PD-L1 (CD274) |
| MPDL33280A | PD-L1 (CD274) |
| YW243.55.570 | PD-L1 (CD274) |
| MDX-1105 | PD-L1 (CD274) |
| MSB0010718C | PD-L1 (CD274) |

In a further preferred embodiment the checkpoint modulator is a decoy receptor (e.g. a soluble receptor). Preferably, the decoy receptor is a soluble PD1 receptor. In a particularly preferred embodiment the RNA sequence encoding a soluble PD1 receptor comprises an RNA sequence according to SEQ ID NO: 389

In a further preferred embodiment the checkpoint modulator is a ligand of an immune checkpoint protein. Preferably, the ligand is CD40 Ligand (CD40L).

In a particularly preferred embodiment, the at least one RNA of the RNA containing composition is an immunostimulating RNA, preferably according to SEQ ID NOs. 5, 394, or 10072 and is combined with at least one checkpoint modulator as defined above, preferably selected from an anti-CTLA4 antibody, an anti-PD1 antibody, an anti PD-L1 antibody, a CD40 ligand, or a soluble PD1 receptor, or a fragment or variant thereof.

11. Innate Immune Activators

In this context protein-based innate immune activators or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

In this context innate immune activators may be selected from mammalian, in particular human adjuvant proteins, which typically comprise any human protein or peptide, which is capable of eliciting an innate immune response (in a mammal), e.g. as a reaction of the binding of an exogenous TLR ligand to a TLR. More preferably, human adjuvant proteins are selected from the group consisting of proteins which are components and ligands of the signalling networks of the pattern recognition receptors including TLR, NLR and RLH, including TLR1, TLR2, TLR3, TLR4, TLR5, TLR6, TLR7, TLR8, TLR9, TLR10, TLR11; NOD1, NOD2, NOD3, NOD4, NOD5, NALP1, NALP2, NALP3, NALP4, NALP5, NALP6, NALP6, NALP7, NALP7, NALP8, NALP9, NALP10, NALP11, NALP12, NALP13, NALP14, I IPAF, NAIP, CIITA, RIG-I, MDA5 and LGP2, the signal transducers of TLR signaling including adaptor proteins including e.g. Trif and Cardif; components of the Small-GTPases signalling (RhoA, Ras, Rac1, Cdc42, Rab etc.), components of the PIP signalling (PI3K, Src-Kinases, etc.), components of the MyD88-dependent signalling (MyD88, IRAK1, IRAK2, IRAK4, TIRAP, TRAF6 etc.), components of the MyD88-independent signalling (TI-CAM1, TICAM2, TRAF6, TBK1, IRF3, TAK1, IRAK1 etc.); the activated kinases including e.g. Akt, MEKK1, MKK1, MKK3, MKK4, MKK6, MKK7, ERK1, ERK2, GSK3, PKC kinases, PKD kinases, GSK3 kinases, JNK, p38MAPK, TAK1, IKK, and TAK1; the activated transcription factors including e.g. NF-κB, c-Fos, c-Jun, c-Myc, CREB, AP-1, Elk-1, ATF2, IRF-3, IRF-7.

Mammalian, in particular human adjuvant proteins may furthermore be selected from the group consisting of heat shock proteins, such as HSP10, HSP60, HSP65, HSP70, HSP75 and HSP90, gp96, Fibrinogen, TypIII repeat extra domain A of fibronectin; or components of the complement system including C1q, MBL, C1r, C1s, C2b, Bb, D, MASP-1, MASP-2, C4b, C3b, C5a, C3a, C4a, C5b, C6, C7, C8, C9, CR1, CR2, CR3, CR4, C1qR, C1INH, C4bp, MCP, DAF, H, I, P and CD59, or induced target genes including e.g. Beta-Defensin, cell surface proteins; or human adjuvant proteins including trif, flt-3 ligand, Gp96 or fibronectin, etc., or any species homolog of any of the above human adjuvant proteins. Furthermore HGMB1 may be used as adjuvant protein.

Mammalian, in particular human adjuvant proteins may furthermore comprise cytokines which induce or enhance an innate immune response, including IL-1 alpha, IL1 beta, IL-2, IL-6, IL-7, IL-8, IL-9, IL-12, IL-13, IL-15, IL-16, IL-17, IL-18, IL-21, IL-23, TNFalpha, IFNalpha, IFNbeta, IFNgamma, GM-CSF, G-CSF, M-CSF; chemokines including IL-8, IP-10, MCP-1, MIP-1alpha, RANTES, Eotaxin, CCL21; cytokines which are released from macrophages, including IL-1, IL-6, IL-8, IL-12 and TNF-alpha; as well as IL-1R1 and IL-1 alpha.

Therefore in this context it particularly preferred that the at least innate immune activator, is preferably an adjuvant protein, more preferably a human adjuvant protein, or a fragment or variant thereof.

In this context it is particularly preferred that I constitutive active variant of an adjuvant protein is used as innate immune activator, preferably a constitutive active variant of RIG-1 (ΔRIGI).

In another preferred embodiment the at least one innate immune activator is HGMB1, or a fragment or variant thereof.

In this context particularly preferred are innate immune activators as disclosed in Table 11 above.

In a particularly preferred embodiment, the at least one RNA of the RNA containing composition is an immunostimulating RNA, preferably according to SEQ ID NOs. 5, 394, or 10072 and is combined with at least one innate immune activator as defined above, or a fragment or variant thereof.

12. Antibodies, Decoy Receptors and Dominant Negative Receptors

In this context protein-based antibodies, decoy receptors, or dominant negative receptors or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

According to the present invention antibodies according to Table 16 are particularly preferred:

TABLE 16

Antibodies directed against proteins accociated with tumor or cancer development

| Name | Target |
|---|---|
| 3F8 | GD2 |
| Abagovomab | CA-125 imitation |
| Abciximab | Platelet glycoprotein GPIIb/IIIa |
| Adecatumumab | EpCAM (CD326) |
| Afutuzumab | CD20 |
| Alacizumab pegol | VEGFR2 |
| Alemtuzumab | CD52 |
| Altumomab pentetate | CEA |
| Amatuximab | mesothelin |
| Anatumomab mafenatox | 5T4 |
| Anetumab ravtansine | mesothelin |
| Apolizumab | HLA-DR beta |
| apomab | TRAIL-R2 (CD262) |
| Arcitumomab | CEA |
| Ascrinvacumab | ACVRL1 |
| Bavituximab | phosphatidylserine |
| Bectumomab | CD22 |
| Belimumab | BAFF |
| Besilesomab | CEA |
| Bevacizumab | VEGF-A |
| Bivatuzumab mertansine | CD44v6 |
| Blinatumomab | CD19 × CD3 |
| Brentuximab vedotin | CD30 (TNFRSF8) |
| Brontictuzumab | NOTCH1 |
| canakinumab | IL-1β |
| Cantuzumab mertansine | CanAg |
| Cantuzumab ravtansine | MUC1 (CD227) |
| Capromab pendetide | PSMA |
| Carlumab | MCP-1 |
| Catumaxomab | EpCAM × CD3 |
| cBR-doxorubicin immunoconjugate | CD174 (Lewis Y) |
| Cetuximab | EGFR (HER1/ERBB1) |
| Citatuzumab bogatox | EpCAM |
| Cixutumumab | IGF-1R |
| Clivatuzumab tetraxetan | MUC1 (CD227) |
| Codrituzumab | glypican 3 |
| Coltuximab ravtansine | CD19 |
| Conatumumab | TRAIL-R2 (CD262) |
| Dacetuzumab | CD40 |
| Dalotuzumab | IGF-1R |
| Dalotuzumab | insulin-like growth factor I receptor |
| Daratumumab | CD38 (cyclic ADP ribose hydrolase) |
| Demcizumab | DLL4 |
| Denintuzumab mafodotin | CD19 |
| Denosumab | RANKL |
| Depatuxizumab | EGFR (HER1/ERBB1) |

TABLE 16-continued

Antibodies directed against proteins accociated with tumor or cancer development

| Name | Target |
|---|---|
| Derlotuximab | histone complex |
| Detumomab | unknown (B-lymphoma cells) |
| Dinutuximab | B4GALNT1 |
| Drozitumab | TRAIL-R2 (CD262) |
| Duligotuxab | HER3 (ERBB3) |
| Duligotuzumab | EGFR (HER1/ERBB1) |
| Dusigitumab | ILGF2 |
| Ecromeximab | GD3 ganglioside |
| Edrecolomab | EpCAM |
| Elgemtumab | ERBB3 |
| Elotuzumab | SLAMF7 (CD319) |
| Elsilimomab | IL-6 |
| Emactuzumab | CSF1R |
| Emibetuzumab | HGFR |
| Emibetuzumab | MET |
| Enavatuzumab | TNFRSF12A |
| Enfortumab vedotin | AGS-22M6 |
| Enoticumab | DLL4 |
| Ensituximab | MUC5AC |
| Epitumomab cituxetan | MUC1 (CD227) |
| Epratuzumab | CD22 |
| Ertumaxomab | HER2 (ERBB2/neu) × CD3 |
| Etaracizumab | integrin α5β3 |
| Faralimomab | IFNA1 |
| Farletuzumab | FOLR1 alpha |
| FBTA | CD20 × CD3 |
| Ficlatuzumab | HGFR |
| Figitumumab | IGF-1R |
| Flanvotumab | TYRP1(glycoprotein 75) |
| Fresolimumab | TGF-β |
| Futuximab | EGFR (HER1/ERBB1) |
| Galiximab | CD80 |
| Gantinumab | IGF-1R |
| Gemtuzumab ozogamicin | CD33 |
| Girentuximab | Carbonic anhydrase 9 (CA9/CAIX) |
| Glembatumumab vedotin | GPNMB |
| glycooptimized trastuzumab-GEX | HER2 (ERBB2/neu) |
| Ibritumomab tiuxetan | CD20 |
| Icrucumab | VEGFR-1 |
| Igovomab | MUC16 |
| IMAB362 | Claudin-18 (CLDN18.2) |
| Imgatuzumab | EGFR (HER1/ERBB1) |
| Indatuximab ravtansine | SDC1 |
| Indusatumab vedotin | GUCY2C |
| inebilizumab | CD19 |
| Inotuzumab ozogamicin | CD22 |
| Intetumumab | CD51 |
| Iratumumab | CD30 (TNFRSF8) |
| Isatuximab | CD38 |
| Labetuzumab | CEA |
| Lenzilumab | CSF2 |
| Lexatumumab | TRAIL-R2 (CD262) |
| Lifastuzumab vedotin | NaPi2B |
| Lilotomab satetraxetan | CD37 |
| Lintuzumab | CD33 |
| Lorvotuzumab mertansine | CD56 |
| Lucatumumab | CD40 |
| Lumiliximab | CD23 (IgE receptor) |
| Lumretuzumab | ERBB3 |
| Mapatumumab | TRAIL-R1 (CD261) |
| Margetuximab | HER2 (ERBB2/neu) |
| Matuzumab | EGFR (HER1/ERBB1) |
| Mepolizumab | IL-5 |
| Milatuzumab | CD74 |
| Minretumomab | TAG-72 |
| Mirvetuximab soravtansine | FOLR1 alpha |
| Mitumomab | GD3 (ganglioside) |
| Mogamulizumab | CCR4 |
| Moxetumomab pasudotox | CD22 |
| Nacolomab tafenatox | C242 antigen |
| Naptumomab estafenatox | 5T4 |
| Narnatumab | RON |
| Necitumumab | EGFR (HER1/ERBB1) |
| Nesvacumab | ANGPT2 (angiopoietin 2) |
| Nimotuzumab | EGFR (HER1/ERBB1) |
| Nofetumomab merpentan | EpCAM |
| binutuzumab | CD20 |
| Ocaratuzumab | CD20 |
| Ofatumumab | CD20 |
| Olaratumab | PDGFRα |
| Onartuzumab | MET |
| Ontuxizumab | CD248 (TEM1) |
| Oportuzumab monatox | EpCAM |
| Oregovomab | CA-125 |
| Otlertuzumab | CD37 |
| Panitumumab | EGFR (HER1/ERBB1) |
| Pankomab | MUC1 (tumor specific glycosylation) |
| Parsatuzumab | EGFL7 |
| Pasotuxizumab | FOLH1 |
| Patritumab | HER3 (ERBB3) |
| Pemtumomab | MUC1 (CD227) |
| Pertuzumab | HER2 (ERBB2/neu) |
| Pinatuzumab vedotin | CD22 |
| Pintumomab | adenocarcinoma antigen |
| Polatuzumab vedotin | CD79B |
| Racotumomab | NGcGM3 |
| Radretumab | EDB (fibronectin extra domain-B) |
| Ramucirumab | VEGFR2 |
| Rilotumumab | HGFR |
| Rituximab | CD20 |
| Robatumumab | IGF-1R |
| Sacituzumab govitecan | Trop-2 (tumor-associated calcium signal transducer 2/EGP-1) |
| Samalizumab | CD200 (OX-2 membrane glycoprotein) |
| Satumomab pendetide | TAG-72 |
| Seribantumab | ERBB3 |
| Seribantumab | HER3 (ERBB3) |
| SGN-CDA | CD19 |
| SGN-CDA | CD33 |
| Sibrotuzumab | FAP |
| Siltuximab | IL-6 |
| Simtuzumab | LOXL2 |
| Sofituzumab vedotin | CA 125 |
| Solitomab | EpCAM |
| Sonepcizumab | S1P (sphingosine-1-phosphate) |
| Tacatuzumab tetraxetan | AFP (alpha-fetoprotein) |
| Taplitumomab paptox | CD19 |
| Tarextumab | Notch receptor |
| Tenatumomab | TN-C (tenascin C) |
| Teprotumumab | CD221 |
| Tetulomab | CD37 |
| TGN | CD28 |
| Tigatuzumab | TRAIL-R2 (CD262) |
| Lebrikizumab | IL-13 |
| Tocilizumab | IL-6R |
| Tositumomab | CD20 |
| Tovetumab | CD140a |
| Tovetumab | PDGFRα |
| Trastuzumab | HER2 (ERBB2/neu) |
| Trastuzumab emtansine | HER2 (ERBB2/neu) |
| TRBS | GD2 |
| Tucotuzumab celmoleukin | EpCAM |
| ublituximab | CD20 |
| Ublituximab | MS4A1 |
| Ulocuplumab | CXCR4 |
| Vandortuzumab vedotin | STEAP1 |
| Vantictumab | FZD7 |
| Vanucizumab | Ang-2 (angiopoietin 2) × VEGF-A |
| Veltuzumab | CD20 |
| Vesencumab | NRP1 |
| Volociximab | integrin α5β1 |
| Votumumab | CTAA16.88 |
| Zalutumumab | EGFR (HER1/ERBB1) |
| Zanolimumab | CD4 |
| Zatuximab | HER1 (EGFR/ERBB1) |

Preferably, the neutralizing antibody is chosen from the list of anti-IL-10 and anti-TGFbeta.

In a particularly preferred embodiment, the at least one RNA of the RNA containing composition is an immunostimulating RNA, preferably according to SEQ ID NOs. 5, 394, or 10072 and is combined with at least one antibody, preferably anti-CD73 antibody or at least one decoy receptor as defined above, or a fragment or variant thereof.

Furthermore, the at least one antibody may preferably chosen from anti-CD73 antibodies or fragments or variants thereof.

In a further particularly preferred embodiment the at least one antibody is chosen from an antibody directed against CCR5/CD195 or from an antibody directed against its ligand CCL5/RANTES or fragments or variants thereof.

In a particularly preferred embodiment the decoy receptor is a soluble CCR5 (chemokine receptor type 5, also known as CD195).

In a particularly preferred embodiment the dominant negative receptor is dominant negative CCR5 (chemokine receptor type 5, also known as CD195).

13. Inhibitors of Myeloid Derived Suppressor Cells (MDSCs)

In this context protein-based inhibitors of myeloid derived suppressor cells (MDSCs), or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

It is particularly preferred to use anti IL-17 antibodies and IL-12 as inhibitors of MDSCs.

In the context of the invention, MDSC inhibition can be achieved by direct deactivation of MDSCs (e.g., chemical NO inhibitors (PDE-5 inhibitors, NO-aspirins, L-NAME), Arginase inhibitors (PDE-5 inhibitors, COX2 inhibitors, NOHA, L-NAME), ROS inhibitors (synthetic Triterpenoids)), by blocking differentiation of MDSCs into mature cells (e.g., ATRA, Vitamin A, Vitamin D3, CpG), by blocking the cell development of MDSCs (e.g. bisphosphorates (zolodronic acid), modulators of cell signaling (JAK2/STAT3 inhibitors, Multi-Kinase inhibitors, VEGF inhibitors)), or by depletion of MDSCs (e.g., cytotoxic agents (gemcitabine, cisplatin, paclitaxel, 5-fluorouracil) or HSP 90 inhibitors (17-DMAG)). Therefore these compounds may also be used as additional pharmaceutically active compound.

In a particularly preferred embodiment, the at least one RNA of the RNA containing composition is an immunostimulating RNA, preferably according to SEQ ID NOs. 5, 394, or 10072 and is combined with at least one inhibitor of MDSCs as defined above, or a fragment or variant thereof.

14. IDO Pathway Inhibitors

In this context protein-based IDO pathway inhibitors, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

Chemical IDO Pathway Inhibitor:

In a further preferred embodiment the additional pharmaceutically active component may be selected from an IDO pathway inhibitor, which is preferably selected from small molecule inhibitor. Preferably the IDO pathway inhibitor is chosen from the following list: Indoximod (the D isomer of 1-methyl-tryptophan) and NLG919).

In a particularly preferred embodiment, the at least one RNA of the RNA containing composition is an immunostimulating RNA, preferably according to SEQ ID NOs. 5, 394, or 10072 and is combined with at least one IDO pathway inhibitor as defined above, or a fragment or variant thereof.

15. Proteins or Peptides that Bind Inhibitors of Apoptosis

Apoptosis is a tightly regulated cellular process and faulty regulation of apoptosis is a hallmark of human cancers. Targeting key apoptosis regulators with the goal to restore apoptosis in tumor cells has been pursued as a new cancer therapeutic strategy. XIAP, cIAP1, and cIAP2, members of inhibitor of apoptosis (IAP) proteins, are critical regulators of cell death and survival and are attractive targets for new cancer therapy. The SMAC/DIABLO protein is an endogenous antagonist of XIAP, cIAP1, and cIAP2. In the last decade, intense research efforts have resulted in the design and development of several small-molecule SMAC mimetics now in clinical trials for cancer treatment In a further preferred embodiment, the inventive composition comprises at least one molecule that binds inhibitors of apoptosis proteins (IAPB) and thus sensitize cancer cells to apoptotic death.

Therefore it is particularly preferred that the inventive RNA containing composition comprises at least one molecule that binds inhibitors of apoptosis, such as SMAC mimetics.

Particularly preferred proteins or peptides that bind IAPB according to the present invention comprise Omi/HtrA2, Smac, Smac derived peptides, Smac/DIABLO, and XAF1 (XIAP-associated factor 1) and fragments or variants thereof.

In this context proteins or peptides that bind inhibitors of apoptosis, or fragments and variants thereof as disclosed above in the context of "coding RNA" may be used as additional pharmaceutically active component. Alternatively, nucleic acids encoding these proteins or peptides or fragments or variants thereof may be used as additional pharmaceutically active component.

Therefore it is particularly preferred that the additional pharmaceutically active component is selected from proteins or peptides that bind inhibitors of apoptosis, such as SMAC mimetics. Furthermore it is particularly preferred that such SMAC mimetics used as additional pharmaceutically active component are small molecules inhibiting inhibitors of apoptosis.

In a particularly preferred embodiment, the at least one RNA of the RNA containing composition is an immunostimulating RNA, preferably according to SEQ ID NOs. 5, 394, or 10072 and is combined with at least one proteins or peptides that bind inhibitors of apoptosis as defined above, or a fragment or variant thereof.

16. Anti-Bacterial Agent:

According to the present invention, the at least one additional pharmaceutically active component which may be contained in the inventive composition, and/or which may be co-administered, may be an anti-bacterial agent. In this context, any anti-bacterial agents known to one of skill in the art may be used in combination with the components of the inventive composition as defined herein. Non-limiting examples of anti-bacterial agents include Amikacin, Amoxicillin, Amoxicillin-clavulanic acid, Amphothericin-B, Ampicillin, Ampicllin-sulbactam, Apramycin, Azithromycin, Aztreonam, Bacitracin, Benzylpenicillin, Caspofungin, Cefaclor, Cefadroxil, Cefalexin, Cefalothin, Cefazolin, Cefdinir, Cefepime, Cefixime, Cefmenoxime, Cefoperazone, Cefoperazone-sulbactam, Cefotaxime, Cefoxitin, Cefbirome, Cefpodoxime, Cefpodoxime-clavulanic acid, Cefpodoxime-sulbactam, Cefbrozil, Cefquinome, Ceftazidime, Ceftibutin, Ceftiofur, Ceftobiprole, Ceftriaxon, Cefuroxime, Chloramphenicole, Florfenicole, Ciprofloxacin, Clarithromycin, Clinafloxacin, Clindamycin, Cloxacillin, Colistin, Cotrimoxazol (Trimthoprim/sulphamethoxazole), Dalbavancin, Dalfopristin/Quinopristin, Daptomycin, Dibekacin, Dicloxacillin, Doripenem, Doxycycline, Enrofloxacin, Ertapenem, Erythromycin, Flucloxacillin, Fluconazol, Flucytosin, Fosfomycin, Fusidic acid, Garenoxacin, Gatifloxacin, Gemifloxacin, Gentamicin, Imipenem, Itraconazole, Kanamycin, Ketoconazole, Levofloxacin, Lincomycin, Linezolid, Loracarbef, Mecillnam (amdinocillin), Meropenem, Metronidazole, Meziocillin, Mezlocillin-sulbactam, Minocycline, Moxifloxacin, Mupirocin, Nalidixic acid, Neomycin, Netilmicin, Nitrofurantoin, Norfloxacin, Ofloxacin, Oxacillin, Pefloxacin, Penicillin V, Piperacillin, Piperacillin-sulbactam, Piperacillin-tazobactam, Rifampicin, Roxythromycin, Sparfloxacin, Spectinomycin, Spiramycin, Streptomycin, Sulbactam, Sulfamethoxazole, Teicoplanin, Telavancin, Telithromycin, Temocillin, Tetracyklin, Ticarcillin, Ticarcillin-clavulanic acid, Tigecycline, Tobramycin, Trimethoprim, Trovafloxacin, Tylosin, Vancomycin, Virginiamycin, and Voriconazole.

17. Anti-Viral Agents:

According to the present invention, the at least one additional pharmaceutically active component/compound, which may be contained in the inventive composition, and/or which may be co-administered, may be an anti-viral agents, preferably, but are not limited to, nucleoside analogs (e.g., zidovudine, acyclovir, gangcyclovir, vidarabine, idoxuridine, trifluridine, and ribavirin), foscarnet, amantadine, peramivir, rimantadine, saquinavir, indinavir, ritonavir, alpha-interferons and other interferons, AZT, t-705, zanamivir (Relenza®), and oseltamivir)(Tamiflu®). Other anti-viral agents include influenza virus vaccines, e.g., Fluarix® (Glaxo SmithKline), FluMist® (MedImmune Vaccines), Fluvirin® (Chiron Corporation), Flulaval® (GlaxoSmithKline), Afluria® (CSL Biotherapies Inc.), Agriflu® (Novartis) or Fluzone® (Aventis Pasteur).

18. Drugs:

In some embodiments, the additional pharmaceutically active component/compound may include at least one drug. The term "drug" is intended to include any substance that, when introduced or absorbed into the body of a living organism, alters normal bodily or cellular function. Some non-limiting examples of suitable drugs, including combinations and alternative forms of the drugs such as alternative salt forms, free acid form, free base forms, pro-drugs and hydrates, include: analgesics/antipyretics (e.g., aspirin, acetaminophen, ibuprofen, naproxen sodium, buprenorphine, propoxyphene hydrochloride, propoxyphene napsylate, meperidine hydrochloride, hydromorphone hydrochloride, morphine, oxycodone, codeine, dihydrocodeine bitartrate, pentazocine, hydrocodone bitartrate, levorphanol, diflunisal, trolamine salicylate, nalbuphine hydrochloride, mefenamic acid, butorphanol, choline salicylate, butalbital, phenyltoloxamine citrate, diphenhydramine citrate, methotrimeprazine, cinnamedrine hydrochloride, and meprobamate); antiasthmatics (e.g., ketotifen and traxanox); antibiotics (e.g., neomycin, streptomycin, chloramphenicol, cephalosporin, ampicillin, penicillin, tetracycline, and ciprofloxacin); antidepressants (e.g., nefopam, oxypertine, doxepin, amoxapine, trazodone, amitriptyline, maprotiline, phenelzine, desipramine, nortriptyline, tranylcypromine, fluoxetine, imipramine, imipramine pamoate, isocarboxazid, trimipramine, and protriptyline); antidiabetics (e.g., biguanides and sulfonylurea derivatives); antifungal agents (e.g., griseofulvin, ketoconazole, itraconazole, amphotericin B, nystatin, and candicidin); antihypertensive agents (e.g., propanolol, propafenone, oxyprenolol, nifedipine, reserpine, trimethaphan, phenoxybenzamine, pargyline hydrochloride, deserpidine, diazoxide, guanethidine monosulfate, minoxidil, rescinnamine, sodium nitroprusside, rauwolfia serpentine, alseroxylon, and phentolamine); anti-inflammatories (e.g., (non-steroidal) indomethacin, ketoprofen, flurbiprofen, naproxen, ibuprofen, ramifenazone, piroxicam, (steroidal) cortisone, dexamethasone, fluazacort, deflazacort, celecoxib, rofecoxib, hydrocortisone, prednisolone, and prednisone); antineoplastics (e.g., cyclophosphamide, actinomycin, bleomycin, dactinomycin, daunorubicin, doxorubicin, epirubicin, mitomycin, methotrexate, fluorouracil, gemcitabine, carboplatin, carmustine (BCNU), methyl-CCNU, cisplatin, etoposide, camptothecin and derivatives thereof, phenesterine, paclitaxel and derivatives thereof, docetaxel and derivatives thereof, vinblastine, vincristine, goserelin, leuprolide, tamoxifen, interferon alfa, retinoic acid (ATRA), nitrogen mustard alkylating agents, and piposulfan); antianxiety agents (e.g., lorazepam, buspirone, prazepam, chlordiazepoxide, oxazepam, clorazepate dipotassium, diazepam, hydroxyzine pamoate, hydroxyzine hydrochloride, alprazolam, droperidol, halazepam, chlormezanone, and dantrolene); immunosuppressive agents (e.g., cyclosporine, azathioprine, mizoribine, and FK506 (tacrolimus)); antimigraine agents (e.g., ergotamine, propanolol, isometheptene mucate, and dichloralphenazone); sedatives/hypnotics (e.g., barbiturates such as pentobarbital, pentobarbital, and secobarbital; and benzodiazapines such as flurazepam hydrochloride, triazolam, and midazolam); antianginal agents (e.g., beta-adrenergic blockers; calcium channel blockers such as nifedipine, and diltiazem; and nitrates such as nitroglycerin, isosorbide dinitrate, pentearythritol tetranitrate, and erythrityl tetranitrate); antipsychotic agents (e.g., haloperidol, loxapine succinate, loxapine hydrochloride, thioridazine, thioridazine hydrochloride, thiothixene, fluphenazine, fluphenazine decanoate, fluphenazine enanthate, trifluoperazine, chlorpromazine, perphenazine, lithium citrate, and prochlorperazine); antimanic agents (e.g., lithium carbonate); antiarrhythmics (e.g., bretylium tosylate, esmolol, verapamil, amiodarone, encamide, digoxin, digitoxin, mexiletine, disopyramide phosphate, procainamide, quinidine sulfate, quinidine gluconate, quinidine polygalacturonate, flecamide acetate, tocamide, and lidocaine); antiarthritic agents (e.g., phenylbutazone, sulindac, penicillanine, salsalate, piroxicam, azathioprine, indomethacin, meclofenamate, gold sodium thiomalate, ketoprofen, auranofin, aurothioglucose, and tolmetin sodium); antigout agents (e.g., colchicine, and allopurinol); anticoagulants (e.g., heparin, heparin sodium, and warfarin sodium); thrombolytic agents (e.g., urokinase, streptokinase, and alteplase); antifibrinolytic agents (e.g., aminocaproic acid); hemorheologic agents (e.g., pentoxifylline); antiplatelet agents (e.g., aspirin); anticonvulsants (e.g., valproic acid, divalproex sodium, phenyloin, phenyloin sodium, clonazepam, primidone, phenobarbital, carbamazepine, amobarbital sodium, methsuximide, metharbital, mephobarbital, mephenyloin, phensuximide, paramethadione, ethotoin, phenacemide, secobarbital sodium, clorazepate dipotassium, and trimethadione); antiparkinson agents (e.g., ethosuximide); antihistamines/antipruritics (e.g., hydroxyzine, diphenydramine, chlorpheniramine, brompheniramine maleate, cyproheptadine hydrochloride, terfenadine, clemastine fumarate, triprolidine, carbinoxamine, diphenylpyraline, phenindamine, azatadine, tripelennamine, dexchlorpheniramine maleate, methdilazine, and); agents useful for calcium regulation (e.g., calcitonin, and parathyroid hormone);

antibacterial agents (e.g., amikacin sulfate, aztreonam, chloramphenicol, chloramphenicol palmitate, ciprofloxacin, clindamycin, clindamycin palmitate, clindamycin phosphate, metronidazole, metronidazole hydrochloride, gentamicin sulfate, lincomycin hydrochloride, tobramycin sulfate, vancomycin hydrochloride, polymyxin B sulfate, colistimethate sodium, and colistin sulfate); antiviral agents (e.g., interferon alpha, beta or gamma, zidovudine, amantadine hydrochloride, ribavirin, and acyclovir); antimicrobials (e.g., cephalosporins such as cefazolin sodium, cephradine, cefaclor, cephapirin sodium, ceftizoxime sodium, cefoperazone sodium, cefotetan disodium, cefuroxime axetil, cefotaxime sodium, cefadroxil monohydrate, cephalexin, cephalothin sodium, cephalexin hydrochloride monohydrate, cefamandole nafate, cefoxitin sodium, cefonicid sodium, ceforanide, ceftriaxone sodium, ceftazidime, cefadroxil, cephradine, and cefuroxime sodium; penicillins such as ampicillin, amoxicillin, penicillin G benzathine, cyclacillin, ampicillin sodium, penicillin G potassium, penicillin V potassium, piperacillin sodium, oxacillin sodium, bacampicillin hydrochloride, cloxacillin sodium, ticarcillin disodium, azlocillin sodium, carbenicillin indanyl sodium, penicillin G procaine, methicillin sodium, and nafcillin sodium; macrolides such as, azithromycin, clarithromycin, and erythromycins such as erythromycin ethylsuccinate, erythromycin, erythromycin estolate, erythromycin lactobionate, erythromycin stearate, and erythromycin ethylsuccinate; and tetracyclines such as tetracycline hydrochloride, doxycycline hyclate, and minocycline hydrochloride); anti-infectives (e.g., GM-CSF); bronchodilators (e.g., sympathomimetics such as epinephrine hydrochloride, metaproterenol sulfate, terbutaline sulfate, isoetharine, isoetharine mesylate, isoetharine hydrochloride, albuterol sulfate, albuterol, bitolterolmesylate, isoproterenol hydrochloride, terbutaline sulfate, epinephrine bitartrate, metaproterenol sulfate, epinephrine, and epinephrine bitartrate; anticholinergic agents such as ipratropium bromide; xanthines such as aminophylline, dyphylline, metaproterenol sulfate, and theophylline; mast cell stabilizers such as cromolyn sodium; inhalant corticosteroids such as beclomethasone dipropionate (BDP), and beclomethasone dipropionate monohydrate; salbutamol; ipratropium bromide; budesonide; salmeterol; xinafoate; triamcinolone; nedocromil sodium; flunisolide; fluticasone propionate; steroidal compounds and hormones (e.g., androgens such as danazol, testosterone cypionate, fluoxymesterone, ethyltestosterone, testosterone enathate, methyltestosterone; estrogens such as estradiol, estropipate, and conjugated estrogens; progestins such as methoxyprogesterone acetate, and norethindrone acetate; corticosteroids such as triamcinolone, betamethasone, betamethasone sodium phosphate, dexamethasone, dexamethasone sodium phosphate, dexamethasone acetate, prednisone, methylprednisolone acetate suspension, triamcinolone acetonide, methylprednisolone, prednisolone sodium phosphate, methylprednisolone sodium succinate, hydrocortisone sodium succinate, triamcinolone hexacetonide, hydrocortisone, hydrocortisone cypionate, prednisolone, fludrocortisone acetate, paramethasone acetate, prednisolone tebutate, prednisolone acetate, prednisolone sodium phosphate, and thyroid hormones such as levothyroxine sodium); hypoglycemic agents (e.g., human insulin, purified beef insulin, purified pork insulin, glyburide, metformin, chlorpropamide, glipizide, tolbutamide, and tolazamide); hypolipidemic agents (e.g., clofibrate, dextrothyroxine sodium, probucol, pravastitin, atorvastatin, lovastatin, and niacin); proteins (e.g., DNase, alginase, superoxide dismutase, and lipase); nucleic acids (e.g., anti-sense nucleic acids); agents useful for erythropoiesis stimulation (e.g., erythropoietin); antiulcer/antireflux agents (e.g., famotidine, cimetidine, and ranitidine hydrochloride); antinauseants/antiemetics (e.g., meclizine hydrochloride, nabilone, prochlorperazine, dimenhydrinate, promethazine hydrochloride, thiethylperazine, and scopolamine); as well as other drugs useful in the compositions and methods described herein include mitotane, halonitrosoureas, anthrocyclines, ellipticine, ceftriaxone, ketoconazole, ceftazidime, oxaprozin, valacyclovir, urofollitropin, famciclovir, flutamide, enalapril, itraconazole, buspirone, gabapentin, fosinopril, tramadol, acarbose, lorazepam, follitropin, omeprazole, fluoxetine, lisinopril, tramadol, levofloxacin, zafirlukast, interferon, growth hormone, interleukin, erythropoietin, granulocyte stimulating factor, nizatidine, bupropion, perindopril, erbumine, adenosine, alendronate, alprostadil, benazepril, betaxolol, bleomycin sulfate, dexfenfluramine, diltiazem, fentanyl, flecamide, gemcitabine, glatiramer acetate, granisetron, lamivudine, mangafodipir trisodium, mesalamine, metoprolol fumarate, metronidazole, miglitol, moexipril, monteleukast, octreotide acetate, olopatadine, paricalcitol, somatropin, sumatriptan succinate, tacrine, verapamil, nabumetone, trovafloxacin, dolasetron, zidovudine, finasteride, tobramycin, isradipine, tolcapone, enoxaparin, fluconazole, lansoprazole, terbinafine, pamidronate, didanosine, diclofenac, cisapride, venlafaxine, troglitazone, fluvastatin, losartan, imiglucerase, donepezil, olanzapine, valsartan, fexofenadine, calcitonin, and ipratropium bromide. In some embodiments, the drug may be water soluble. In some embodiments, the drug may not be water soluble 19. Combination with Standard Therapy According to the present invention, the at least one additional pharmaceutically active component/compound which may be contained in the inventive composition, and/or which may be co-administered, may be selected from any standard therapy used for the treatment of the particular tumor or cancer disease, e.g any chemotherapy, checkpoint modulator, kinase inhibitor etc.

Adjuvants and Further Components:

According to the present invention, the at least one additional pharmaceutically active component/compound which may be contained in the inventive composition, and/or which may be co-administered may be an adjuvant. According to a specific embodiment, the inventive composition may comprise an adjuvant. In this context, an adjuvant may be understood as any compound, which is suitable to initiate or increase an immune response of the innate immune system, i.e. a non-specific immune response. With other words, when administered, the inventive composition preferably elicits an innate immune response due to the adjuvant, optionally contained therein. Preferably, such an adjuvant may be selected from an adjuvant known to a skilled person and suitable for the present case, i.e. supporting the induction of an innate immune response in a mammal.

Particularly preferred as adjuvants suitable for depot and delivery are cationic or polycationic compounds as defined above for the RNA of the inventive composition as vehicle, transfection or complexation agent.

Furthermore, the inventive composition may comprise one or more additional adjuvants which are suitable to initiate or increase an immune response of the innate immune system, i.e. a non-specific immune response, particularly by binding to pathogen-associated molecular patterns (PAMPs). With other words, when administered, the pharmaceutical composition preferably elicits an innate immune response due to the adjuvant, optionally contained therein. Preferably, such an adjuvant may be selected from an adjuvant known to a skilled person and suitable for the present case, i.e. supporting the induction of an innate immune response in a mammal.

Also such an adjuvant may be selected from any adjuvant known to a skilled person and suitable for the present case, i.e. supporting the induction of an innate immune response in a mammal and/or suitable for depot and delivery of the components of the inventive composition. Preferred as adjuvants suitable for depot and delivery are cationic or polycationic compounds as defined above. Likewise, the adjuvant may be selected from the group consisting of, e.g., cationic or polycationic compounds as defined above, from chitosan, TDM, MDP, muramyl dipeptide, pluronics, alum solution, aluminium hydroxide, ADJUMERTM (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINETM (propanediamine); BAY R1005TM ((N-(2-deoxy-2-L-leucylaminob-D-glucopyranosyl)-N-octadecyl-dodecanoyl-amide hydroacetate); CALCITRIOLTM (1-alpha,25-dihydroxy-vitamin D3); calcium phosphate gel; CAPTM (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i)N-acetylglucosaminyl-(P1-4)-N-acetylmuramyl-L-alanyl-D35 glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L47 alanyl-D-isoglutamine); imiquimod (1-(2-methypropyl)-1H-imidazo[4,5-c]quinoline-4-amine); ImmTherTM (N-acetylglucosaminyl-N-acetylmuramyl-L-Ala-D-isoGlu-L-Ala-glycerol dipalmitate); DRVs (immunoliposomes prepared from dehydration-rehydration vesicles); interferongamma; interleukin-1beta; interleukin-2; interleukin-7; interleukin-12; ISCOMSTM; ISCOPREP 7.0.3. TM; liposomes; LOXORIBINETM (7-allyl-8-oxoguanosine); LT 5 oral adjuvant (*E. coli* labile enterotoxin-protoxin); microspheres and microparticles of any composition; MF59TM; (squalenewater emulsion); MONTANIDE ISA 51TM (purified incomplete Freund's adjuvant); MONTANIDE ISA 720TM (metabolisable oil adjuvant); MPLTM (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDETM (Nac-Mur-L-Ala-D-Gln-OCH3); MURAPALMITINETM and DMURAPALMITINETM (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURANTM (β-glucan); PLGA, PGA and PLA (homo- and co-polymers of lactic acid and glycolic acid; microspheres/nanospheres); PLURONIC L121TM; PMMA (polymethylmethacrylate); PODDSTM (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULONTM (QS-21); Quil-A (Quil-A saponin); S-28463 (4-amino-otec-dimethyl-2-ethoxymethyl-1H-imidazo[4,5-c]quinoline-1-ethanol); SAF-1TM ("Syntex adjuvant formulation"); Sendai proteoliposomes and Sendai containing lipid matrices; Span-85 (sorbitan trioleate); Specol (emulsion of Marcol 52, Span 85 and Tween 85); squalene or Robane® (2,6,10,15,19,23-hexamethyltetracosan and 2,6,10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Aladipalmitoxypropylamide); Theronyl-MDP (TermurtideTM or [thr 1]-MDP; N-acetylmuramyl-Lthreonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin, microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Particularly preferred, an adjuvant may be selected from adjuvants, which support induction of a Th1-immune response or maturation of naïve T-cells, such as GM-CSF, IL-12, IFNg, any RNA as defined herein, preferably an immunostimulatory RNA, CpG DNA, etc.

It is possible that the inventive composition contains besides the at least one RNA as described above further components which are selected from the group comprising: further antigens or further antigen-providing nucleic acids; a further immunotherapeutic agent; one or more auxiliary substances; or any further compound, which is known to be immunostimulating due to its binding affinity (as ligands) to human Toll-like receptors; and/or an adjuvant nucleic acid, preferably an immunostimulatory RNA (is RNA).

The inventive composition can additionally contain one or more auxiliary substances in order to increase its immunogenicity or immunostimulatory capacity, if desired. A synergistic action of the at least one RNA as defined herein and of an auxiliary substance, which may be optionally contained in the inventive composition, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFNgamma, GM-CSF, G-CSF, M-CSF, LT-beta or TNF-alpha, growth factors, such as hGH.

The inventive composition may contain any further compound, which is known to be immunostimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Further additives which may be included in the inventive composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

Pharmaceutical Composition:

In a further aspect, the present invention also provides a pharmaceutical composition, comprising the RNA containing composition as defined herein and a pharmaceutically acceptable carrier and/or vehicle. Preferably the pharmaceutical composition is prepared for intratumoral application, preferably by injection into tumor tissue. Sterile injectable forms of the inventive pharmaceutical composition may be aqueous or oleaginous suspension. These suspensions may be formulated according to techniques known in the art using suitable dispersing or wetting agents and suspending agents.

A pharmaceutically acceptable carrier typically includes the liquid or non-liquid basis of a composition comprising the components of the inventive composition. If the composition is provided in liquid form, the carrier will typically be pyrogen-free water; isotonic saline or buffered (aqueous) solutions, e.g. phosphate, citrate etc. buffered solutions. The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. liquids occurring in "in vivo" methods, such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds, which are suitable for administration to a patient to be treated, may be used as well for the pharmaceutical composition according to the invention. The term "compatible" as used here means that these constituents of the inventive pharmaceutical composition are capable of being mixed with the components of the inventive pharmaceutical composition in such a manner that no interaction occurs which would substantially reduce the pharmaceutical effectiveness of the pharmaceutical composition under typical use conditions.

Administration:

The inventive composition or the inventive pharmaceutical composition may be administered by conventional needle injection or needle-free jet injection into the tumor tissue. In a preferred embodiment the inventive composition or the inventive pharmaceutical composition is administered by jet injection. Jet injection refers to a needle-free injection method, wherein a fluid comprising the inventive composition and, optionally, further suitable excipients is forced through an orifice, thus generating an ultra-fine liquid stream of high pressure that is capable of penetrating mammalian skin. In principle, the liquid stream forms a hole in the skin, through which the liquid stream is pushed into the target tissue, namely the tumor tissue. According to the invention, jet injection may be used for intratumoral application of the inventive composition.

The inventive composition may be administered by conventional needle injection or needle-free jet injection adjacent to and/or in close proximity to the tumor tissue. In a preferred embodiment the inventive pharmaceutical composition is administered by jet injection adjacent to and/or in close proximity to the tumor tissue. Jet injection refers to a needle-free injection method, wherein a fluid comprising the inventive composition and, optionally, further suitable excipients is forced through an orifice, thus generating an ultra-fine liquid stream of high pressure that is capable of penetrating mammalian skin. In principle, the liquid stream forms a hole in the skin, through which the liquid stream is pushed into the target tissue, namely the tumor tissue. According to the invention, jet injection may be used for intratumoral application (adjacent to and/or in close proximity to the tumor tissue), particularly for injection of the inventive composition.

In other embodiments, the inventive composition or the inventive pharmaceutical composition may be administered orally, parenterally, by inhalation spray, topically, rectally, nasally, buccally, vaginally or via an implanted reservoir. The term parenteral as used herein includes subcutaneous, intravenous, intramuscular, intraarticular, intranodal, intrasynovial, intrasternal, intrathecal, intrahepatic, intralesional, intracranial, transdermal, intradermal, intrapulmonal, intraperitoneal, intracardial, intraarterial, and sublingual injection or infusion techniques.

Further particularly preferred administration routes are intradermal and intramuscular injection.

Despite, the inventive pharmaceutical composition may comprise further components for facilitating administration and uptake of components of the pharmaceutical composition. Such further components may be an appropriate carrier or vehicle, additional adjuvants for supporting any immune response, antibacterial and/or antiviral agents.

A further component of the inventive pharmaceutical composition may be an immunotherapeutic agent that can be selected from immunoglobulins, preferably IgGs, monoclonal or polyclonal antibodies, polyclonal serum or sera, etc. Preferably, such a further immunotherapeutic agent may be provided as a peptide/protein or may be encoded by a nucleic acid, preferably by a DNA or an RNA, more preferably an mRNA.

The inventive pharmaceutical composition typically comprises a "safe and effective amount" of the components of the inventive pharmaceutical composition, particularly of the RNA molecule(s) as defined herein. As used herein, a "safe and effective amount" means an amount of the RNA molecule(s) as defined herein as such that is sufficient to significantly induce a positive modification of the tumor or cancer disease. At the same time, however, a "safe and effective amount" is small enough to avoid serious side-effects and to permit a sensible relationship between advantage and risk. The determination of these limits typically lies within the scope of sensible medical judgment.

The inventive pharmaceutical composition may be used for human and also for veterinary medical purposes, preferably for human medical purposes, as a pharmaceutical composition in general.

Vaccine:

According to another particularly preferred aspect, the inventive composition or the inventive pharmaceutical composition may be provided or used as a vaccine. Typically, such a vaccine is as defined above for pharmaceutical compositions. Additionally, such a vaccine typically contains the at least one RNA as defined herein or the inventive composition comprising a plurality of RNAs. Preferably, the at least one RNA encodes at least one tumor antigen or at least one immune activator as defined above. The inventive vaccine may also comprise a pharmaceutically acceptable carrier, adjuvant, and/or vehicle as defined herein for the inventive pharmaceutical composition. In the specific context of the inventive vaccine, the choice of a pharmaceutically acceptable carrier is determined in principle by the manner in which the inventive vaccine is administered. The inventive vaccine may be administered locally into tumor tissue.

The inventive vaccine can additionally contain one or more auxiliary substances in order to increase its immunogenicity or immunostimulatory capacity, if desired. Particularly preferred are adjuvants as auxiliary substances or additives as defined for the pharmaceutical composition.

Kit or Kit of Parts:

In a further aspect, the invention relates to a kit or kit of parts comprising the RNA containing composition as described above, or comprising the pharmaceutical composition as described above, or the components thereof and optionally technical instructions with information on the administration and dosage of the components.

Beside the components of the inventive RNA containing composition, the kit may additionally contain a pharmaceutically acceptable vehicle, an adjuvant and at least one further component e.g. an additional pharmaceutically active component/compound as defined herein, as well as means for administration and technical instructions. The components of the composition and possibly further components may be provided in lyophilized form. In a preferred embodiment, prior to use of the kit, the provided vehicle is than added to the lyophilized components in a predetermined amount as written e.g. in the provided technical instructions.

Medical Indication:

The present invention furthermore provides several applications and uses of the inventive RNA containing composition, or the pharmaceutical composition, or the vaccine, or the kit or kit of parts as defined herein. As a main aspect of the invention the composition or the pharmaceutical composition or the kit or kit of parts may be used as a medicament, namely for treatment of tumor or cancer diseases. In this context the treatment is preferably done by intratumoral application, especially by injection into tumor tissue. According to another aspect, the present invention is directed to the second medical use of the RNA containing composition or the pharmaceutical composition, or the vaccine, or the kit or kit of parts as described above, wherein these subject matters are used for preparation of a medicament particularly for intratumoral application (administration) for treatment of tumor or cancer diseases.

Preferably, diseases as mentioned herein are selected from tumor or cancer diseases which preferably include e.g. Acute lymphoblastic leukemia, Acute myeloid leukemia, Adrenocortical carcinoma, AIDS-related cancers, AIDS-related lymphoma, Anal cancer, Appendix cancer, Astrocytoma, Basal cell carcinoma, Bile duct cancer, Bladder cancer, Bone cancer, Osteosarcoma/Malignant fibrous histiocytoma, Brainstem glioma, Brain tumor, cerebellar astrocytoma, cerebral astrocytoma/malignant glioma, ependymoma, medulloblastoma, supratentorial primitive neuroectodermal tumors, visual pathway and hypothalamic glioma, Breast cancer, Bronchial adenomas/carcinoids, Burkitt lymphoma, childhood Carcinoid tumor, gastrointestinal Carcinoid tumor, Carcinoma of unknown primary, primary Central nervous system lymphoma, childhood Cerebellar astrocytoma, childhood Cerebral astrocytoma/Malignant glioma, Cervical cancer, Childhood cancers, Chronic lymphocytic leukemia, Chronic myelogenous leukemia, Chronic myeloproliferative disorders, Colon Cancer, Cutaneous T-cell lymphoma, Desmoplastic small round cell tumor, Endometrial cancer, Ependymoma, Esophageal cancer, Ewing's sarcoma in the Ewing family of tumors, Childhood Extracranial germ cell tumor, Extragonadal Germ cell tumor, Extrahepatic bile duct cancer, Intraocular melanoma, Retinoblastoma, Gallbladder cancer, Gastric (Stomach) cancer, Gastrointestinal Carcinoid Tumor, Gastrointestinal stromal tumor (GIST), extracranial, extragonadal, or ovarian Germ cell tumor, Gestational trophoblastic tumor, Glioma of the brain stem, Childhood Cerebral Astrocytoma, Childhood Visual Pathway and Hypothalamic Glioma, Gastric carcinoid, Hairy cell leukemia, Head and neck cancer, Heart cancer, Hepatocellular (liver) cancer, Hodgkin lymphoma, Hypopharyngeal cancer, childhood Hypothalamic and visual pathway glioma, Intraocular Melanoma, Islet Cell Carcinoma (Endocrine Pancreas), Kaposi sarcoma, Kidney cancer (renal cell cancer), Laryngeal Cancer, Leukemias, acute lymphoblastic Leukemia, acute myeloid Leukemia, chronic lymphocytic Leukemia, chronic myelogenous Leukemia, hairy cell Leukemia, Lip and Oral Cavity Cancer, Liposarcoma, Liver Cancer, Non-Small Cell Lung Cancer, Small Cell Lung Cancer, Lymphomas, AIDS-related Lymphoma, Burkitt Lymphoma, cutaneous T-Cell Lymphoma, Hodgkin Lymphoma, Non-Hodgkin Lymphomas, Primary Central Nervous System Lymphoma, Waldenström Macroglobulinemia, Malignant Fibrous Histiocytoma of Bone/Osteosarcoma, Childhood Medulloblastoma, Melanoma, Intraocular (Eye) Melanoma, Merkel Cell Carcinoma, Adult Malignant Mesothelioma, Childhood Mesothelioma, Metastatic Squamous Neck Cancer with Occult Primary, Mouth Cancer, Childhood Multiple Endocrine Neoplasia Syndrome, Multiple Myeloma/Plasma Cell Neoplasm, Mycosis Fungoides, Myelodysplastic Syndromes, Myelodysplastic/Myeloproliferative Diseases, Chronic Myelogenous Leukemia, Adult Acute Myeloid Leukemia, Childhood Acute Myeloid Leukemia, Multiple Myeloma (Cancer of the Bone-Marrow), Chronic Myeloproliferative Disorders, Nasal cavity and paranasal sinus cancer, Nasopharyngeal carcinoma, Neuroblastoma, Oral Cancer, Oropharyngeal cancer, Osteosarcoma/malignant fibrous histiocytoma of bone, Ovarian cancer, Ovarian epithelial cancer (Surface epithelial-stromal tumor), Ovarian germ cell tumor, Ovarian low malignant potential tumor, Pancreatic cancer, islet cell Pancreatic cancer, Paranasal sinus and nasal cavity cancer, Parathyroid cancer, Penile cancer, Pharyngeal cancer, Pheochromocytoma, Pineal astrocytoma, Pineal germinoma, childhood Pineoblastoma and supratentorial primitive neuroectodermal tumors, Pituitary adenoma, Plasma cell neoplasia/Multiple myeloma, Pleuropulmonary blastoma, Primary central nervous system lymphoma, Prostate cancer, Rectal cancer, Renal cell carcinoma (kidney cancer), Cancer of the Renal pelvis and ureter, Retinoblastoma, childhood Rhabdomyosarcoma, Salivary gland cancer, Sarcoma of the Ewing family of tumors, Kaposi Sarcoma, soft tissue Sarcoma, uterine Sarcoma, Sézary syndrome, Skin cancer (nonmelanoma), Skin cancer (melanoma), Merkel cell Skin carcinoma, Small intestine cancer, Squamous cell carcinoma, metastatic Squamous neck cancer with occult primary, childhood Supratentorial primitive neuroectodermal tumor, Testicular cancer, Throat cancer, childhood Thymoma, Thymoma and Thymic carcinoma, Thyroid cancer, childhood Thyroid cancer, Transitional cell cancer of the renal pelvis and ureter, gestational Trophoblastic tumor, Urethral cancer, endometrial Uterine cancer, Uterine sarcoma, Vaginal cancer, childhood Visual pathway and hypothalamic glioma, Vulvar cancer, Waldenström macroglobulinemia, and childhood Wilms tumor (kidney cancer).

Especially preferred examples of tumors or cancers that are suitable for intratumoral administration are prostate cancer, lung cancer, breast cancer, brain cancer, head and neck cancer, thyroid cancer, colon cancer, stomach cancer, liver cancer, pancreas cancer, ovary cancer, skin cancer, urinary bladder, uterus and cervix.

According to a specific embodiment, the medicament may be administered to the patient as a single dose or as several doses. In certain embodiments, the medicament may be administered to a patient as a single dose followed by a second dose later and optionally even a third, fourth (or more) dose subsequent thereto etc.

Preferably, the inventive composition is provided in an amount of at least 40 µg RNA per dose. More specifically, the amount of the mRNA comprised in a single dose is typically at least 200 µg, preferably from 200 µg to 1.000 µg, more preferably from 300 µg to 850 µg, even more preferably from 300 µg to 700 µg.

Treatment with Additional (Pharmaceutical) Compounds:

In a particularly preferred embodiment the subject receiving the inventive composition, or the pharmaceutical composition or vaccine may be a patient with cancer or tumor who receives or received standard treatments of cancer. Preferably, the patient has achieved partial response or stable disease after having received standard treatments.

The standard treatments of cancer include chemotherapy, radiation, chemoradiation and surgery dependent on the particular cancer or tumor type to be treated, wherein these treatments are applied individually or in combination.

In some embodiments the subject receiving the inventive composition, pharmaceutical composition or vaccine may be a patient with cancer or tumor, who received or receives chemotherapy (e.g. first-line or second-line chemotherapy), radiotherapy, chemoradiation (combination of chemotherapy and radiotherapy), kinase inhibitors, antibody therapy and/or checkpoint modulators (e.g. CTLA4 inhibitors, PD1 pathway inhibitors), or a patient, who has achieved partial response or stable disease after having received one or more of the treatments specified above.

In other embodiments the subject receiving the inventive composition, pharmaceutical composition or vaccine may be a patient with cancer or tumor, who received or receives an additional pharmaceutically active component/compound as defined above. Preferably, the subject is a patient, who has achieved partial response or stable disease after having received one or more of the treatments specified above.

According to a further aspect the invention refers to a method of treatment of tumor or cancer diseases, wherein the RNA containing composition as described above, or the pharmaceutical composition as described above, or the vaccine as described above, or the kit or kit of parts as described above is preferably applied intratumorally, especially by injection into tumor tissue. With respect to further features of the method for treatment it is referred to the description above.

Preferred Intratumoral Applications:

In this context it is particularly preferred that the intratumoral application of the RNA containing composition or the pharmaceutical composition or the vaccine as defined above is combined with the application of different agents/pharmaceutically active components/compounds. Particularly preferred are antibodies (e.g. check point modulators as e.g. anti-CTLA4, anti-OX40, anti-PD1 or anti-PD-L1) or ligands (e.g. CD40L).

In preferred embodiments the following combinations are particularly preferred:

RNAdjuvant (i.t.)+anti-CTLA4 as protein (i.p./i.v.)
RNAdjuvant (i.t.)+anti-CTLA4 as protein (i.t.)
RNAdjuvant (i.t.)+anti-PD1 as protein (i.p./i.v.)
RNAdjuvant (i.t.)+anti-PD1 as protein (i.t.)
RNAdjuvant (i.t.)+anti-PD-L1 as protein (i.p./i.v.)
RNAdjuvant (i.t.)+anti-PD-L1 as protein (i.t.)
RNAdjuvant (i.t.)+CD40L (i.t.) as protein or encoded by a nucleic acid preferably an RNA, more preferably an mRNA
RNAdjuvant (i.t.)+mRNA encoding IL-12+mRNA encoding soluble PD-1 receptor+anti-CD73 (i.p./i.v.)
RNAdjuvant (i.t.)+mRNA encoding IL-12+mRNA encoding soluble PD-1 receptor+anti-CD137 (i.p./i.v.)
RNadjuvant (i.t.)
(i.t.=intratumoral, i.p.=intraperitoneal, i.v.=intravenous)

In the present invention, if not otherwise indicated, different features of alternatives and embodiments may be combined with each other, where suitable. Furthermore, the term "comprising" shall not be narrowly construed as being limited to "consisting of" only, if not specifically mentioned. Rather, in the context of the present invention, "consisting of" is an embodiment specifically contemplated by the inventors to fall under the scope of "comprising", wherever "comprising" is used herein.

All publications, patents and patent applications cited in this specification are herein incorporated by reference as if each individual publication or patent application were specifically and individually indicated to be incorporated by reference. Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims.

The examples and figures shown in the following are merely illustrative and shall describe the present invention in a further way. These figures and examples shall not be construed to limit the present invention thereto.

SHORT DESCRIPTION OF THE FIGURES

FIG. 1: shows survival proportions of mice bearing E.G7-OVA tumors after intratumoral treatment with mRNA encoding IL-12 (IL-12 mRNA) or with recombinant IL-12 protein (rIL-12 protein). The experiment was performed as described in Example 1. Kaplan-Meier survival curves are presented.

FIG. 2: shows that intratumoral treatment of mice with a combination of IL-12 mRNA (R2763, SEQ ID NO: 1) and the polymeric carrier cargo complex (R2391, RNAdjuvant®, prepared as described in methods) led to a significantly decreased tumor volume compared to control groups.

The experiment was performed as described in Example 2. FIG. 2 shows the mean tumor volume at day 21 after tumor challenge (the last day when all animals were alive). Statistical analysis was performed in GraphPad Prism version 5.04 using Mann Whitney test.

FIG. 3: shows survival proportions of mice bearing CT26 tumors after intratumoral treatment with a combination of IL-12 mRNA and the polymeric carrier cargo complex ("RNAdjuvant") as described in Example 2 and in legend of FIG. 2. Kaplan-Meier survival curves are presented. Statistical analysis was performed in GraphPad Prism version 5.04 using Log-rank test.

FIG. 4: shows survival proportions of mice bearing CT26 tumors after intratumoral treatment with mRNA encoding the influenza nucleoprotein. The experiment was performed as described in Example 3. Kaplan-Meier survival curves are presented.

FIGS. 5A-B: Panel (A) shows an analysis of the median tumor growth of mice bearing CT26 tumors after intratumoral treatment with mRNA encoding IL-12, RNAdjuvant, and mRNA encoding soluble PD-1. Respective combinations of these compounds, including control groups, were tested as indicated in the figure. The experiment was performed as described in Example 4.

Panel (B) shows survival proportions of mice bearing CT26 tumors after intratumoral treatment with mRNA encoding IL-12, RNAdjuvant, and mRNA encoding soluble PD-1. Respective combinations of these compounds, including control groups, were tested as indicated in the figure. The experiment was performed as described in Example 4. Kaplan-Meier survival curves are presented.

FIG. 6: shows survival proportions of mice bearing CT26 tumors after intratumoral treatment with mRNA encoding IL-12, RNAdjuvant, mRNA encoding soluble PD-1 and intraperitoneal treatment of an anti-CD73 antibody. Respective combinations of these compounds, including control groups, were tested as indicated in the figure. The experiment was performed as described in Example 5. Kaplan-Meier survival curves are presented.

FIG. 7: shows survival proportions of mice bearing CT26 tumors after intratumoral treatment with mRNA encoding IL-12, RNAdjuvant, mRNA encoding soluble PD-1 and intraperitoneal treatment of an anti-CD173 antibody. Respective combinations of these compounds, including control groups, were tested as indicated in the figure. The experiment was performed as described in Example 6. Kaplan-Meier survival curves are presented.

FIG. 8: shows survival proportions of mice bearing CT26 tumors after intratumoral treatment with RNAdjuvant and intraperitoneal treatment of an anti-PD-1 antibody. Respective combinations of these compounds, including control groups, were tested as indicated in the figure. The experiment was performed as described in Example 7. Kaplan-Meier survival curves are presented.

FIG. 9: shows survival proportions of mice bearing CT26 tumors after intratumoral treatment with mRNA encoding IL-12, RNAdjuvant, mRNA encoding CD40L compared to intratumoral treatment with mRNA encoding IL-12 alone. Respective combinations of these compounds, including control groups, were tested as indicated in the figure. The experiment was performed as described in Example 8. Kaplan-Meier survival curves are presented.

FIG. 10: shows the mRNA sequence R3571 encoding murine CD40L (MmCD40L) according to SEQ ID NO. 10.073

EXAMPLES

Methods: Preparation of the RNA

1. Preparation of DNA and RNA Constructs

For the present examples DNA sequences encoding the indicated RNAs (see Table 17) were prepared and used for subsequent RNA in vitro transcription reactions.

TABLE 17

RNA constructs

| RNA | Description | 5'-UTR | 3'-UTR | SEQ ID NO. |
|---|---|---|---|---|
| R1328 | Murine IL-12 encoding mRNA (MmIL-12(GC))-sc-Flag) | — | Muag (3'-UTR of alpha globin)-A64-C30 | SEQ ID NO: 1 |
| R491 | mRNA encoding Photinus pyralis luciferase (pPLuc (GC)) (irrelevant mRNA) | — | Muag (3'-UTR of alpha globin)-A64-C30 | SEQ ID NO: 2 |
| R2763 | Murine IL-12 encoding mRNA (MmIL-12 (GC)) | 5'-TOP-UTR derived from the ribosomal protein 32 L | albumin-3'-UTR-A64-C30-histone stem-loop | SEQ ID NO: 3 |
| R2244 | Luciferase encoding mRNA (PpLuc(GC)) | 5'-TOP-UTR derived from the ribosomal protein 32 L | albumin-3'-UTR-A64-C30-histone stem-loop | SEQ ID NO: 4 |
| R2025 R2391 | Non-coding immunostimulatory RNA (RNAdjuvant) (SEQ ID NO. 118 of WO2009095226) | | | SEQ ID NO: 5 |
| R2650 R2651 | mRNA coding for the influenza nucleoprotein (H1N1(PR8)-NP(GC)) | 5'-TOP-UTR derived from the ribosomal protein 32 L | albumin-3'-UTR-A64-C30-histone stem-loop | SEQ ID NO: 6 |
| R3971 | mRNA encoding solPD-1 | 5'-TOP-UTR derived from the ribosomal protein 32 L | albumin-3'-UTR-A64-C30-histone stem-loop | SEQ ID NO: 389 |

TABLE 17-continued

| RNA constructs | | | | |
|---|---|---|---|---|
| RNA | Description | 5'-UTR | 3'-UTR | SEQ ID NO. |
| R3571 | mRNA encoding murine CD40L (MmCD40L) | 5'-TOP-UTR derived from the ribosomal protein 32 L | albumin-3'-UTR-A64-C30-histone stem-loop | SEQ ID NO: 10.073 |

The constructs of MmIL-12(GC), Influenza NP (GC), soIPD-1 and PpLuc(GC)) were prepared by introducing a 5'-TOP-UTR derived from the ribosomal protein 32 L, modifying the wild type coding sequence by introducing a GC-optimized sequence for stabilization, followed by a stabilizing sequence derived from the albumin-3'-UTR, a stretch of 64 adenosines (poly(A)-sequence), a stretch of 30 cytosines (poly(C)-sequence), and a histone stem loop. Most DNA sequences were prepared by modifying the wild type encoding DNA sequences by introducing a GC-optimized sequence for stabilization, using an in silico algorithm that increase the GC content of the respective coding sequence compared to the wild type coding sequence (in Table 12 indicated as "GC").

For the present example a DNA sequence encoding the non-coding immunostimulatory RNA (isRNA) R2025 was prepared and used for subsequent RNA in vitro transcription reactions.

2. RNA In Vitro Transcription

The respective DNA plasmids prepared according to section 1 above were transcribed in vitro using T7 polymerase. The RNA in vitro transcription reactions of the IL-12, the NP, PpLuc, CD40L and soluble PD-1 encoding constructs were performed in the presence of a CAP analog ($m^7$GpppG). The isRNA R2025 was prepared without CAP analog. Subsequently, the RNA was purified using PureMessenger® (CureVac, Tübingen, Germany; WO2008/077592A1).

3. Preparation of the Polymeric Cargo Complex ("RNAdjuvant")

The following cationic peptide as cationic component of the polymeric carrier was used (Cys-$Arg_{12}$-Cys or $CR_{12}C$) according to SEQ ID NO: 7.

For synthesis of the polymeric carrier cargo complexes an RNA molecule having the RNA sequence R2025 as defined in section 1 above was mixed with the cationic CR12C peptide component as defined above. The specified amount of the RNA was mixed with the respective cationic component in mass ratios as indicated below, thereby forming a complex. If polymerizing cationic components were used according to the present invention, polymerization of the cationic components took place simultaneously to complexation of the nucleic acid cargo. Afterwards, the resulting solution was adjusted with water to a final volume of 50 μl and incubated for 30 minutes at room temperature. Further details are described in WO2012013326.

The mass ratio of peptide:RNA was 1:3.7. The polymeric carrier cargo complex is formed by the disulfide-crosslinked cationic peptide CR12C as carrier and the immunostimulatory R2025 as nucleic acid cargo. This polymeric carrier cargo complex R2025/CR12C (designated R2391) was used as adjuvant in the following examples (referred to as "RNAdjuvant")

4. Preparation of the Vaccine Formulation Coding for the Influenza Nucleoprotein (H1N1(PR8)-NP(GC)) (R2651)

The mRNA (R2650) was complexed with protamine by addition of protamine to the mRNA in the ratio (1:2) (w/w) (adjuvant component). After incubation for 10 min, the same amount of free mRNA used as antigen-providing mRNA was added. This vaccine formulation is termed herein R2651 (according to WO2010037539). The vaccine was administered in Ringer's Lactate solution.

5. Preparation of the RNA for Administration

The naked (that is, non-formulated) PpLuc mRNA (R2244, R491)), IL-12 mRNA (R2763, R1328), soluble PD-1 mRNA (R3971), CD40L mRNA (R3571) were administered in Ringer's Lactate (RiLa) solution. The co-formulation of naked mRNAs and the polymeric carrier cargo complex "RNAdjuvant" (R2391) were also administered in Ringer's Lactate (RiLa) after mixing of both components directly before injection.

Example 1: Intratumoral Application of mRNA Coding for IL-12

5 female C57BL/6 mice per treatment group were inoculated with $10^6$ cells E.G7-OVA cells 5 days before the first treatment. For each treatment group 5 established (about 100 $mm^3$) subcutaneously implanted EG.7-OVA tumors were treated. Tumors were treated with 16 μg mRNA coding for MmIL-12 (MmIL-12(GC))-sc-Flag) (R1328) or 0.5 μg MmIL-12 protein on d 0, 2, 4, 21, 23 and 25 with 50 μg (1 μg/μl). As control mice were treated with an irrelevant mRNA (pPLuc) (R491).

Study day 0 is defined as the first day of treatment. Tumor growth was monitored frequently (every 2-3 days). Mice with a volume of >3 $cm^3$ were killed.

Results of Example 1

FIG. 1 shows that the intratumoral treatment with the mRNA-encoded IL-12 (IL-12 mRNA) resulted in a significant increase in survival compared to the control group. Furthermore an increased survival could be observed compared to the intratumoral application of recombinant IL-12 protein (rIL-12 protein).

Example 2: Intratumoral Treatment with mRNA Encoding IL-12 in Combination with an Immunostimulating RNA (RNAdjuvant®)

The following table 18 summarizes the RNA constructs used for the example 2.

TABLE 18

| RNA constructs for example 2 | | | |
|---|---|---|---|
| RNA | Description | FIG. | SEQ ID NO. |
| R2763 | Murine IL-12 encoding mRNA | 1 | SEQ ID NO. 1 |
| R2244 | Luciferase encoding mRNA (PpLuc) | 2 | SEQ ID NO. 2 |
| R2025 | Non-coding immunostimulatory RNA | 3 | SEQ ID NO. 3 |

Balb/c mice (n=6 or 7, see table 14) were injected subcutaneously (s.c.) with $1\times10^6$ CT26 cells (colon carcinoma cell line) per mouse (in a volume of 100 μl PBS) on the right flank on day 0 of the experiment. At day 9 after tumor challenge, mice were sorted according to the tumor size to obtain groups with a mean tumor volume of approximately 60 mm³. Intratumoral (i.t.) therapy started at day 9 and continued for additional 4 injections every 3-4 days. Mice were injected with a combination of mRNA-encoded IL-12 (25 µg of R2763)+RNAdjuvant® (25 µg of R2391) (group A). To control for local inflammation due to RNA application or the injection procedure, mice were injected with control mRNA coding for luciferase (PpLuc, R2244, group B) or buffer (RiLa, group C), respectively. Untreated mice served as additional control (group D).

Tumor growth was monitored by measuring the tumor size in three dimensions using a calliper. Tumor volume was calculated according to the following formula:

$$\text{volume (mm}^3) = \frac{\text{length (mm)} \times \pi \times \text{width}^2 (\text{mm}^2)}{6}$$

On day 9, 11, 14, 17 and 21 of the experiment mice were injected intratumorally (i.t.) with RNA according to the table 19 below. The volume for intratumoral injection was 50 µl.

TABLE 19

Animal groups

| Group | Strain sex | Number of mice | RNA | Dose per mouse | Route, volume |
|---|---|---|---|---|---|
| A | BALB/c Female | 7 | R2763, R2391 | 25 µg of each RNA | i.t., 50 µl |
| B | BALB/c Female | 7 | R2244 | 50 µg | i.t., 50 µl |
| C | BALB/c Female | 6 | RiLa | — | i.t., 50 µl |
| D | BALB/c Female | 6 | — | — | — |

Results of Example 2

Figure 1:
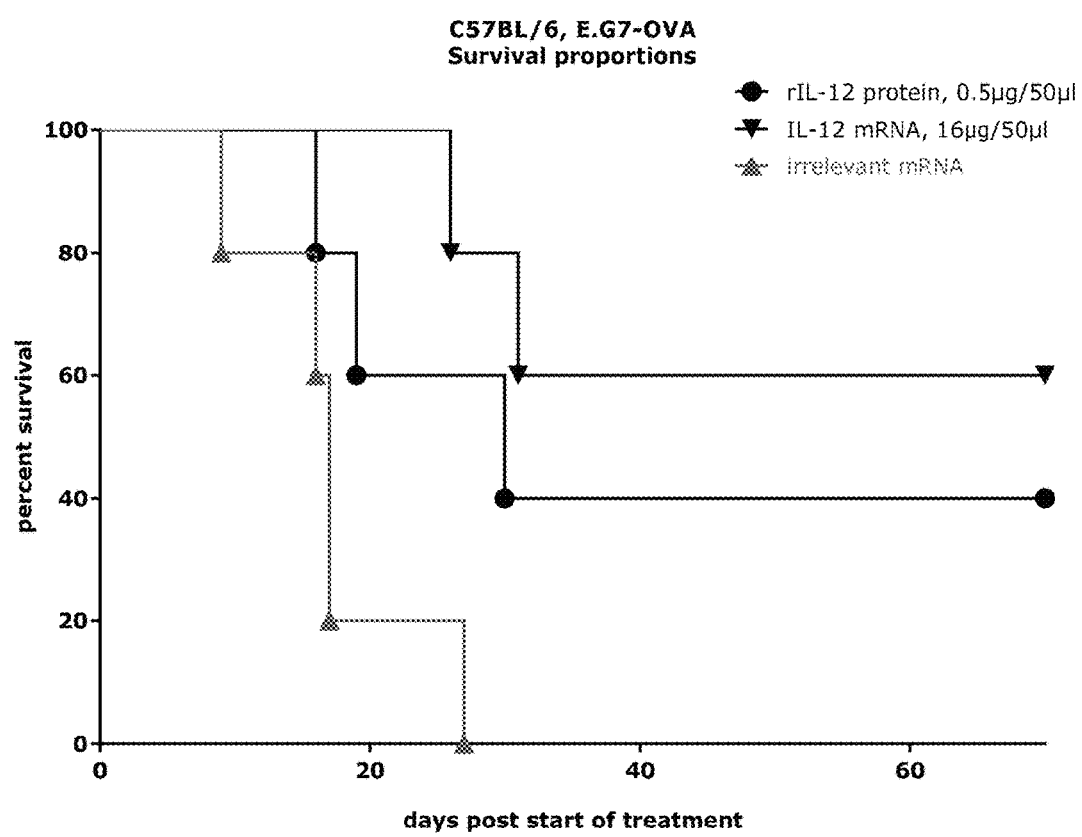
Figure 2:
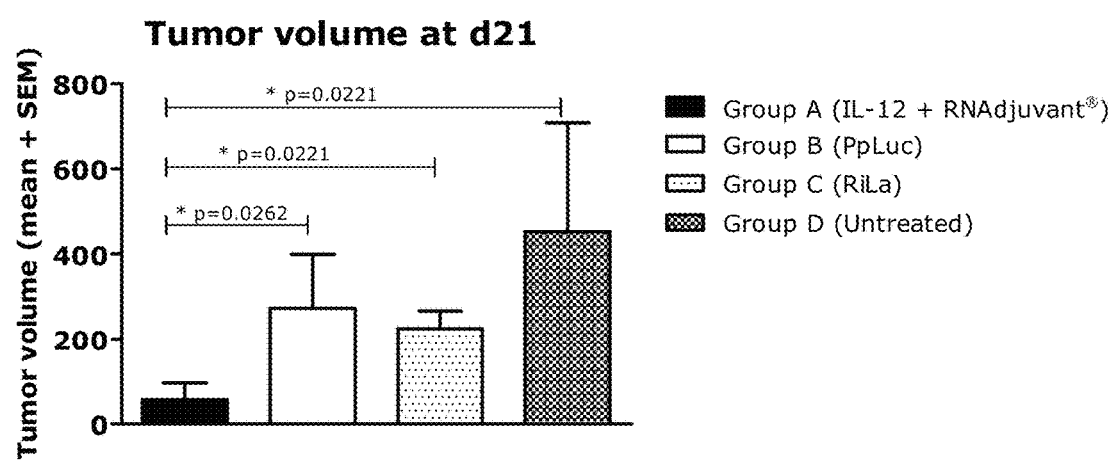
FIG. 2 shows that the intratumoral treatment with the combination of mRNA-encoded IL-12 (R2763) and RNAdjuvant® (R2391) resulted in a statistically significant decrease in tumor volume at day 21 after tumor challenge compared to all control groups.
Figure 3:
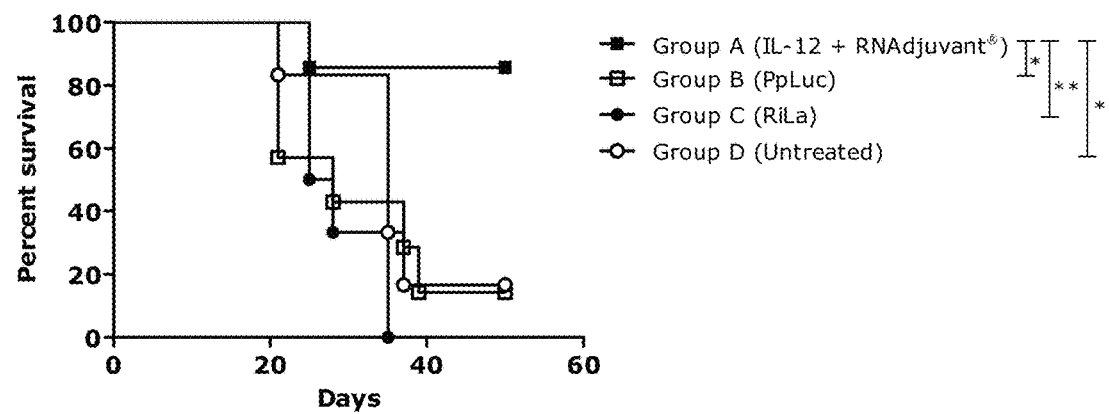
FIG. 3 shows that the intratumoral treatment with the combination of mRNA-encoded IL-12 (R2763) and RNAdjuvant® (R2391) resulted in a statistically significant increase in survival compared to all three control groups (group A vs. group B*p=0.0104, group A vs. group C**p=0.0035, group A vs. Group D*p==0.0263).

Example 3: Vaccination of Mice with mRNA Encoding the Influenza Nucleoprotein (NP) and Subsequent Intratumoral Treatment with NP-Encoding mRNA The objective of this experiment was to test whether a pre-existing immune response can be harnessed against an established tumor. To this end, mice were first vaccinated with RNActive (vaccine formulation complexed with protamine) encoding the influenza nucleoprotein (NP) (R2651) which induces a high level of anti-NP CD8+ T cell responses, then challenged with CT26 tumor cells followed by intratumoral treatment with naked RNA encoding NP (R2650).

27 Balb/c mice were vaccinated intradermally (i.d.) with 40 µg of H1N1(PR8)-NP(GC) RNActive (R2651) (2×50 up or Ringer-Lactate buffer (RiLa) as control on day 0, day 7 and day 16 of the experiment. On day 14 all mice were challenged subcutaneously (s.c.) with 1×10⁶ CT26 cells per mouse (in a volume of 100 µl PBS) on the right flank. On day 22, mice were assigned to the different groups as shown in Table 20.

On day 23, seven days after the second boost, intratumoral (i.t.) application of 50 µg naked H1N1(PR8)-NP(GC) mRNA (R2650) started (only group C) and continued for additional four injections (at day 25, day 28, day 31 and day 35). The volume for intratumoral injection was 50 µl. A detailed treatment schedule is shown in Table 21.

Tumor growth was monitored by measuring the tumor size in three dimensions using a calliper. Tumor volume was calculated according to the following formula:

$$\text{volume (mm}^3) = \frac{\text{length (mm)} \times \pi \times \text{width}^2 (\text{mm}^2)}{6}$$

TABLE 20

Animal groups

| Group | Strain sex | Number of mice | mRNA i.d. | mRNA i.t. |
|---|---|---|---|---|
| A | BALB/c Female | 9 | RiLa | — |
| B | BALB/c Female | 9 | R2651 (40 µg) | — |
| C | BALB/c Female | 9 | R2651 (40 µg) | R2650 (50 µg) |

TABLE 21

Vaccination schedule

| Day | Treatment |
|---|---|
| 0 | i.d. vaccination all groups |
| 7 | i.d. vaccination all groups |
| 14 | Tumor challenge of all groups (1 × 10⁶ CT26 cells/mouse) |
| 16 | i.d. vaccination all groups |
| 23 | i.t. vaccination group C |
| 25,28, 31,35 | i.t. vaccination group C |

Results of Example 3

Figure 4:
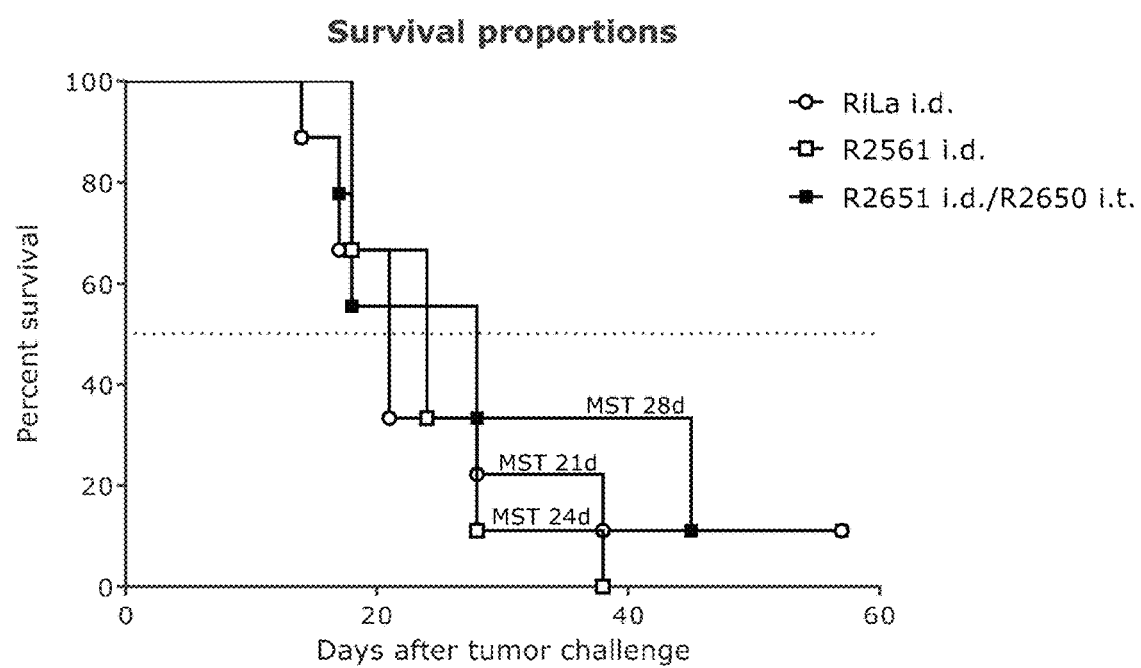

FIG. 4 shows that pre-existent immunity (induced in this model by the NP vaccination) increased the median survival time (MST) of mice which received intratumoral application of NP-encoded mRNA compared to mice which were treated with buffer only (MST=28 vs. MST=21, respectively).

Example 4: Intratumoral Treatment with an Immunostimulating RNA ("RNAdiuvant") and an mRNA Encoding Soluble PD-1 and an mRNA Encoding IL-12

Table 22 summarizes the treatment as used in the present example. RNAdjuvant and the mRNA constructs encoding IL-12 and soluble PD-1 were administered intratumorally (i.t.). In CT26 tumor challenged mice, survival rates and median tumor growth were analyzed.

TABLE 22

Groups, treatment and RNA dilution

| Group | Nr. of mice | i.t treatment (25 µg for each component) | Vaccination schedule |
|---|---|---|---|
| A | 10 | IL-12 + RNAdjuvant + soluble PD-1 | 2× week |
| B | 10 | IL-12 | 2× week |
| C | 10 | RNAdjuvant | 2× week |
| D | 10 | RiLa | 2× week |

Tumor Challenge and Administration of the Inventive Composition:

60 Balb/c mice were challenged subcutaneously with $1\times10^6$ CT26 cells per mouse (volume in 100 µl PBS) on the right flank on day 0 of the experiment. On day 8 mice were sorted according to tumor size. According to tumor size, the first vaccination took place on day 8 or 9 (tumors should have a size of about 40-50 mm$^3$). Mice were vaccinated with different combinations of mRNAs and RNAdjuvant according to the table above. Six vaccinations took place. Volume for intratumoral injection was 50 µl.

Mice were injected according to the indicated scheme shown in Table 22. Median tumor growth was determined according to example 3. The results of the experiment are shown in FIG. 5, wherein FIG. 5A shows the effect of the inventive composition on tumor growth, and FIG. 5B shows the effect of the inventive composition on survival.

Results:

The results in FIG. 5A show that the inventive composition comprising an mRNA encoding IL-12 and mRNA encoding soluble PD-1 in combination with RNAdjuvant (group "A" according to Table 22) to strongly decreased the median tumor volume compared to the other treatments (groups B-D according to Table 22). In addition, the results in FIG. 5B show that the inventive composition comprising an mRNA encoding IL-12 and mRNA encoding soluble PD-1 in combination with RNAdjuvant (group "A" according to Table 22) strongly increased the survival of tumor challenged mice compared to the other treatments (groups B-D according to Table 22).

Example 5: Intratumoral Treatment with mRNA Encoding IL-12 in Combination with an Immunostimulating RNA ("RNAdjuvant") and mRNA Encoding Sol PD-1 and Anti-CD73 Antibody Table 23 summarizes the treatment as used in the present example. In addition to RNAdjuvant and mRNA constructs encoding IL-12 and soluble PD-1 (administered intratumorally (i.t.)), an anti CD73 antibody (BioXCell) was co-administered intraperitoreally (i.p.). In CT26 tumor challenged mice, survival rates were analyzed.

TABLE 23

Groups, treatment and RNA dilution

| Group | Nr. of mice | i.t. treatment (25 µg for each component) | i.p. treatment | Vaccination schedule |
|---|---|---|---|---|
| A | 10 | IL-12 + RNAdjuvant + soluble PD-1 | a-CD73 | 2× week |
| B | 10 | IL-12 + RNAdjuvant + soluble PD-1 | Rat IgG2a | 2× week |
| C | 10 | RiLa | a-CD73 | 2× week |
| D | 10 | RiLa | Rat IgG2a | 2× week |

Tumor Challenge and Administration of the Inventive Composition:

The tumor challenge was performed according to the previous experiments (see Example 4).

Mice were injected according to the indicated scheme shown in Table 23.

Figure 6:
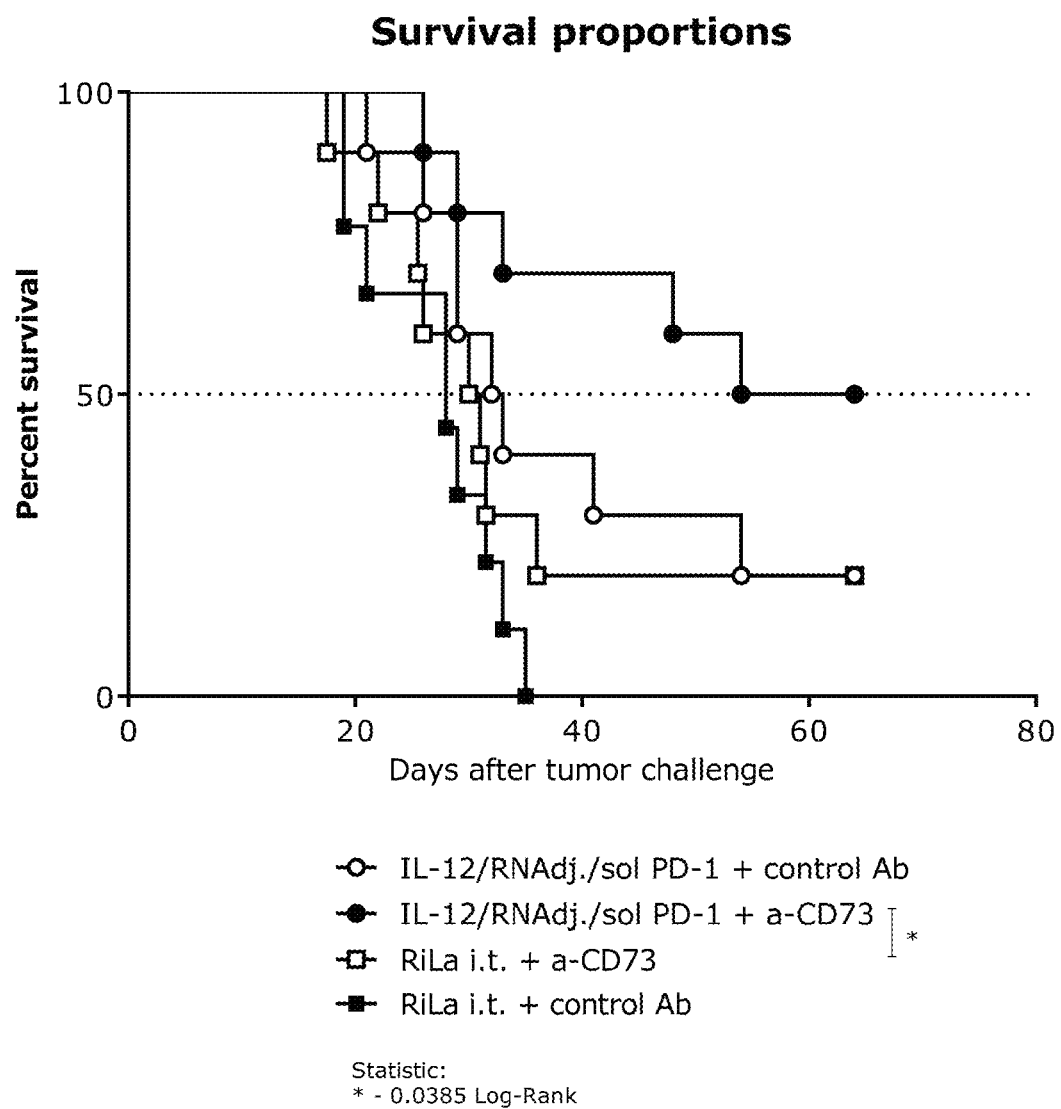

The results of the experiment are shown in FIG. 6.

Results:

FIG. 6 shows that the intratumoral treatment with mRNA-encoded IL-12 (R2763), mRNA encoded sol-PD-1 (R3971) and RNAdjuvant® (R2391) in combination with an i.p. administration of anti CD73 antibody (Group "A" according to Table 23) resulted in a statistically significant increase in survival compared to the relevant control group that only received an anti CD73 antibody (Group "C" according to Table 23) and in an increase in survival rates compared to the treatment with IL-12+RNAdjuvant+soluble PD-1 and a control antibody (Rat IgG2a, BioXCell) (Group "B" according to Table 23).

Example 6: Intratumoral Treatment with mRNA Encoding IL-12 in Combination with an Immunostimulating RNA ("RNAdjuvant") and an Anti-CD137 Antibody Table 24 summarizes the treatment as used in the present example. In addition to RNAdjuvant and the mRNA constructs encoding IL-12 and soluble PD-1 (administered intratumorally (i.t.)), an anti CD137 antibody (BioXCell) was co-administered intraperitoreally (i.p.). In CT26 tumor challenged mice, survival rates were analyzed.

TABLE 24

Groups, treatment and RNA dilution

| Group | Nr. of mice | i.t. treatment (25 µg) | i.p. treatment | Vaccination schedule |
|---|---|---|---|---|
| A | 10 | IL-12 + RNAdjuvant + soluble PD-1 | a-CD137 | 2× week |
| B | 10 | IL-12 + RNAdjuvant + soluble PD-1 | Rat IgG2a | 2× week |
| C | 10 | RiLa | a-CD137 | 2× week |
| D | 10 | RiLa | Rat IgG2a | 2× week |

Tumor Challenge and Administration of the Inventive Composition:

The tumor challenge was performed according to the previous experiments (see Example 4).

Mice were injected according to the indicated scheme shown in Table 24.

Figure 7:
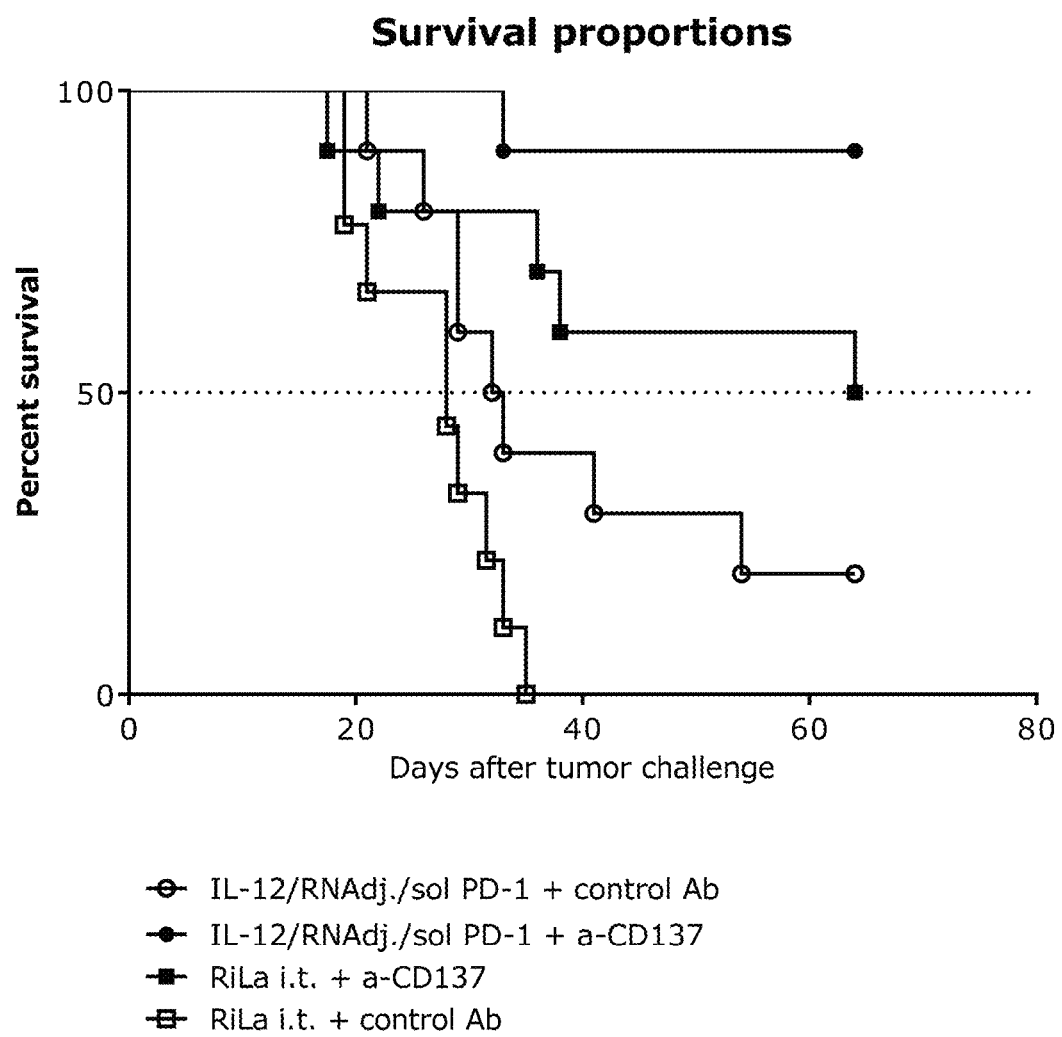

The results of the experiment are shown in FIG. 7.

Results:

FIG. 7 shows that the intratumoral treatment with mRNA-encoded IL-12 (R2763) sol-PD-1 (R3971) and RNAdjuvant® (R2391) in combination with an i.p. administration of anti CD-137 antibody (Group "A" according to Table 24) resulted in a significant increase in survival compared to the relevant control group that only received the antibody anti CD-137 (Group "C" according to Table 24) and in an increase in survival rates compared to the treatment with IL-12+RNAdjuvant+soluble PD-1 and a control antibody (Rat IgG2a, BioXCell) (Group "B" according to Table 24).

Example 7: Treatment with an Immunostimulating RNA ("RNAdjuvant") in Combination with a Checkpoint Inhibitor Anti PD-1 Antibody Table 25 summarizes the treatment as used in the present example. In addition to RNAdjuvant (administered i.t.), a checkpoint inhibitor anti PD-1 (BioXCell) was administered i.p. In CT26 tumor challenged mice, survival rates were analyzed.

TABLE 25

Groups, treatment and RNA dilution /antibody dilution

| Group | Construct | Antibody | Amount of RNA (µg) | Vaccination schedule |
|---|---|---|---|---|
| A | RiLa (i.t.) | — | | 2× week |
| B | RNAdjuvant (i.t.) | Control Ab (i.p.)(100 µg) | 25 | 2× week |
| C | RNAdjuvant (i.t.) | Anti-PD-1 (i.p.) (200 µg) | 25 | 2× week |
| D | RiLa (i.t.) | Anti-PD-1 (i.p.) (200 µg) | — | 2× week |

Tumor Challenge and Administration of the Inventive Composition:

The tumor challenge was performed according to the previous experiments (see Example 4).

Mice were injected according to the indicated scheme shown in Table 25.

Figure 8:
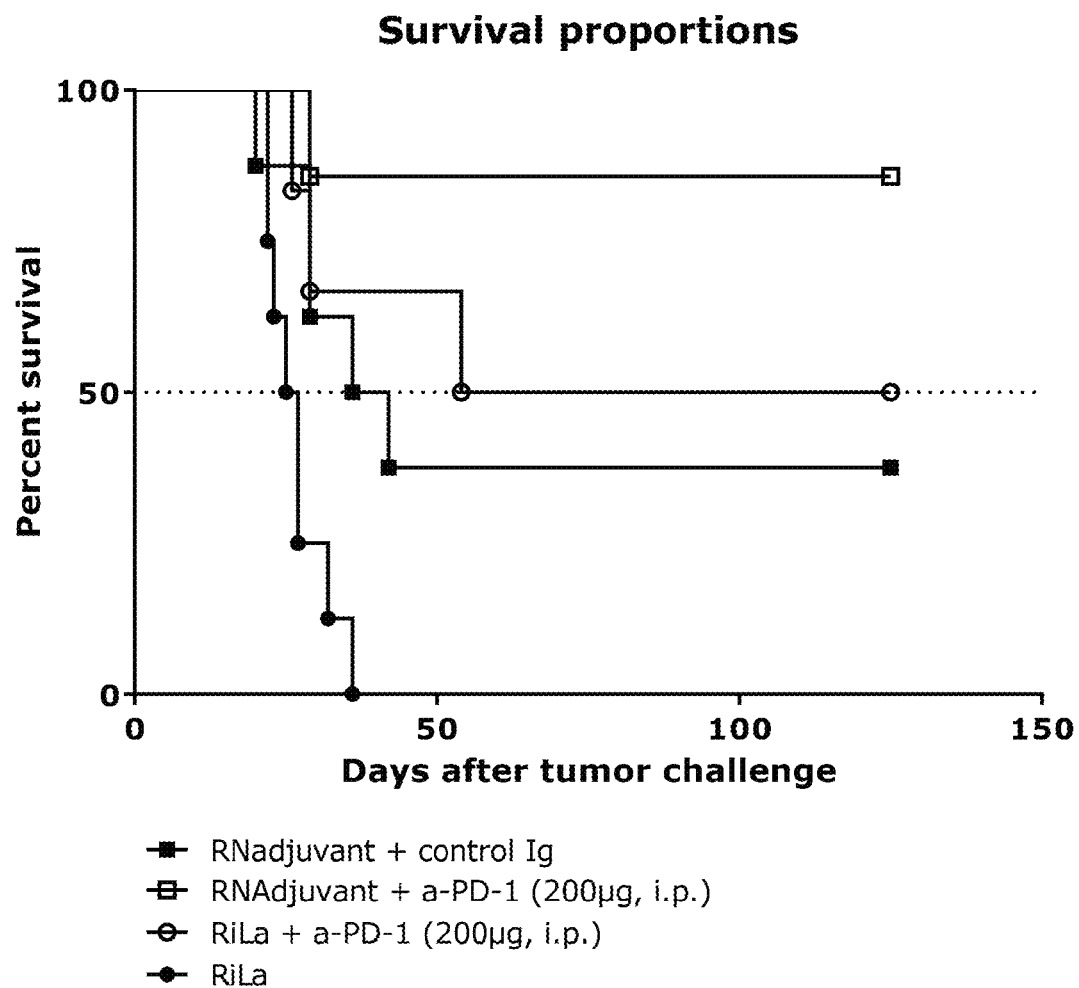

The results of the experiment are shown in FIG. 8.

Results:

FIG. 8 shows that the intratumoral (i.t.) treatment with RNAdjuvant® (R2391) in combination with an i.p. administration of anti PD-1 antibody (Group "C" according to Table 25) resulted in an increase in survival compared to the relevant control group that only received the checkpoint inhibitor anti PD-1 antibody (Group "D" according to Table 25) and in an increase in survival rates compared to the treatment with RNAdjuvant and a control antibody (anti hamster IgG, BioXCell) (Group "B" according to Table 25).

Example 8: Intratumoral Treatment with an Immunostimulating RNA ("RNAdjuvant") and an mRNA Encoding CD40 Ligand (CD40L) and an mRNA Encoding IL-12

Table 26 summarizes the treatment as used in the present example. RNAdjuvant and the mRNA constructs encoding IL-12 and murine CD40L were administered intratumorally (i.t.). In CT26 tumor challenged mice, survival rates were analyzed.

TABLE 26

Groups, treatment and RNA dilution

| Group | Nr. of mice | i.t. treatment (25 µg per RNA) | Vaccination schedule |
|---|---|---|---|
| A | 8 | IL-12 + RNAdjuvant + CD40L | 2× week |
| B | 8 | IL-12 | 2× week |
| C | 8 | RiLa | 2× week |

Tumor Challenge and Administration of the Inventive Composition:

The tumor challenge was performed according to the previous experiments (see Example 4).

Mice were injected according to the indicated scheme shown in Table 26.

Figure 9:
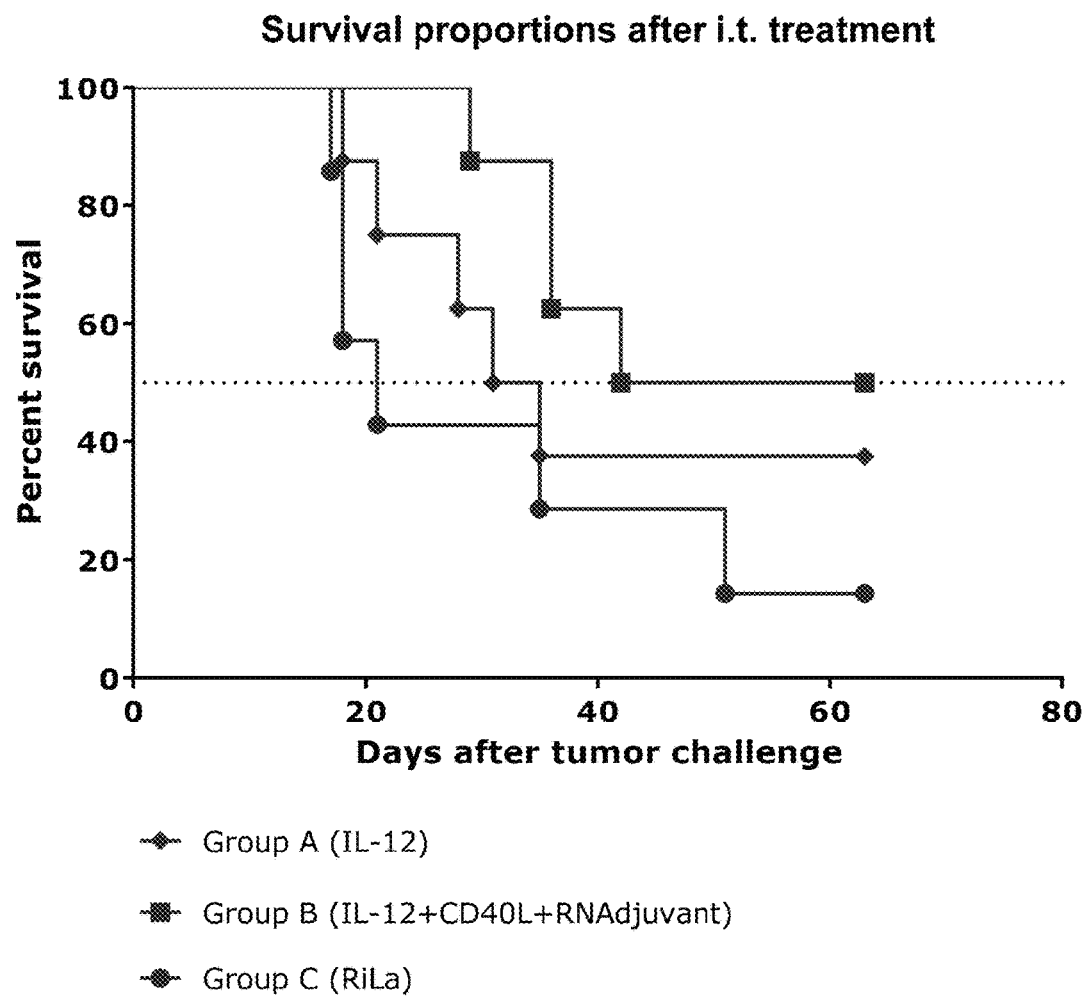

The results of the experiment are shown in FIG. 9.

Results:

The results in FIG. 9 show that the inventive composition comprising an mRNA encoding IL-12 and an mRNA encoding CD40L in combination with RNAdjuvant (group "A" according to table 26) strongly increased the median survival of tumor challenged mice compared to the other treatments (groups B-C according to table 26).

SEQUENCE LISTING (10073 sequences)

SEQ ID NO: 1 - RNA, 1815 nt, Artificial Sequence
  R1328 coding for the mouse IL-12 protein
gggagaaagcuuaccaugugcccccagaagcugaccaucagcugguucgccaucgugcuccuggucuccccgcugauggccaugugggagcucgagaaggacguguacguggucgagguggacuggacccccgacgcgcccggcgagacggugaaccugaccugcgacacccccgaggaggacgacaucaccuggacgagcgaccagcggcacggggucaucggcuccgggaagacccugaccaucaccgugaaggaguuccucgacgccggccaguacacgugccacaagggcggcgagacccugagccacucccaccugcuccugcacaagaaggagaacgggaucuggagcaccgagauccugaagaacuucaagaacaagaccuuccucaagugcgaggccccgaacuacuccgggcgcuucacgugcagcuggcuggugcagcggaacauggaccugaaguucaacaucaaguccagcuccagcucccccgacagccgcgccgucaccugcggcauggccucccucagcgcggagaaggugacccuggaccagcgggacuacgagaaguacuccgugagcugccaggaggacgucaccugccccacggccgaggagacccugcccaucgagcucgcccuggaggcccgccagcagaacaaguacgagaacuacuccaccagcuucuucauccgggacaucaucaagccggacccccccaagaaccugcagaugaagccccucaagaacagccagguggagguguccugggaguacccggacagcugguccaccccgcacagcuacuucucccugaaguucuucguccgcauccagcggaagaaggagaagaugaaggagacggaggaggggugcaaccagaagggcgcguuccugguggagaagaccagcaccgaggugcagugcaagggcgggaacgucugcgugcaggcccaggaccgguacuacaacuccagcugcuccaagugggccugcgugcccugccggguccgcagccgcgugauccccgucagcggcccggcccggugccugucccagagccgcaaccugcucaagaccacggacgacauggugaagaccgcccgggagaagcugaagcacuacuccugcaccgccgaggacaucgaccacgaggacaucacccgcgaccagacgagcacccugaagaccugccucccccuggagcugcacaagaacgaguccugccucgccacccgggagacgagcuccaccacccgcgggagcugccugccgccccagaagaccucccugaugaugacgcucugccugggcagcaucuacgaggaccugaagauguaccagaccgaguuccaggcgaucaacgccgcccuccagaaccacaaccaccagcagaucauccuggacaaggggaugcugguggccaucgacgagcucaugcagucccugaaccacaacggcgagacccugcggcagaagccgcccgucggggaggcggaccccuaccgcgugaagaugaagcucugcauccugcugcacgccuucagcacccggguggucacgaucaaccgcgugaugggcuaccucuccagcgccgacuacaaggacgacgacgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 2 - RNA, 1857 nt, Artificial Sequence
  R491 coding for the Photinus pyralis luciferase protein
gggagaaagcuugaggauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguaagacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 3 - RNA, 2023 nt, Artificial Sequence
  R2763 coding for the mouse IL-12 protein
ggggcgcugccuacggagguggcagccaucuccuucucggcaucaagcuuaccaugugcccccagaagcugaccaucagcugguucgccaucgugcuccuggucuccccgcugauggccaugugggagcucgagaaggacguguacguggucgagguggacuggacccccgacgcgcccggcgagacggugaaccugaccugcgacacccccgaggaggacgacaucaccuggacgagcgaccagcggcacggggucaucggcuccgggaagacccugaccaucaccgugaaggaguuccucgacgccggccaguacacgugccacaagggcggcgagacccugagccacucccaccugcuccugcacaagaaggagaacgggaucuggagcaccgagauccugaagaacuucaagaacaagaccuuccucaagugcgaggccccgaacuacuccgggcgcuucacgugcagcuggcuggugcagcggaacauggaccugaaguucaacaucaaguccagcuccagcucccccgacagccgcgccgucaccugcggcauggccucccucagcgcggagaaggugacccuggaccagcgggacuacgagaaguacuccgugagcugccaggaggacgucaccugccccacggccgaggagacccugcccaucgagcucgcccuggaggcccgccagcagaacaaguacgagaacuacuccaccagcuucuucauccgggacaucaucaagccggacccccccaagaaccugcagaugaagccccucaagaacagccagguggagguguccugggaguacccggacagcugguccaccccgcacagcuacuucucccugaaguucuucguccgcauccagcggaagaaggagaagaugaaggagacggaggaggggugcaaccagaagggcgcguuccugguggagaagaccagcaccgaggugcagugcaagggcgggaacgucugcgugcaggcccaggaccgguacuacaacuccagcugcuccaagugggccugcgugcccugccggguccgcagcggcaguacuucgggcagugguaagccugguaguggugaggguaguacuaagggucgcgugauccccgucagcggcccggcccggugccugucccagagccgcaaccugcucaagaccacggacgacauggugaagaccgcccgggagaagcugaagcacuacuccugcaccgccgaggacaucgaccacgaggacaucacccgcgaccagacgagcacccugaagaccugccucccccuggagcugcacaagaacgaguccugccucgccacccgggagacgagcuccaccacccgcgggagcugccugccgccccagaagaccucccugaugaugacgcucugccugggcagcaucuacgaggaccugaagauguaccagaccgaguuccaggcgaucaacgccgcccuccagaaccacaaccaccagcagaucauccuggacaaggggaugcugguggccaucgacgagcucaugcagucccugaaccacaacggcgagacccugcggcagaagccgcccgucggggaggcggaccccuaccgcgugaagaugaagcucugcauccugcugcacgccuucagcacccggguggucacgaucaaccgcgugaugggcuaccucuccagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4 - RNA, 2034 nt, Artificial Sequence
  R2244 coding for the Photinus pyralis luciferase protein
gggcgcugccuacggagguggcagccaucuccuucucggcaucaagcuugaggauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguaagacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5 - RNA, 547 nt, Artificial Sequence
  RNA sequence of the non-coding immunostimulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuag

SEQ ID NO: 6 - RNA, 1879 nt, Artificial Sequence
  R2650/R2651 coding for the influenza nucleoprotein
ggggcgcugccuacggagguggcagccaucuccuucucggcaucaagcuuaccauggccagccagggcaccaagcgguccuacgagcagauggagaccgacggggagcgccagaacgccacggagauccgggcgagcgugggcaagaugaucgggggcaucgggcgcuucuacauccagaugugcaccgagcugaagcucuccgacuacgagggccggcugauccagaacagccugaccaucgagcgcaugguccucuccgccuucgacgagcggcgcaacaaguaccuggaggagcaccccagcgccggcaaggacccgaagaagaccgggggccccaucuaccggcgcgugaacgggaaguggaugcgggagcugauccucuacgacaaggaggagauccgccggaucuggcgccaggccaacaacggcgacgacgccacggcggggcugacccacaugaugaucuggcacuccaaccugaacgacgccaccuaccagcggacccgcgcccucgugcggacgggcauggacccccgcaugugcagccugaugcagggcuccacccugccccggcgcagcggggccgcgggcgccgccgucaagggggugggcaccauggugauggagcucguccggaugaucaagcgcggcaucaacgaccggaacuucuggcggggcgagaacgggcgcaagacccggaucgccuacgagcgcaugugcaacauccugaaggggaaguuccagacggccgcgcagaaggccaugauggaccaggugcgggagucccgcaacccgggcaacgccgaguucgaggaccugaccuuccucgcccggagcgcccugauccugcgcggguccguggcgcacaagagcugccuccccgccugcgucuacggccccgccguggccuccggcuacgacuucgagcgggagggguacagccuggugggcaucgaccccuuccgccugcuccagaacucccaggucuacagccugauccggccgaacgagaaccccgcccacaagucccagcugguguggauggcgugccacagcgccgccuucgaggaccuccgcgugcugagcuucaucaaggggaccaagguccugccccggggcaagcucuccacccgcggggugcagaucgccagcaacgagaacauggagacgauggaguccagcacccuggagcugcggucccgcuacugggccauccggacccgcagcggcggcaacaccaaccagcagcgggcguccgccgggcagaucagcauccagcccacguucuccgugcagcgcaaccucccguucgaccggaccaccaucauggccgccuucaacggcaacaccgaggggcggacgagcgacaugcgcaccgagaucauccggaugauggaguccgcgcgccccgaggacgucagcuuccagggccggggcguguucgagcuguccgacgagaaggccgccagccccaucgugcccuccuucgacaugagcaacgagggguccuacuucuucggcgacaacgccgaggaguacgacaacugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7 - protein, 14 aa, Artificial Sequence
  cationic component of the polymeric carrier
CRRRRRRRRRRRRC

SEQ ID NO: 8 - DNA, 24 bp, Artificial Sequence
  Stem-loop nucleotide sequence
caaaggcucuuuucagagccacca

SEQ ID NO: 9 - RNA, 24 nt, Artificial Sequence
  Stem-loop nucleotide sequence
caaaggcucuuuucagagccacca

SEQ ID NO: 10 - protein, 9 aa, Artificial Sequence
  cationic component of the polymeric carrier
CRRRRRRRC

SEQ ID NO: 11 - protein, 10 aa, Artificial Sequence
  cationic component of the polymeric carrier
CRRRRRRRRC

SEQ ID NO: 12 - protein, 11 aa, Artificial Sequence
  cationic component of the polymeric carrier
CRRRRRRRRRC

SEQ ID NO: 13 - protein, 12 aa, Artificial Sequence
  cationic component of the polymeric carrier
CRRRRRRRRRRC

SEQ ID NO: 14 - protein, 13 aa, Artificial Sequence
  cationic component of the polymeric carrier
CRRRRRRRRRRRC

SEQ ID NO: 15 - protein, 14 aa, Artificial Sequence
  cationic component of the polymeric carrier
CRRRRRRRRRRRRC

SEQ ID NO: 16 - protein, 15 aa, Artificial Sequence
  cationic component of the polymeric carrier
CRRRRRRRRRRRRRC

SEQ ID NO: 17 - protein, 16 aa, Artificial Sequence
  cationic component of the polymeric carrier
CRRRRRRRRRRRRRRC

SEQ ID NO: 18 - protein, 17 aa, Artificial Sequence
  cationic component of the polymeric carrier
CRRRRRRRRRRRRRRRC

SEQ ID NO: 19 - protein, 18 aa, Artificial Sequence
  cationic component of the polymeric carrier
CRRRRRRRRRRRRRRRRC

SEQ ID NO: 20 - protein, 19 aa, Artificial Sequence
  cationic component of the polymeric carrier
CRRRRRRRRRRRRRRRRRC

SEQ ID NO: 21 - protein, 20 aa, Artificial Sequence
  cationic component of the polymeric carrier
CRRRRRRRRRRRRRRRRRRC

SEQ ID NO: 22 - protein, 20 aa, Artificial Sequence
  cationic component of the polymeric carrier
CRRRRRRRRRRRRRRRRRRC

SEQ ID NO: 23 - protein, 21 aa, Artificial Sequence
  cationic component of the polymeric carrier
CRRRRRRRRRRRRRRRRRRRC

SEQ ID NO: 24 - protein, 2 aa, Artificial Sequence
  cationic component of the polymeric carrier
WY

SEQ ID NO: 25 - protein, 2 aa, Artificial Sequence
  cationic component of the polymeric carrier
YW

SEQ ID NO: 26 - protein, 2 aa, Artificial Sequence
  cationic component of the polymeric carrier
WW

SEQ ID NO: 27 - protein, 2 aa, Artificial Sequence
  cationic component of the polymeric carrier
YY

SEQ ID NO: 28 - protein, 3 aa, Artificial Sequence
  cationic component of the polymeric carrier
WYW

SEQ ID NO: 29 - protein, 3 aa, Artificial Sequence
  cationic component of the polymeric carrier
YWY

SEQ ID NO: 30 - protein, 3 aa, Artificial Sequence
  cationic component of the polymeric carrier
WWW

SEQ ID NO: 31 - protein, 3 aa, Artificial Sequence
  cationic component of the polymeric carrier
YYY

SEQ ID NO: 32 - protein, 4 aa, Artificial Sequence
  cationic component of the polymeric carrier
WYWY

SEQ ID NO: 33 - protein, 4 aa, Artificial Sequence
  cationic component of the polymeric carrier
YWYW

SEQ ID NO: 34 - protein, 4 aa, Artificial Sequence
  cationic component of the polymeric carrier
WWWW

SEQ ID NO: 35 - protein, 2 aa, Artificial Sequence
  cationic component of the polymeric carrier
FY

SEQ ID NO: 36 - protein, 2 aa, Artificial Sequence
  cationic component of the polymeric carrier
YF

SEQ ID NO: 37 - protein, 2 aa, Artificial Sequence
  cationic component of the polymeric carrier
FF

SEQ ID NO: 38 - protein, 3 aa, Artificial Sequence
  cationic component of the polymeric carrier
FYF

SEQ ID NO: 39 - protein, 3 aa, Artificial Sequence
  cationic component of the polymeric carrier
YFY

SEQ ID NO: 40 - protein, 3 aa, Artificial Sequence
  cationic component of the polymeric carrier
FFF

SEQ ID NO: 41 - protein, 4 aa, Artificial Sequence
  cationic component of the polymeric carrier
FYFY

SEQ ID NO: 42 - protein, 4 aa, Artificial Sequence
  cationic component of the polymeric carrier
YFYF

SEQ ID NO: 43 - protein, 4 aa, Artificial Sequence
  cationic component of the polymeric carrier
FFFF

SEQ ID NO: 44 - protein, 2 aa, Artificial Sequence
  cationic component of the polymeric carrier
FW

SEQ ID NO: 45 - protein, 2 aa, Artificial Sequence
  cationic component of the polymeric carrier
WF

SEQ ID NO: 46 - protein, 2 aa, Artificial Sequence
  cationic component of the polymeric carrier
FF

SEQ ID NO: 47 - protein, 3 aa, Artificial Sequence
  cationic component of the polymeric carrier
FWF

SEQ ID NO: 48 - protein, 3 aa, Artificial Sequence
  cationic component of the polymeric carrier
WFW

SEQ ID NO: 49 - protein, 4 aa, Artificial Sequence
  cationic component of the polymeric carrier
FWFW

SEQ ID NO: 50 - protein, 4 aa, Artificial Sequence
  cationic component of the polymeric carrier
WFWF

SEQ ID NO: 51 - protein, 4 aa, Artificial Sequence
  cationic component of the polymeric carrier
YYYY

SEQ ID NO: 52 - protein, 3 aa, Artificial Sequence
  cationic component of the polymeric carrier
CYC

SEQ ID NO: 53 - protein, 3 aa, Artificial Sequence
  cationic component of the polymeric carrier
CWC

SEQ ID NO: 54 - protein, 4 aa, Artificial Sequence
  cationic component of the polymeric carrier
CWYC

SEQ ID NO: 55 - protein, 4 aa, Artificial Sequence
  cationic component of the polymeric carrier
CYWC

SEQ ID NO: 56 - protein, 4 aa, Artificial Sequence
  cationic component of the polymeric carrier
CWWC

SEQ ID NO: 57 - protein, 4 aa, Artificial Sequence
  cationic component of the polymeric carrier
CYYC

SEQ ID NO: 58 - protein, 5 aa, Artificial Sequence
  cationic component of the polymeric carrier
CWYWC

SEQ ID NO: 59 - protein, 5 aa, Artificial Sequence
  cationic component of the polymeric carrier
CYWYC

SEQ ID NO: 60 - protein, 5 aa, Artificial Sequence
  cationic component of the polymeric carrier
CWWWC

SEQ ID NO: 61 - protein, 5 aa, Artificial Sequence
  cationic component of the polymeric carrier
CYYYC

SEQ ID NO: 62 - protein, 6 aa, Artificial Sequence
  cationic component of the polymeric carrier
CWYWYC

SEQ ID NO: 63 - protein, 6 aa, Artificial Sequence
  cationic component of the polymeric carrier
CYWYWC

SEQ ID NO: 64 - protein, 6 aa, Artificial Sequence
  cationic component of the polymeric carrier
CWWWWC

SEQ ID NO: 65 - protein, 6 aa, Artificial Sequence
  cationic component of the polymeric carrier
CYYYYC

SEQ ID NO: 66 - protein, 3 aa, Artificial Sequence
  cationic component of the polymeric carrier
CFC

SEQ ID NO: 67 - protein, 4 aa, Artificial Sequence
  cationic component of the polymeric carrier
CFYC

SEQ ID NO: 68 - protein, 4 aa, Artificial Sequence
  cationic component of the polymeric carrier
CYFC

SEQ ID NO: 69 - protein, 4 aa, Artificial Sequence
  cationic component of the polymeric carrier
CFFC

SEQ ID NO: 70 - protein, 4 aa, Artificial Sequence
  cationic component of the polymeric carrier
CYYC

SEQ ID NO: 71 - protein, 5 aa, Artificial Sequence
  cationic component of the polymeric carrier
CFYFC

SEQ ID NO: 72 - protein, 5 aa, Artificial Sequence
  cationic component of the polymeric carrier
CYFYC

SEQ ID NO: 73 - protein, 5 aa, Artificial Sequence
  cationic component of the polymeric carrier
CFFFC

SEQ ID NO: 74 - protein, 5 aa, Artificial Sequence
  cationic component of the polymeric carrier
CYYYC

SEQ ID NO: 75 - protein, 6 aa, Artificial Sequence
  cationic component of the polymeric carrier
CFYFYC

SEQ ID NO: 76 - protein, 6 aa, Artificial Sequence
  cationic component of the polymeric carrier
CYFYFC

SEQ ID NO: 77 - protein, 6 aa, Artificial Sequence
  cationic component of the polymeric carrier
CFFFFC

SEQ ID NO: 78 - protein, 4 aa, Artificial Sequence
  cationic component of the polymeric carrier
CFWC

SEQ ID NO: 79 - protein, 4 aa, Artificial Sequence
  cationic component of the polymeric carrier
CWFC

SEQ ID NO: 80 - protein, 4 aa, Artificial Sequence
  cationic component of the polymeric carrier
CFFC

SEQ ID NO: 81 - protein, 5 aa, Artificial Sequence
  cationic component of the polymeric carrier
CFWFC

SEQ ID NO: 82 - protein, 5 aa, Artificial Sequence
  cationic component of the polymeric carrier
CWFWC

SEQ ID NO: 83 - protein, 6 aa, Artificial Sequence
  cationic component of the polymeric carrier
CFWFWC

SEQ ID NO: 84 - protein, 6 aa, Artificial Sequence
  cationic component of the polymeric carrier
CWFWFC

SEQ ID NO: 85 - protein, 2 aa, Artificial Sequence
  cationic component of the polymeric carrier
ST

SEQ ID NO: 86 - protein, 2 aa, Artificial Sequence
  cationic component of the polymeric carrier
TS

SEQ ID NO: 87 - protein, 2 aa, Artificial Sequence
  cationic component of the polymeric carrier
SS

SEQ ID NO: 88 - protein, 2 aa, Artificial Sequence
  cationic component of the polymeric carrier
TT

SEQ ID NO: 89 - protein, 3 aa, Artificial Sequence
  cationic component of the polymeric carrier
STS

SEQ ID NO: 90 - protein, 3 aa, Artificial Sequence
  cationic component of the polymeric carrier
TST

SEQ ID NO: 91 - protein, 3 aa, Artificial Sequence
  cationic component of the polymeric carrier
SSS

SEQ ID NO: 92 - protein, 3 aa, Artificial Sequence
  cationic component of the polymeric carrier
TTT

SEQ ID NO: 93 - protein, 4 aa, Artificial Sequence
  cationic component of the polymeric carrier
STST

SEQ ID NO: 94 - protein, 4 aa, Artificial Sequence
  cationic component of the polymeric carrier
TSTS

SEQ ID NO: 95 - protein, 4 aa, Artificial Sequence
  cationic component of the polymeric carrier
SSSS

SEQ ID NO: 96 - protein, 4 aa, Artificial Sequence
  cationic component of the polymeric carrier
TTTT

SEQ ID NO: 97 - protein, 2 aa, Artificial Sequence
  cationic component of the polymeric carrier
QN

SEQ ID NO: 98 - protein, 2 aa, Artificial Sequence
  cationic component of the polymeric carrier
NQ

SEQ ID NO: 99 - protein, 2 aa, Artificial Sequence
  cationic component of the polymeric carrier
QQ

SEQ ID NO: 100 - protein, 2 aa, Artificial Sequence
  cationic component of the polymeric carrier
NN

SEQ ID NO: 101 - protein, 3 aa, Artificial Sequence
  cationic component of the polymeric carrier
QNQ

SEQ ID NO: 102 - protein, 3 aa, Artificial Sequence
  cationic component of the polymeric carrier
NQN

SEQ ID NO: 103 - protein, 3 aa, Artificial Sequence
  cationic component of the polymeric carrier
QQQ

SEQ ID NO: 104 - protein, 3 aa, Artificial Sequence
  cationic component of the polymeric carrier
NNN

SEQ ID NO: 105 - protein, 4 aa, Artificial Sequence
  cationic component of the polymeric carrier
QNQN

SEQ ID NO: 106 - protein, 4 aa, Artificial Sequence
  cationic component of the polymeric carrier
NQNQ

SEQ ID NO: 107 - protein, 4 aa, Artificial Sequence
  cationic component of the polymeric carrier
QQQQ

SEQ ID NO: 108 - protein, 4 aa, Artificial Sequence
  cationic component of the polymeric carrier
NNNN

SEQ ID NO: 109 - protein, 2 aa, Artificial Sequence
  cationic component of the polymeric carrier
SN

SEQ ID NO: 110 - protein, 2 aa, Artificial Sequence
  cationic component of the polymeric carrier
NS

SEQ ID NO: 111 - protein, 2 aa, Artificial Sequence
  cationic component of the polymeric carrier
SS

SEQ ID NO: 112 - protein, 2 aa, Artificial Sequence
  cationic component of the polymeric carrier
NN

SEQ ID NO: 113 - protein, 3 aa, Artificial Sequence
  cationic component of the polymeric carrier
SNS

SEQ ID NO: 114 - protein, 3 aa, Artificial Sequence
  cationic component of the polymeric carrier
NSN

SEQ ID NO: 115 - protein, 3 aa, Artificial Sequence
  cationic component of the polymeric carrier
SSS

SEQ ID NO: 116 - protein, 3 aa, Artificial Sequence
  cationic component of the polymeric carrier
NNN

SEQ ID NO: 117 - protein, 4 aa, Artificial Sequence
  cationic component of the polymeric carrier
SNSN

SEQ ID NO: 118 - protein, 4 aa, Artificial Sequence
  cationic component of the polymeric carrier
NSNS

SEQ ID NO: 119 - protein, 4 aa, Artificial Sequence
  cationic component of the polymeric carrier
SSSS

SEQ ID NO: 120 - protein, 4 aa, Artificial Sequence
  cationic component of the polymeric carrier
NNNN

SEQ ID NO: 121 - protein, 3 aa, Artificial Sequence
  cationic component of the polymeric carrier
CTC

SEQ ID NO: 122 - protein, 3 aa, Artificial Sequence
  cationic component of the polymeric carrier
CSC

SEQ ID NO: 123 - protein, 4 aa, Artificial Sequence
  cationic component of the polymeric carrier
CSTC

SEQ ID NO: 124 - protein, 4 aa, Artificial Sequence
  cationic component of the polymeric carrier
CTSC

SEQ ID NO: 125 - protein, 4 aa, Artificial Sequence
  cationic component of the polymeric carrier
CSSC

SEQ ID NO: 126 - protein, 4 aa, Artificial Sequence
  cationic component of the polymeric carrier
CTTC

SEQ ID NO: 127 - protein, 5 aa, Artificial Sequence
  cationic component of the polymeric carrier
CSTSC

SEQ ID NO: 128 - protein, 5 aa, Artificial Sequence
  cationic component of the polymeric carrier
CTSTC

SEQ ID NO: 129 - protein, 5 aa, Artificial Sequence
  cationic component of the polymeric carrier
CSSSC

SEQ ID NO: 130 - protein, 5 aa, Artificial Sequence
  cationic component of the polymeric carrier
CTTTC

SEQ ID NO: 131 - protein, 6 aa, Artificial Sequence
  cationic component of the polymeric carrier
CSTSTC

SEQ ID NO: 132 - protein, 6 aa, Artificial Sequence
  cationic component of the polymeric carrier
CTSTSC

SEQ ID NO: 133 - protein, 6 aa, Artificial Sequence
  cationic component of the polymeric carrier
CSSSSC

SEQ ID NO: 134 - protein, 6 aa, Artificial Sequence
  cationic component of the polymeric carrier
CTTTTC

SEQ ID NO: 135 - protein, 3 aa, Artificial Sequence
  cationic component of the polymeric carrier
CNC

SEQ ID NO: 136 - protein, 3 aa, Artificial Sequence
  cationic component of the polymeric carrier
CQC

SEQ ID NO: 137 - protein, 4 aa, Artificial Sequence
  cationic component of the polymeric carrier
CQNC

SEQ ID NO: 138 - protein, 4 aa, Artificial Sequence
  cationic component of the polymeric carrier
CNQC

SEQ ID NO: 139 - protein, 4 aa, Artificial Sequence
  cationic component of the polymeric carrier
CQQC

SEQ ID NO: 140 - protein, 4 aa, Artificial Sequence
  cationic component of the polymeric carrier
CNNC

SEQ ID NO: 141 - protein, 5 aa, Artificial Sequence
  cationic component of the polymeric carrier
CQNQC

SEQ ID NO: 142 - protein, 5 aa, Artificial Sequence
  cationic component of the polymeric carrier
CNQNC

SEQ ID NO: 143 - protein, 5 aa, Artificial Sequence
  cationic component of the polymeric carrier
CQQQC

SEQ ID NO: 144 - protein, 5 aa, Artificial Sequence
  cationic component of the polymeric carrier
CNNNC

SEQ ID NO: 145 - protein, 6 aa, Artificial Sequence
  cationic component of the polymeric carrier
CQNQNC

SEQ ID NO: 146 - protein, 6 aa, Artificial Sequence
  cationic component of the polymeric carrier
CNQNQC

SEQ ID NO: 147 - protein, 6 aa, Artificial Sequence
  cationic component of the polymeric carrier
CQQQQC

SEQ ID NO: 148 - protein, 6 aa, Artificial Sequence
  cationic component of the polymeric carrier
CNNNNC

SEQ ID NO: 149 - protein, 3 aa, Artificial Sequence
  cationic component of the polymeric carrier
CNC

SEQ ID NO: 150 - protein, 3 aa, Artificial Sequence
  cationic component of the polymeric carrier
CSC

SEQ ID NO: 151 - protein, 4 aa, Artificial Sequence
  cationic component of the polymeric carrier
CSNC

SEQ ID NO: 152 - protein, 4 aa, Artificial Sequence
  cationic component of the polymeric carrier
CNSC

SEQ ID NO: 153 - protein, 4 aa, Artificial Sequence
  cationic component of the polymeric carrier
CSSC

SEQ ID NO: 154 - protein, 4 aa, Artificial Sequence
  cationic component of the polymeric carrier
CNNC

SEQ ID NO: 155 - protein, 5 aa, Artificial Sequence
  cationic component of the polymeric carrier
CSNSC

SEQ ID NO: 156 - protein, 5 aa, Artificial Sequence
  cationic component of the polymeric carrier
CNSNC

SEQ ID NO: 157 - protein, 5 aa, Artificial Sequence
  cationic component of the polymeric carrier
CSSSC

SEQ ID NO: 158 - protein, 5 aa, Artificial Sequence
  cationic component of the polymeric carrier
CNNNC

SEQ ID NO: 159 - protein, 6 aa, Artificial Sequence
  cationic component of the polymeric carrier
CSNSNC

SEQ ID NO: 160 - protein, 6 aa, Artificial Sequence
  cationic component of the polymeric carrier
CNSNSC

SEQ ID NO: 161 - protein, 6 aa, Artificial Sequence
  cationic component of the polymeric carrier
CSSSSC

SEQ ID NO: 162 - protein, 6 aa, Artificial Sequence
  cationic component of the polymeric carrier
CNNNNC

SEQ ID NO: 163 - protein, 2 aa, Artificial Sequence
  cationic component of the polymeric carrier
LV

SEQ ID NO: 164 - protein, 2 aa, Artificial Sequence
  cationic component of the polymeric carrier
VL

SEQ ID NO: 165 - protein, 2 aa, Artificial Sequence
  cationic component of the polymeric carrier
LL

SEQ ID NO: 166 - protein, 2 aa, Artificial Sequence
  cationic component of the polymeric carrier
VV

SEQ ID NO: 167 - protein, 3 aa, Artificial Sequence
  cationic component of the polymeric carrier
LVL

SEQ ID NO: 168 - protein, 3 aa, Artificial Sequence
  cationic component of the polymeric carrier
VLV

SEQ ID NO: 169 - protein, 3 aa, Artificial Sequence
  cationic component of the polymeric carrier
LLL

SEQ ID NO: 170 - protein, 3 aa, Artificial Sequence
  cationic component of the polymeric carrier
VVV

SEQ ID NO: 171 - protein, 4 aa, Artificial Sequence
  cationic component of the polymeric carrier
LVLV

SEQ ID NO: 172 - protein, 4 aa, Artificial Sequence
  cationic component of the polymeric carrier
VLVL

SEQ ID NO: 173 - protein, 4 aa, Artificial Sequence
  cationic component of the polymeric carrier
LLLL

SEQ ID NO: 174 - protein, 4 aa, Artificial Sequence
  cationic component of the polymeric carrier
VVVV

SEQ ID NO: 175 - protein, 2 aa, Artificial Sequence
  cationic component of the polymeric carrier
IA

SEQ ID NO: 176 - protein, 2 aa, Artificial Sequence
  cationic component of the polymeric carrier
AI

SEQ ID NO: 177 - protein, 2 aa, Artificial Sequence
  cationic component of the polymeric carrier
II

SEQ ID NO: 178 - protein, 2 aa, Artificial Sequence
  cationic component of the polymeric carrier
AA

SEQ ID NO: 179 - protein, 3 aa, Artificial Sequence
  cationic component of the polymeric carrier
IAI

SEQ ID NO: 180 - protein, 3 aa, Artificial Sequence
  cationic component of the polymeric carrier
AIA

SEQ ID NO: 181 - protein, 3 aa, Artificial Sequence
  cationic component of the polymeric carrier
III

SEQ ID NO: 182 - protein, 3 aa, Artificial Sequence
  cationic component of the polymeric carrier
AAA

SEQ ID NO: 183 - protein, 4 aa, Artificial Sequence
  cationic component of the polymeric carrier
IAIA

SEQ ID NO: 184 - protein, 4 aa, Artificial Sequence
  cationic component of the polymeric carrier
AIAI

SEQ ID NO: 185 - protein, 4 aa, Artificial Sequence
  cationic component of the polymeric carrier
IIII

SEQ ID NO: 186 - protein, 4 aa, Artificial Sequence
  cationic component of the polymeric carrier
AAAA

SEQ ID NO: 187 - protein, 2 aa, Artificial Sequence
  cationic component of the polymeric carrier
MA

SEQ ID NO: 188 - protein, 2 aa, Artificial Sequence
  cationic component of the polymeric carrier
AM

SEQ ID NO: 189 - protein, 2 aa, Artificial Sequence
  cationic component of the polymeric carrier
MM

SEQ ID NO: 190 - protein, 2 aa, Artificial Sequence
  cationic component of the polymeric carrier
AA

SEQ ID NO: 191 - protein, 3 aa, Artificial Sequence
  cationic component of the polymeric carrier
MAM

SEQ ID NO: 192 - protein, 3 aa, Artificial Sequence
  cationic component of the polymeric carrier
AMA

SEQ ID NO: 193 - protein, 3 aa, Artificial Sequence
  cationic component of the polymeric carrier
MMM

SEQ ID NO: 194 - protein, 3 aa, Artificial Sequence
  cationic component of the polymeric carrier
AAA

SEQ ID NO: 195 - protein, 4 aa, Artificial Sequence
  cationic component of the polymeric carrier
MAMA

SEQ ID NO: 196 - protein, 4 aa, Artificial Sequence
  cationic component of the polymeric carrier
AMAM

SEQ ID NO: 197 - protein, 4 aa, Artificial Sequence
  cationic component of the polymeric carrier
MMMM

SEQ ID NO: 198 - protein, 3 aa, Artificial Sequence
  cationic component of the polymeric carrier
CVC

SEQ ID NO: 199 - protein, 3 aa, Artificial Sequence
  cationic component of the polymeric carrier
CLC

SEQ ID NO: 200 - protein, 4 aa, Artificial Sequence
  cationic component of the polymeric carrier
CLVC

SEQ ID NO: 201 - protein, 4 aa, Artificial Sequence
  cationic component of the polymeric carrier
CVLC

SEQ ID NO: 202 - protein, 4 aa, Artificial Sequence
  cationic component of the polymeric carrier
CLLC

SEQ ID NO: 203 - protein, 4 aa, Artificial Sequence
  cationic component of the polymeric carrier
CVVC

SEQ ID NO: 204 - protein, 5 aa, Artificial Sequence
  cationic component of the polymeric carrier
CLVLC

SEQ ID NO: 205 - protein, 5 aa, Artificial Sequence
  cationic component of the polymeric carrier
CVLVC

SEQ ID NO: 206 - protein, 5 aa, Artificial Sequence
  cationic component of the polymeric carrier
CLLLC

SEQ ID NO: 207 - protein, 5 aa, Artificial Sequence
  cationic component of the polymeric carrier
CVVVC

SEQ ID NO: 208 - protein, 6 aa, Artificial Sequence
  cationic component of the polymeric carrier
CLVLVC

SEQ ID NO: 209 - protein, 6 aa, Artificial Sequence
  cationic component of the polymeric carrier
CVLVLC

SEQ ID NO: 210 - protein, 6 aa, Artificial Sequence
  cationic component of the polymeric carrier
CLLLLC

SEQ ID NO: 211 - protein, 6 aa, Artificial Sequence
  cationic component of the polymeric carrier
CVVVVC

SEQ ID NO: 212 - protein, 3 aa, Artificial Sequence
  cationic component of the polymeric carrier
CAC

SEQ ID NO: 213 - protein, 3 aa, Artificial Sequence
  cationic component of the polymeric carrier
CIC

SEQ ID NO: 214 - protein, 4 aa, Artificial Sequence
  cationic component of the polymeric carrier
CIAC

SEQ ID NO: 215 - protein, 4 aa, Artificial Sequence
  cationic component of the polymeric carrier
CAIC

SEQ ID NO: 216 - protein, 4 aa, Artificial Sequence
  cationic component of the polymeric carrier
CIIC

SEQ ID NO: 217 - protein, 4 aa, Artificial Sequence
  cationic component of the polymeric carrier
CAAC

SEQ ID NO: 218 - protein, 5 aa, Artificial Sequence
  cationic component of the polymeric carrier
CIAIC

SEQ ID NO: 219 - protein, 5 aa, Artificial Sequence
  cationic component of the polymeric carrier
CAIAC

SEQ ID NO: 220 - protein, 5 aa, Artificial Sequence
  cationic component of the polymeric carrier
CIIIC

SEQ ID NO: 221 - protein, 5 aa, Artificial Sequence
  cationic component of the polymeric carrier
CAAAC

SEQ ID NO: 222 - protein, 6 aa, Artificial Sequence
  cationic component of the polymeric carrier
CIAIAC

SEQ ID NO: 223 - protein, 6 aa, Artificial Sequence
  cationic component of the polymeric carrier
CAIAIC

SEQ ID NO: 224 - protein, 6 aa, Artificial Sequence
  cationic component of the polymeric carrier
CIIIIC

SEQ ID NO: 225 - protein, 6 aa, Artificial Sequence
  cationic component of the polymeric carrier
CAAAAC

SEQ ID NO: 226 - protein, 3 aa, Artificial Sequence
  cationic component of the polymeric carrier
CMC

SEQ ID NO: 227 - protein, 4 aa, Artificial Sequence
  cationic component of the polymeric carrier
CMAC

SEQ ID NO: 228 - protein, 4 aa, Artificial Sequence
  cationic component of the polymeric carrier
CAMC

SEQ ID NO: 229 - protein, 4 aa, Artificial Sequence
  cationic component of the polymeric carrier
CMMC

SEQ ID NO: 230 - protein, 4 aa, Artificial Sequence
  cationic component of the polymeric carrier
CAAC

SEQ ID NO: 231 - protein, 5 aa, Artificial Sequence
  cationic component of the polymeric carrier
CMAMC

SEQ ID NO: 232 - protein, 5 aa, Artificial Sequence
  cationic component of the polymeric carrier
CAMAC

SEQ ID NO: 233 - protein, 5 aa, Artificial Sequence
  cationic component of the polymeric carrier
CMMMC

SEQ ID NO: 234 - protein, 5 aa, Artificial Sequence
  cationic component of the polymeric carrier
CAAAC

SEQ ID NO: 235 - protein, 6 aa, Artificial Sequence
  cationic component of the polymeric carrier
CMAMAC

SEQ ID NO: 236 - protein, 6 aa, Artificial Sequence
  cationic component of the polymeric carrier
CAMAMC

SEQ ID NO: 237 - protein, 6 aa, Artificial Sequence
  cationic component of the polymeric carrier
CMMMMC

SEQ ID NO: 238 - protein, 6 aa, Artificial Sequence
  cationic component of the polymeric carrier
CAAAAC

SEQ ID NO: 239 - protein, 2 aa, Artificial Sequence
  cationic component of the polymeric carrier
DH

SEQ ID NO: 240 - protein, 2 aa, Artificial Sequence
  cationic component of the polymeric carrier
HD

SEQ ID NO: 241 - protein, 2 aa, Artificial Sequence
  cationic component of the polymeric carrier
DD

SEQ ID NO: 242 - protein, 2 aa, Artificial Sequence
  cationic component of the polymeric carrier
HH

SEQ ID NO: 243 - protein, 3 aa, Artificial Sequence
  cationic component of the polymeric carrier
DHD

SEQ ID NO: 244 - protein, 3 aa, Artificial Sequence
  cationic component of the polymeric carrier
HDH

SEQ ID NO: 245 - protein, 3 aa, Artificial Sequence
  cationic component of the polymeric carrier
DDD

SEQ ID NO: 246 - protein, 3 aa, Artificial Sequence
  cationic component of the polymeric carrier
HHH

SEQ ID NO: 247 - protein, 4 aa, Artificial Sequence
  cationic component of the polymeric carrier
DHDH

SEQ ID NO: 248 - protein, 4 aa, Artificial Sequence
  cationic component of the polymeric carrier
HDHD

SEQ ID NO: 249 - protein, 4 aa, Artificial Sequence
  cationic component of the polymeric carrier
DDDD

SEQ ID NO: 250 - protein, 4 aa, Artificial Sequence
  cationic component of the polymeric carrier
HHHH

SEQ ID NO: 251 - protein, 3 aa, Artificial Sequence
  cationic component of the polymeric carrier
CHC

SEQ ID NO: 252 - protein, 3 aa, Artificial Sequence
  cationic component of the polymeric carrier
CDC

SEQ ID NO: 253 - protein, 4 aa, Artificial Sequence
  cationic component of the polymeric carrier
CDHC

SEQ ID NO: 254 - protein, 4 aa, Artificial Sequence
  cationic component of the polymeric carrier
CHDC

SEQ ID NO: 255 - protein, 4 aa, Artificial Sequence
  cationic component of the polymeric carrier
CDDC

SEQ ID NO: 256 - protein, 4 aa, Artificial Sequence
  cationic component of the polymeric carrier
CHHC

SEQ ID NO: 257 - protein, 5 aa, Artificial Sequence
  cationic component of the polymeric carrier
CDHDC

SEQ ID NO: 258 - protein, 5 aa, Artificial Sequence
  cationic component of the polymeric carrier
CHDHC

SEQ ID NO: 259 - protein, 5 aa, Artificial Sequence
  cationic component of the polymeric carrier
CDDDC

SEQ ID NO: 260 - protein, 5 aa, Artificial Sequence
  cationic component of the polymeric carrier
CHHHC

SEQ ID NO: 261 - protein, 6 aa, Artificial Sequence
  cationic component of the polymeric carrier
CDHDHC

SEQ ID NO: 262 - protein, 6 aa, Artificial Sequence
  cationic component of the polymeric carrier
CHDHDC

SEQ ID NO: 263 - protein, 6 aa, Artificial Sequence
  cationic component of the polymeric carrier
CDDDDC

SEQ ID NO: 264 - protein, 6 aa, Artificial Sequence
  cationic component of the polymeric carrier
CHHHHC

SEQ ID NO: 265 - protein, 4 aa, Artificial Sequence
  cationic component of the polymeric carrier
KDEL

SEQ ID NO: 266 - protein, 4 aa, Artificial Sequence
  cationic component of the polymeric carrier
DDEL

SEQ ID NO: 267 - protein, 4 aa, Artificial Sequence
  cationic component of the polymeric carrier
DEEL

SEQ ID NO: 268 - protein, 4 aa, Artificial Sequence
  cationic component of the polymeric carrier
QEDL

SEQ ID NO: 269 - protein, 4 aa, Artificial Sequence
  cationic component of the polymeric carrier
RDEL

SEQ ID NO: 270 - protein, 8 aa, Artificial Sequence
  cationic component of the polymeric carrier
GQNLSTSN

SEQ ID NO: 271 - protein, 7 aa, Artificial Sequence
  cationic component of the polymeric carrier
PKKKRKV

SEQ ID NO: 272 - protein, 7 aa, Artificial Sequence
  cationic component of the polymeric carrier
PQKKIKS

SEQ ID NO: 273 - protein, 5 aa, Artificial Sequence
  cationic component of the polymeric carrier
QPKKP

SEQ ID NO: 274 - protein, 4 aa, Artificial Sequence
  cationic component of the polymeric carrier
RKKR

SEQ ID NO: 275 - protein, 12 aa, Artificial Sequence
  cationic component of the polymeric carrier
RKKRRQRRRAHQ

SEQ ID NO: 276 - protein, 16 aa, Artificial Sequence
  cationic component of the polymeric carrier
RQARRNRRRRWRERQR

SEQ ID NO: 277 - protein, 19 aa, Artificial Sequence
  cationic component of the polymeric carrier
MPLTRRRPAASQALAPPTP

SEQ ID NO: 278 - protein, 8 aa, Artificial Sequence
  cationic component of the polymeric carrier
GAALTILV

SEQ ID NO: 279 - protein, 8 aa, Artificial Sequence
  cationic component of the polymeric carrier
GAALTLLG

SEQ ID NO: 280 - protein, 15 aa, Artificial Sequence
  cationic component of the polymeric carrier
MDDQRDLISNNEQLP

SEQ ID NO: 281 - protein, 32 aa, Artificial Sequence
  cationic component of the polymeric carrier
  UNSURE (7)..(8): unknown
  UNSURE (32)..(32): unknown
MLFNLRXXLNNAAFRHGHNFMVRNFRCGQPLX

SEQ ID NO: 282 - protein, 8 aa, Artificial Sequence
  cationic component of the polymeric carrier
GCVCSSNP

SEQ ID NO: 283 - protein, 8 aa, Artificial Sequence
  cationic component of the polymeric carrier
GQTVTTPL

SEQ ID NO: 284 - protein, 8 aa, Artificial Sequence
  cationic component of the polymeric carrier
GQELSQHE

SEQ ID NO: 285 - protein, 8 aa, Artificial Sequence
  cationic component of the polymeric carrier
GNSPSYNP

SEQ ID NO: 286 - protein, 8 aa, Artificial Sequence
  cationic component of the polymeric carrier
GVSGSKGQ

SEQ ID NO: 287 - protein, 8 aa, Artificial Sequence
  cationic component of the polymeric carrier
GQTITTPL

SEQ ID NO: 288 - protein, 8 aa, Artificial Sequence
  cationic component of the polymeric carrier
GQTLTTPL

SEQ ID NO: 289 - protein, 8 aa, Artificial Sequence
  cationic component of the polymeric carrier
GQIFSRSA

SEQ ID NO: 290 - protein, 8 aa, Artificial Sequence
  cationic component of the polymeric carrier
GQIHGLSP

SEQ ID NO: 291 - protein, 8 aa, Artificial Sequence
  cationic component of the polymeric carrier
GARASVLS

SEQ ID NO: 292 - protein, 8 aa, Artificial Sequence
  cationic component of the polymeric carrier
GCTLSAEE

SEQ ID NO: 293 - protein, 8 aa, Artificial Sequence
  cationic component of the polymeric carrier
GAQVSSQK

SEQ ID NO: 294 - protein, 8 aa, Artificial Sequence
  cationic component of the polymeric carrier
GAQLSRNT

SEQ ID NO: 295 - protein, 8 aa, Artificial Sequence
  cationic component of the polymeric carrier
GNAAAAKK

SEQ ID NO: 296 - protein, 8 aa, Artificial Sequence
  cationic component of the polymeric carrier
GNEASYPL

SEQ ID NO: 297 - protein, 8 aa, Artificial Sequence
  cationic component of the polymeric carrier
GSSKSKPK

SEQ ID NO: 298 - RNA, 20 nt, Artificial Sequence
  immune stimmulatory RNA
gguuuuuuuuuuuuuuuggg

SEQ ID NO: 299 - RNA, 20 nt, Artificial Sequence
  immune stimmulatory RNA
ggggguuuuuuuuuuggggg

SEQ ID NO: 300 - RNA, 40 nt, Artificial Sequence
  immune stimmulatory RNA
ggggguuuuuuuuuuuuuuuuuuuuuuuuuuuuuuggggg

SEQ ID NO: 301 - RNA, 39 nt, Artificial Sequence
  immune stimmulatory RNA
guguguguguguuuuuuuuuuuuuuuugugugugugugu

SEQ ID NO: 302 - RNA, 39 nt, Artificial Sequence
  immune stimmulatory RNA
gguugguugguuuuuuuuuuuuuuuuugguugguugguu

SEQ ID NO: 303 - RNA, 20 nt, Artificial Sequence
  immune stimmulatory RNA
ggggggggguuugggggggg

SEQ ID NO: 304 - RNA, 20 nt, Artificial Sequence
  immune stimmulatory RNA
gggggggguuuugggggggg

SEQ ID NO: 305 - RNA, 20 nt, Artificial Sequence
  immune stimmulatory RNA
ggggggguuuuuuggggggg

SEQ ID NO: 306 - RNA, 20 nt, Artificial Sequence
  immune stimmulatory RNA
ggggggguuuuuuugggggg

SEQ ID NO: 307 - RNA, 20 nt, Artificial Sequence
  immune stimmulatory RNA
gggggguuuuuuuugggggg

SEQ ID NO: 308 - RNA, 20 nt, Artificial Sequence
  immune stimmulatory RNA
gggggguuuuuuuuuggggg

SEQ ID NO: 309 - RNA, 20 nt, Artificial Sequence
  immune stimmulatory RNA
gggggguuuuuuuuuugggg

SEQ ID NO: 310 - RNA, 20 nt, Artificial Sequence
  immune stimmulatory RNA
ggggguuuuuuuuuuugggg

SEQ ID NO: 311 - RNA, 20 nt, Artificial Sequence
  immune stimmulatory RNA
ggggguuuuuuuuuuuuggg

SEQ ID NO: 312 - RNA, 20 nt, Artificial Sequence
  immune stimmulatory RNA
gggguuuuuuuuuuuuuggg

SEQ ID NO: 313 - RNA, 20 nt, Artificial Sequence
  immune stimmulatory RNA
gggguuuuuuuuuuuuuugg

SEQ ID NO: 314 - RNA, 20 nt, Artificial Sequence
  immune stimmulatory RNA
gguuuuuuuuuuuuuuuugg

SEQ ID NO: 315 - RNA, 20 nt, Artificial Sequence
  immune stimmulatory RNA
guuuuuuuuuuuuuuuuuug

SEQ ID NO: 316 - RNA, 22 nt, Artificial Sequence
  immune stimmulatory RNA
gggggggggguuuggggggggg

SEQ ID NO: 317 - RNA, 22 nt, Artificial Sequence
  immune stimmulatory RNA
ggggggggguuuuggggggggg

SEQ ID NO: 318 - RNA, 22 nt, Artificial Sequence
  immune stimmulatory RNA
gggggggguuuuuugggggggg

SEQ ID NO: 319 - RNA, 22 nt, Artificial Sequence
  immune stimmulatory RNA
gggggggguuuuuuuggggggg

SEQ ID NO: 320 - RNA, 22 nt, Artificial Sequence
  immune stimmulatory RNA
ggggggguuuuuuuuggggggg

SEQ ID NO: 321 - RNA, 22 nt, Artificial Sequence
  immune stimmulatory RNA
ggggggguuuuuuuuugggggg

SEQ ID NO: 322 - RNA, 22 nt, Artificial Sequence
  immune stimmulatory RNA
ggggggguuuuuuuuuuggggg

SEQ ID NO: 323 - RNA, 22 nt, Artificial Sequence
  immune stimmulatory RNA
gggggguuuuuuuuuuuggggg

SEQ ID NO: 324 - RNA, 22 nt, Artificial Sequence
  immune stimmulatory RNA
gggggguuuuuuuuuuuugggg

SEQ ID NO: 325 - RNA, 22 nt, Artificial Sequence
  immune stimmulatory RNA
ggggguuuuuuuuuuuuugggg

SEQ ID NO: 326 - RNA, 22 nt, Artificial Sequence
  immune stimmulatory RNA
ggggguuuuuuuuuuuuuuggg

SEQ ID NO: 327 - RNA, 22 nt, Artificial Sequence
  immune stimmulatory RNA
ggguuuuuuuuuuuuuuuuggg

SEQ ID NO: 328 - RNA, 22 nt, Artificial Sequence
  immune stimmulatory RNA
gguuuuuuuuuuuuuuuuuugg

SEQ ID NO: 329 - RNA, 24 nt, Artificial Sequence
  immune stimmulatory RNA
ggggggggggguuugggggggggg

SEQ ID NO: 330 - RNA, 24 nt, Artificial Sequence
  immune stimmulatory RNA
gggggggggguuuugggggggggg

SEQ ID NO: 331 - RNA, 24 nt, Artificial Sequence
  immune stimmulatory RNA
ggggggggguuuuuuggggggggg

SEQ ID NO: 332 - RNA, 24 nt, Artificial Sequence
  immune stimmulatory RNA
ggggggggguuuuuuugggggggg

SEQ ID NO: 333 - RNA, 24 nt, Artificial Sequence
  immune stimmulatory RNA
gggggggguuuuuuuugggggggg

SEQ ID NO: 334 - RNA, 24 nt, Artificial Sequence
  immune stimmulatory RNA
gggggggguuuuuuuuuggggggg

SEQ ID NO: 335 - RNA, 24 nt, Artificial Sequence
  immune stimmulatory RNA
gggggggguuuuuuuuuugggggg

SEQ ID NO: 336 - RNA, 24 nt, Artificial Sequence
  immune stimmulatory RNA
ggggggguuuuuuuuuuugggggg

SEQ ID NO: 337 - RNA, 24 nt, Artificial Sequence
  immune stimmulatory RNA
ggggggguuuuuuuuuuuuggggg

SEQ ID NO: 338 - RNA, 24 nt, Artificial Sequence
  immune stimmulatory RNA
gggggguuuuuuuuuuuuuggggg

SEQ ID NO: 339 - RNA, 24 nt, Artificial Sequence
  immune stimmulatory RNA
gggggguuuuuuuuuuuuuugggg

SEQ ID NO: 340 - RNA, 24 nt, Artificial Sequence
  immune stimmulatory RNA
gggguuuuuuuuuuuuuuuugggg

SEQ ID NO: 341 - RNA, 24 nt, Artificial Sequence
  immune stimmulatory RNA
ggguuuuuuuuuuuuuuuuuuggg

SEQ ID NO: 342 - RNA, 32 nt, Artificial Sequence
  immune stimmulatory RNA
guuuuuuuuuuuuuuuuuuuuuuuuuuuuuug

SEQ ID NO: 343 - RNA, 34 nt, Artificial Sequence
  immune stimmulatory RNA
gguuuuuuuuuuuuuuuuuuuuuuuuuuuuuugg

SEQ ID NO: 344 - RNA, 36 nt, Artificial Sequence
  immune stimmulatory RNA
ggguuuuuuuuuuuuuuuuuuuuuuuuuuuuuuggg

SEQ ID NO: 345 - RNA, 37 nt, Artificial Sequence
  immune stimmulatory RNA
gggguuuuuuuuuuuuuuuuuuuuuuuuuuuuuuggg

SEQ ID NO: 346 - RNA, 39 nt, Artificial Sequence
  immune stimmulatory RNA
ggggguuuuuuuuuuuuuuuuuuuuuuuuuuuuuugggg

SEQ ID NO: 347 - RNA, 41 nt, Artificial Sequence
  immune stimmulatory RNA
gggggguuuuuuuuuuuuuuuuuuuuuuuuuuuuuuggggg

SEQ ID NO: 348 - RNA, 43 nt, Artificial Sequence
  immune stimmulatory RNA
ggggggguuuuuuuuuuuuuuuuuuuuuuuuuuuuuugggggg

SEQ ID NO: 349 - RNA, 45 nt, Artificial Sequence
  immune stimmulatory RNA
gggggggguuuuuuuuuuuuuuuuuuuuuuuuuuuuuuggggggg

SEQ ID NO: 350 - RNA, 47 nt, Artificial Sequence
  immune stimmulatory RNA
ggggggggguuuuuuuuuuuuuuuuuuuuuuuuuuuuuugggggggg

SEQ ID NO: 351 - RNA, 7 nt, Artificial Sequence
  immune stimmulatory RNA
gguuugg

SEQ ID NO: 352 - RNA, 8 nt, Artificial Sequence
  immune stimmulatory RNA
gguuuugg

SEQ ID NO: 353 - RNA, 9 nt, Artificial Sequence
  immune stimmulatory RNA
gguuuuugg

SEQ ID NO: 354 - RNA, 10 nt, Artificial Sequence
  immune stimmulatory RNA
gguuuuuugg

SEQ ID NO: 355 - RNA, 11 nt, Artificial Sequence
  immune stimmulatory RNA
gguuuuuuugg

SEQ ID NO: 356 - RNA, 12 nt, Artificial Sequence
  immune stimmulatory RNA
gguuuuuuuugg

SEQ ID NO: 357 - RNA, 13 nt, Artificial Sequence
  immune stimmulatory RNA
gguuuuuuuuugg

SEQ ID NO: 358 - RNA, 14 nt, Artificial Sequence
  immune stimmulatory RNA
gguuuuuuuuuugg

SEQ ID NO: 359 - RNA, 15 nt, Artificial Sequence
  immune stimmulatory RNA
gguuuuuuuuuuugg

SEQ ID NO: 360 - RNA, 16 nt, Artificial Sequence
  immune stimmulatory RNA
gguuuuuuuuuuuugg

SEQ ID NO: 361 - RNA, 17 nt, Artificial Sequence
  immune stimmulatory RNA
gguuuuuuuuuuuuugg

SEQ ID NO: 362 - RNA, 18 nt, Artificial Sequence
  immune stimmulatory RNA
gguuuuuuuuuuuuuugg

SEQ ID NO: 363 - RNA, 19 nt, Artificial Sequence
  immune stimmulatory RNA
gguuuuuuuuuuuuuuugg

SEQ ID NO: 364 - RNA, 9 nt, Artificial Sequence
  immune stimmulatory RNA
ggguuuggg

SEQ ID NO: 365 - RNA, 10 nt, Artificial Sequence
  immune stimmulatory RNA
ggguuuuggg

SEQ ID NO: 366 - RNA, 11 nt, Artificial Sequence
  immune stimmulatory RNA
ggguuuuuggg

SEQ ID NO: 367 - RNA, 12 nt, Artificial Sequence
  immune stimmulatory RNA
ggguuuuuuggg

SEQ ID NO: 368 - RNA, 13 nt, Artificial Sequence
  immune stimmulatory RNA
ggguuuuuuuggg

SEQ ID NO: 369 - RNA, 14 nt, Artificial Sequence
  immune stimmulatory RNA
ggguuuuuuuuggg

SEQ ID NO: 370 - RNA, 15 nt, Artificial Sequence
  immune stimmulatory RNA
ggguuuuuuuuuggg

SEQ ID NO: 371 - RNA, 16 nt, Artificial Sequence
  immune stimmulatory RNA
ggguuuuuuuuuuggg

SEQ ID NO: 372 - RNA, 17 nt, Artificial Sequence
  immune stimmulatory RNA
ggguuuuuuuuuuuggg

SEQ ID NO: 373 - RNA, 18 nt, Artificial Sequence
  immune stimmulatory RNA
ggguuuuuuuuuuuuggg

SEQ ID NO: 374 - RNA, 19 nt, Artificial Sequence
  immune stimmulatory RNA
ggguuuuuuuuuuuuuggg

SEQ ID NO: 375 - RNA, 57 nt, Artificial Sequence
  immune stimmulatory RNA
ggguuuuuuuuuuuuuuuggguuuuuuuuuuuuuuuggguuuuuuuuuuuuuuuggg

SEQ ID NO: 376 - RNA, 42 nt, Artificial Sequence
  immune stimmulatory RNA
ggguuuuuuuuuuuuuuugggggguuuuuuuuuuuuuuuggg

SEQ ID NO: 377 - RNA, 51 nt, Artificial Sequence
  immune stimmulatory RNA
ggguuuggguuuggguuuggguuuggguuuggguuuggguuuggguuuggg

SEQ ID NO: 378 - RNA, 20 nt, Artificial Sequence
  immune stimmulatory RNA
gguuuuuuuuuuuuuuuggg

SEQ ID NO: 379 - RNA, 57 nt, Artificial Sequence
  immune stimmulatory RNA
cccuuuuuuuuuuuuuuucccuuuuuuuuuuuuuuucccuuuuuuuuuuuuuuuccc

SEQ ID NO: 380 - RNA, 51 nt, Artificial Sequence
  immune stimmulatory RNA
cccuuucccuuucccuuucccuuucccuuucccuuucccuuucccuuuccc

SEQ ID NO: 381 - RNA, 42 nt, Artificial Sequence
  immune stimmulatory RNA
cccuuuuuuuuuuuuuuuccccccuuuuuuuuuuuuuuuccc

SEQ ID NO: 382 - RNA, 60 nt, Artificial Sequence
  immune stimmulatory RNA
uagcgaagcucuuggaccuagguuuuuuuuuuuuuuugggugcguuccuagaaguacacg

SEQ ID NO: 383 - RNA, 120 nt, Artificial Sequence
  immune stimmulatory RNA
uagcgaagcucuuggaccuagguuuuuuuuuuuuuuugggugcguuccuagaaguacacgaucgcuucgagaaccuggauccaaaaaaaaaaaaaaacccacgcaaggaucuucaugugc

SEQ ID NO: 384 - RNA, 229 nt, Artificial Sequence
  immune stimmulatory RNA
gggagaaagcucaagcuuggagcaaugcccgcacauugaggaaaccgaguugcauaucucagaguauuggcccccguguagguuauucuugacagacaguggagcuuauucacucccaggauccgagucgcauacuacgguacuggugacagaccuaggucgucaguugaccaguccgccacuagacgugaguccgucaaagcaguuagauguuacacucuauuagauc

SEQ ID NO: 385 - RNA, 547 nt, Artificial Sequence
  immune stimmulatory RNA
gggagaaagcucaagcuuggagcaaugcccgcacauugaggaaaccgaguugcauaucucagaguauuggcccccguguagguuauucuugacagacaguggagcuuauucacucccaggauccgagucgcauacuacgguacuggugacagaccuaggucgucaguugaccaguccgccacuagacgugaguccgucaaagcaguuagauguuacacucuauuagaucucggauuacagcuggaaggagcaggaguaguguucuugcucuaaguaccgagugugcccaauacccgaucagcuuauuaacgaacggcuccuccucuuagacugcagcguaagugcggaaucuggggaucaaauuacugacugccuggauuacccucggacauauaaccuuguagcacgcuguugcuguauaggugaccaacgcccacucgaguagaccagcucucuuaguccggacaaugauaggaggcgcggucaaucuacuucuggcuaguuaagaauaggcugcaccgaccucuauaaguagcguguccucuag

SEQ ID NO: 386 - RNA, 1083 nt, Artificial Sequence
  immune stimmulatory RNA
gggagaaagcucaagcuuggagcaaugcccgcacauugaggaaaccgaguugcauaucucagaguauuggcccccguguagguuauucuugacagacaguggagcuuauucacucccaggauccgagucgcauacuacgguacuggugacagaccuaggucgucaguugaccaguccgccacuagacgugaguccgucaaagcaguuagauguuacacucuauuagaucucggauuacagcuggaaggagcaggaguaguguucuugcucuaaguaccgagugugcccaauacccgaucagcuuauuaacgaacggcuccuccucuuagacugcagcguaagugcggaaucuggggaucaaauuacugacugccuggauuacccucggacauauaaccuuguagcacgcuguugcuguauaggugaccaacgcccacucgaguagaccagcucucuuaguccggacaaugauaggaggcgcggucaaucuacuucuggcuaguuaagaauaggcugcaccgaccucuauaaguagcguguccucuagagcuacgcagguucgcaauaaaagcguugauuagugugcauagaacagaccucuuauucggugaaacgccagaaugcuaaauuccaauaacucuucccaaaacgcguacggccgaagacgcgcgcuuaucuuguguacguucucgcacauggaagaaucagcgggcauggugguagggcaauaggggagcuggguagcagcgaaaaagggccccugcgcacguagcuucgcuguucgucugaaacaacccggcauccguuguagcgaucccguuaucaguguuauucuugugcgcacuaagauucaugguguagucgacaauaacagcgucuuggcagauucuggucacgugcccuaugcccgggcuugugccucucaggugcacagcgauacuuaaagccuucaagguacucgacguggguaccgauucgugacacuuccuaagauuauuccacuguguuagccccgcaccgccgaccuaaacugguccaauguauacgcauucgcugagcggaucgauaauaaaagcuugaauu

SEQ ID NO: 387 - RNA, 229 nt, Artificial Sequence
  immune stimmulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagauc

SEQ ID NO: 388 - RNA, 546 nt, Artificial Sequence
  immune stimmulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucua

SEQ ID NO: 389 - RNA, 856 nt, Artificial Sequence
  R3971 coding for the mouse Pdcd1(1-157,C83S) protein
ggggcgcugccuacggagguggcagccaucuccuucucggcaucaagcuuaccaugugggugcgccagguccccuggagcuucaccugggccgugcugcagcucuccuggcagagcggcuggcugcuggaggugccgaacgggcccuggcggucccucaccuucuaccccgccuggcugacggucagcgagggcgcgaacgccaccuucaccugcucccugagcaacugguccgaggaccucaugcugaacuggaaccgccugagccccuccaaccagaccgagaagcaggccgccuucagcaacgggcucucccagccggugcaggacgcccgguuccagaucauccagcugcccaaccgccacgacuuccacaugaacauccuggacacgcggcgcaacgacagcggcaucuaccucugcggggcgaucucccugcaccccaaggccaagaucgaggagagccccggcgccgagcugguggucaccgagcggauccucgagaccuccacccgcuacccgagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 390 - protein, 862 aa, Artificial Sequence
  AXIN1__Homo sapiens__O15169
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 391 - protein, 695 aa, Artificial Sequence
  DVL1__Homo sapiens__O14640
MAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYGTSPCSSAVTRTSSSSLTSSVPGAPQLEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 392 - protein, 619 aa, Artificial Sequence
  TF7L2__Homo sapiens__Q9NQB0
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 393 - protein, 420 aa, Artificial Sequence
  GSK3B__Homo sapiens__P49841
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 394 - RNA, 547 nt, Artificial Sequence; identical to SEQ ID NO: 5
  immune stimmulatory RNA R2025

SEQ ID NO: 395 - RNA, 1083 nt, Artificial Sequence
  immune stimmulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuagaacgaacugaccugacgccugaacuuaugagcgugcguauuuuuuuuuuuuuuuuuuuuuuuccucccaacaaaugucgaucaauagcugggcuguuggagacgcgucagcaaaugccguggcuccauaggacguguagacuucuauuuuuuuuuuuuuuuuuuuuucccgggaccacaaauaauauucuugcuugguugggcgcaagggccccguaucaggucauaaacggguacauguugcacaggcuccuuuuuuuuuuuuuuuuuuuuuuucgcugaguuauuccggucucaaaagacggcagacgucagucgacaacacggucuaaagcagugcuacaaucugccguguucguguuuuuuuuuuuuuuuuuuuugugaaccuacacggcgugcacuguaguucgcaauucauaggguaccggcucagaguuaugccuugguugaaaacugcccagcauacuuuuuuuuuuuuuuuuuuuucauauucccaugcuaagcaagggaugccgcgagucauguuaagcuugaauu

SEQ ID NO: 396 - RNA, 59 nt, Artificial Sequence
  immune stimmulatory RNA
uagcgaagcucuuggaccuaccuuuuuuuuuuuuuucccugcguuccuagaaguacacg

SEQ ID NO: 397 - RNA, 120 nt, Artificial Sequence
  immune stimmulatory RNA
uagcgaagcucuuggaccuaccuuuuuuuuuuuuuuucccugcguuccuagaaguacacgaucgcuucgagaaccuggauggaaaaaaaaaaaaaaagggacgcaaggaucuucaugugc

SEQ ID NO: 398 - protein, 365 aa, Artificial Sequence
  1A01_HLA-A/m__Homo_sapiens__P30443
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 399 - RNA, 1098 nt, Artificial Sequence
  1A01_HLA-A/m__Homo_sapiens__AAA59652
auggccgucauggcgccccgaacccuccuccugcuacucucgggggcccuggcccugacccagaccugggcgggcucccacuccaugagguauuucuucacauccgugucccggcccggccgcggggagccccgcuucaucgccgugggcuacguggacgacacgcaguucgugcgguucgacagcgacgccgcgagccagaagauggagccgcgggcgccguggauagagcaggaggggccggaguauugggaccaggagacacggaauaugaaggcccacucacagacugaccgagcgaaccuggggacccugcgcggcuacuacaaccagagcgaggacgguucucacaccauccagauaauguauggcugcgacguggggccggacgggcgcuuccuccgcggguaccggcaggacgccuacgacggcaaggauuacaucgcccugaacgaggaccugcgcucuuggaccgcggcggacauggcagcucagaucaccaagcgcaagugggaggcgguccaugcggcggagcagcggagagucuaccuggagggccggugcguggacgggcuccgcagauaccuggagaacgggaaggagacgcugcagcgcacggacccccccaagacacauaugacccaccaccccaucucugaccaugaggccacccugaggugcugggcccugggcuucuacccugcggagaucacacugaccuggcagcgggauggggaggaccagacccaggacacggagcucguggagaccaggccugcaggggauggaaccuuccagaagugggcggcugugguggugccuucuggagaggagcagagauacaccugccaugugcagcaugagggucugcccaagccccucacccugagaugggagcugucuucccagcccaccauccccaucgugggcaucauugcuggccugguucuccuuggagcugugaucacuggagcuguggucgcugccgugauguggaggaggaagagcucagauagaaaaggagggaguuacacucaggcugcaagcagugacagugcccagggcucugaugugucucucacagcuuguaaaguguga

SEQ ID NO: 400 - RNA, 1098 nt, Artificial Sequence
  derived and/or modified sequence opt1 from 1A01_HLA-A/m__Homo_sapiens__AAA59652
auggccgugauggcgccccgcacccugcuccugcugcucagcggcgcccuggcccugacccagacgugggccgggucccacagcaugcgguacuucuucaccuccgucagccgcccgggccgcggggagccccgguucaucgccgugggcuacguggacgacacccaguucguccgguucgacuccgacgccgcgagccagaagauggagccccgcgcccccuggaucgagcaggaggggccggaguacugggaccaggagacccggaacaugaaggcccacucccagacggaccgcgccaaccucggcacccugcggggcuacuacaaccagagcgaggacgggucccacaccauccagaucauguacggcugcgacguggggcccgacggccgcuuccugcggggguaccgccaggacgcguacgacggcaaggacuacaucgcccucaacgaggaccugcggagcuggaccgccgccgacauggccgcgcagaucacgaagcgcaagugggaggccgugcacgccgccgagcagcggcgcgucuaccuggagggccggugcguggacgggcuccgccgguaccuggagaacggcaaggagacccugcagcgcaccgacccgcccaagacccacaugacgcaccaccccaucuccgaccacgaggccacccuccggugcugggcgcugggguucuaccccgccgagaucacccugaccuggcagcgcgacggcgaggaccagacgcaggacaccgagcucguggagacccgccccgccggcgacgggaccuuccagaagugggccgccgucguggugcccagcggcgaggagcagcgguacacgugccacguccagcacgaggggcugccgaagccccugacccuccgcugggagcuguccagccagcccaccauccccaucgugggcaucaucgcggggcuggugcuccugggcgccgucaucaccggcgccgugguggccgccgucauguggcggcgcaaguccagcgaccggaagggcggguccuacacgcaggcggccagcuccgacagcgcccaggggagcgacgugucccugaccgccugcaagguguga

SEQ ID NO: 401 - RNA, 1098 nt, Artificial Sequence
  derived and/or modified sequence opt2 from 1A01_HLA-A/m__Homo_sapiens__AAA59652
auggccgucauggccccccgcacccuccuccuccuccucuccggcgcccucgcccucacccagaccugggccggcucccacuccaugcgcuacuucuucaccuccgucucccgccccggccgcggcgagccccgcuucaucgccgucggcuacgucgacgacacccaguucguccgcuucgacuccgacgccgccucccagaagauggagccccgcgcccccuggaucgagcaggagggccccgaguacugggaccaggagacccgcaacaugaaggcccacucccagaccgaccgcgccaaccucggcacccuccgcggcuacuacaaccaguccgaggacggcucccacaccauccagaucauguacggcugcgacgucggccccgacggccgcuuccuccgcggcuaccgccaggacgccuacgacggcaaggacuacaucgcccucaacgaggaccuccgcuccuggaccgccgccgacauggccgcccagaucaccaagcgcaagugggaggccguccacgccgccgagcagcgccgcgucuaccucgagggccgcugcgucgacggccuccgccgcuaccucgagaacggcaaggagacccuccagcgcaccgacccccccaagacccacaugacccaccaccccaucuccgaccacgaggccacccuccgcugcugggcccucggcuucuaccccgccgagaucacccucaccuggcagcgcgacggcgaggaccagacccaggacaccgagcucgucgagacccgccccgccggcgacggcaccuuccagaagugggccgccgucgucguccccuccggcgaggagcagcgcuacaccugccacguccagcacgagggccuccccaagccccucacccuccgcugggagcucuccucccagcccaccauccccaucgucggcaucaucgccggccucguccuccucggcgccgucaucaccggcgccgucgucgccgccgucauguggcgccgcaaguccuccgaccgcaagggcggcuccuacacccaggccgccuccuccgacuccgcccagggcuccgacgucucccucaccgccugcaaggucuga

SEQ ID NO: 402 - RNA, 1098 nt, Artificial Sequence
  derived and/or modified sequence opt3 from 1A01_HLA-A/m__Homo_sapiens__AAA59652
auggccgugauggcucccagaacccugcuccuucuguugagcggcgcauuagcccugacacagacuugggcggggucccacucuaugagguacuucuuuacgucagucagucggccuggacgcggugagccacgauucaucgcuguuggcuauguggacgauacccaauuuguacguuucgacagcgaugccgcaucccagaagauggaaccgagagcccccuggauugagcaggaagggccugaguacugggaccaggaaacaaggaacaugaaagcucauucucaaacugaucgggcaaaucuaggaacccuccgcggcuauuacaaccagucggaggacgguucacacacaauacagaucauguaugggugcgaugugggaccagacggcagauuucugaggggcuaccggcaggaugccuaugacgggaaggauuacauugcucuuaaugaggaccugcgcagcuggaccgccgcggauauggcagcccaaaucacuaaacgaaagugggaagcuguccaugccgcagagcagagaaggguguacuuggaaggacgguguguugacggucuccgucgcuaucuggagaacggcaaagagacacugcagagaaccgaucccccuaagacgcacaugacucaucacccaauuagugaccacgaagcuacccucaggugcugggccuuaggguucuaccccgcggagaucacacugacuuggcagcgggacggagaagaucaaacccaggacacagagcuuguggaaacccgaccugccggcgaugguacguuucagaagugggcagcugucgugguaccauccggggaggagcaacgcuauacuugucauguucagcacgaaggauugccgaaaccccugacacuaagaugggagcucucuagccagccuaccauaccaaucgugggcauuaucgccggccugguccuucugggggcugugauuacuggagccguggucgcagccguuauguggaggcggaaguccucagaccgcaaagguggcaguuacacacaggcugcgagcucugauuccgcacaagggucagacgugagcuugaccgccugcaagguauga

SEQ ID NO: 403 - RNA, 1098 nt, Artificial Sequence
  derived and/or modified sequence opt4 from 1A01_HLA-A/m__Homo_sapiens__AAA59652
auggccgugauggcccccagaacccugcugcugcugcugagcggcgcccuggcccugacccagaccugggccggcagccacagcaugagauacuucuucaccagcgugagcagacccggcagaggcgagcccagauucaucgccgugggcuacguggacgacacccaguucgugagauucgacagcgacgccgccagccagaagauggagcccagagcccccuggaucgagcaggagggccccgaguacugggaccaggagaccagaaacaugaaggcccacagccagaccgacagagccaaccugggcacccugagaggcuacuacaaccagagcgaggacggcagccacaccauccagaucauguacggcugcgacgugggccccgacggcagauuccugagaggcuacagacaggacgccuacgacggcaaggacuacaucgcccugaacgaggaccugagaagcuggaccgccgccgacauggccgcccagaucaccaagagaaagugggaggccgugcacgccgccgagcagagaagaguguaccuggagggcagaugcguggacggccugagaagauaccuggagaacggcaaggagacccugcagagaaccgacccccccaagacccacaugacccaccaccccaucagcgaccacgaggccacccugagaugcugggcccugggcuucuaccccgccgagaucacccugaccuggcagagagacggcgaggaccagacccaggacaccgagcugguggagaccagacccgccggcgacggcaccuuccagaagugggccgccgugguggugcccagcggcgaggagcagagauacaccugccacgugcagcacgagggccugcccaagccccugacccugagaugggagcugagcagccagcccaccauccccaucgugggcaucaucgccggccuggugcugcugggcgccgugaucaccggcgccgugguggccgccgugauguggagaagaaagagcagcgacagaaagggcggcagcuacacccaggccgccagcagcgacagcgcccagggcagcgacgugagccugaccgccugcaagguguga

SEQ ID NO: 404 - RNA, 1098 nt, Artificial Sequence
  derived and/or modified sequence opt5 from 1A01_HLA-A/m__Homo_sapiens__AAA59652
auggccgugauggcucccagaacccugcuccugcuucugagcggcgcccucgcgcugacacagacgugggcugggucccacucuaugcgguacuucuuuaccagcgucucccgcccuggaagaggcgagccgcgguucaucgccguuggguauguggacgauacacaauuugugcgcuucgacucugaugccgcuagccagaagauggaacccagagccccuuggauugagcaggaaggacccgaguacugggaccaggaaacccggaacaugaaagcucauucccaaacagaucgcgccaaucuuggcacccugagaggguauuacaaccagucugaggacggaagccacacaauccagauuauguauggcugcgaugucggcccugacgggcgguuucuccgcggauacagacaggaugcguaugacggcaaggauuacaucgcccugaaugaggaccugcgguccuggaccgcugccgauauggcugcccaaauuacgaaacgcaagugggaagcggugcaugccgcugagcagagacggguuuaccucgaagggcgcuguguggacggacugagacgguaucuugagaacggcaaagagacccugcagagaacagaucccccuaagacccacaugacacaucacccgaucagcgaccacgaagccacccuccgcugcugggcucugggguucuaccccgccgagaucacgcuuacauggcagcgggacggagaagaucaaacccaggacacagagcuggucgaaaccagaccugccggcgauggcaccuuucagaagugggcugcggugguugugcccucuggggaggagcaacgcuauacaugucauguccagcacgaaggacucccuaaaccccugacgcugcggugggagcucuccagccagccgaccauuccuaucgugggcauuaucgccgggcuggugcuucugggagcugucauuacaggcgccguuguggccgcugugauguggagacgcaagucuuccgaccggaaagggggaagcuacacccaggccgcgucuuccgauagcgcucaaggcuccgacgucucucucacagccugcaagguguga

SEQ ID NO: 405 - protein, 365 aa, Artificial Sequence [sequence omitted]

SEQ ID NO: 406 - RNA, 1098 nt, Artificial Sequence
  1A02__Homo_sapiens__AAA59606
auggccgucauggcgccccgaacccucguccugcuacucucgggggcucuggcccugacccagaccugggcgggcucucacuccaugagguauuucuucacauccgugucccggcccggccgcggggagccccgcuucaucgcagugggcuacguggacgacacgcaguucgugcgguucgacagcgacgccgcgagccagaggauggagccgcgggcgccguggauagagcaggaggguccggaguauugggacggggagacacggaaagugaaggcccacucacagacucaccgaguggaccuggggacccugcgcggcuacuacaaccagagcgaggccgguucucacaccguccagaggauguauggcugcgacguggggucggacuggcgcuuccuccgcggguaccaccaguacgccuacgacggcaaggauuacaucgcccugaaagaggaccugcgcucuuggaccgcggcggacauggcagcucagaccaccaagcacaagugggaggcggcccauguggcggagcaguugagagccuaccuggagggcacgugcguggaguggcuccgcagauaccuggagaacgggaaggagacgcugcagcgcacggacgcccccaaaacgcauaugacucaccacgcugucucugaccaugaagccacccugaggugcugggcccugagcuucuacccugcggagaucacacugaccuggcagcgggauggggaggaccagacccaggacacggagcucguggagaccaggccugcaggggauggaaccuuccagaagugggcggcugugguggugccuucuggacaggagcagagauacaccugccaugugcagcaugaggguuugcccaagccccucacccugagaugggagccgucuucccagcccaccauccccaucgugggcaucauugcuggccugguucucuuuggagcugugaucacuggagcuguggucgcugcugugauguggaggaggaagagcucagauagaaaaggagggagcuacucucaggcugcaagcagugacagugcccagggcucugaugugucucucacagcuuguaaaguguga

SEQ ID NO: 407 - RNA, 1098 nt, Artificial Sequence
  derived and/or modified sequence opt1 from 1A02__Homo_sapiens__AAA59606
auggccgugauggcgccccgcacccugguccuccugcugagcggcgcccucgcccugacccagacgugggccgggucccacagcaugcgguacuucuucaccuccgugagccgcccgggccggggcgagccccgcuucaucgccgugggcuacgucgacgacacccaguucgugcgguucgacuccgacgccgcgagccagcgcauggagccccgggcccccuggaucgagcaggaggggccggaguacugggacggcgagacccgcaaggugaaggcccacucccagacgcaccgggucgaccugggcacccuccgcggguacuacaaccagagcgaggccggcucccacaccgugcagcggauguacgggugcgacgugggcagcgacuggcgcuuccugcggggguaccaccaguacgcguacgacggcaaggacuacaucgcccugaaggaggaccuccgcuccuggaccgccgccgacauggccgcgcagacgaccaagcacaagugggaggccgcccacgucgccgagcagcugcgggccuaccuggaggggaccugcguggaguggcuccgccgguaccuggagaacgggaaggagacccugcagcgcacggacgcgcccaagacccacaugacccaccacgccgugagcgaccacgaggccacccuccggugcugggcccuguccuucuaccccgccgagaucacgcugaccuggcagcgcgacggcgaggaccagacccaggacaccgagcucgucgagacgcggcccgcgggggacggcaccuuccagaagugggccgccgugguggucccgagcggccaggagcagcgcuacacgugccacgugcagcacgaggggcugcccaagccccugacccuccgcugggagcccuccagccagccgaccauccccaucgugggcaucaucgccgggcugguccuguucggcgccgugaucaccggggcgguggucgccgccgugauguggcggcgcaaguccagcgaccggaagggcggcuccuacagccaggccgcgagcuccgacagcgcccagggguccgacgugagccucaccgccugcaaggucuga

SEQ ID NO: 408 - RNA, 1098 nt, Artificial Sequence
  derived and/or modified sequence opt2 from 1A02__Homo_sapiens__AAA59606
auggccgucauggccccccgcacccucguccuccuccucuccggcgcccucgcccucacccagaccugggccggcucccacuccaugcgcuacuucuucaccuccgucucccgccccggccgcggcgagccccgcuucaucgccgucggcuacgucgacgacacccaguucguccgcuucgacuccgacgccgccucccagcgcauggagccccgcgcccccuggaucgagcaggagggccccgaguacugggacggcgagacccgcaaggucaaggcccacucccagacccaccgcgucgaccucggcacccuccgcggcuacuacaaccaguccgaggccggcucccacaccguccagcgcauguacggcugcgacgucggcuccgacuggcgcuuccuccgcggcuaccaccaguacgccuacgacggcaaggacuacaucgcccucaaggaggaccuccgcuccuggaccgccgccgacauggccgcccagaccaccaagcacaagugggaggccgcccacgucgccgagcagcuccgcgccuaccucgagggcaccugcgucgaguggcuccgccgcuaccucgagaacggcaaggagacccuccagcgcaccgacgcccccaagacccacaugacccaccacgccgucuccgaccacgaggccacccuccgcugcugggcccucuccuucuaccccgccgagaucacccucaccuggcagcgcgacggcgaggaccagacccaggacaccgagcucgucgagacccgccccgccggcgacggcaccuuccagaagugggccgccgucgucguccccuccggccaggagcagcgcuacaccugccacguccagcacgagggccuccccaagccccucacccuccgcugggagcccuccucccagcccaccauccccaucgucggcaucaucgccggccucguccucuucggcgccgucaucaccggcgccgucgucgccgccgucauguggcgccgcaaguccuccgaccgcaagggcggcuccuacucccaggccgccuccuccgacuccgcccagggcuccgacgucucccucaccgccugcaaggucuga

SEQ ID NO: 409 - RNA, 1098 nt, Artificial Sequence
  derived and/or modified sequence opt3 from 1A02__Homo_sapiens__AAA59606
auggccgugauggcucccagaacccugguccuccuucugagcggcgcauuggccuuaacacagacuugggcggggucccacucuaugagguacuucuuuacgucaguuagucggccuggacgcggugagccacgauucaucgcugugggcuauguagacgauacccaauuugugcguuucgacagcgaugccgcaucccagagaauggaaccgagggcccccuggauugagcaggaagggccugaguacugggacggagaaacacggaaggucaaagcucauucucagacucaccgcguggaucugggcacccuaagagguuauuacaaccaaucggaggcagggucacauacaguucagaggauguauggaugcgacgugggcagcgauuggcgguuucuccgcggcuaccaccaguaugccuacgacgggaaggauuacauagcucugaaagaggaccuucgaaguuggaccgccgcggauauggcagcccagacuacaaagcauaaaugggaagcugcccacgucgcagagcaacugagagcuuauuuggaaggaaccuguguggaguggcucaggcgguaccuggagaaugguaaggaaacgcugcagcguacugacgccccaaagacccacaugacacaucacgcgguauccgaucaugaggccacucuccgcugcugggcauuaucuuucuaucccgcugaaaucacccugacauggcagagagacggcgaggaccagacccaagauacggaacuuguugagacuaggccugccggggacggaacauuucagaaaugggcugccguggucgugccaagcggccaggagcaacgguacaccugucacgugcagcacgaagguuugcccaagccucugacucuacgaugggagccauccucacagccgacaauucccaucgucgggauuaucgcaggacucguucuguucggcgccgugauaaccggcgcuguaguggcggcagucauguggcgcagaaaaaguagcgauaggaaagggggaucuuauucccaggccgcuucaagcgacagugcccaagguucugaugugucccuuacggcaugcaagguuuga

SEQ ID NO: 410 - RNA, 1098 nt, Artificial Sequence
  derived and/or modified sequence opt4 from 1A02__Homo_sapiens__AAA59606
auggccgugauggcccccagaacccuggugcugcugcugagcggcgcccuggcccugacccagaccugggccggcagccacagcaugagauacuucuucaccagcgugagcagacccggcagaggcgagcccagauucaucgccgugggcuacguggacgacacccaguucgugagauucgacagcgacgccgccagccagagaauggagcccagagcccccuggaucgagcaggagggccccgaguacugggacggcgagaccagaaaggugaaggcccacagccagacccacagaguggaccugggcacccugagaggcuacuacaaccagagcgaggccggcagccacaccgugcagagaauguacggcugcgacgugggcagcgacuggagauuccugagaggcuaccaccaguacgccuacgacggcaaggacuacaucgcccugaaggaggaccugagaagcuggaccgccgccgacauggccgcccagaccaccaagcacaagugggaggccgcccacguggccgagcagcugagagccuaccuggagggcaccugcguggaguggcugagaagauaccuggagaacggcaaggagacccugcagagaaccgacgcccccaagacccacaugacccaccacgccgugagcgaccacgaggccacccugagaugcugggcccugagcuucuaccccgccgagaucacccugaccuggcagagagacggcgaggaccagacccaggacaccgagcugguggagaccagacccgccggcgacggcaccuuccagaagugggccgccgugguggugcccagcggccaggagcagagauacaccugccacgugcagcacgagggccugcccaagccccugacccugagaugggagcccagcagccagcccaccauccccaucgugggcaucaucgccggccuggugcuguucggcgccgugaucaccggcgccgugguggccgccgugauguggagaagaaagagcagcgacagaaagggcggcagcuacagccaggccgccagcagcgacagcgcccagggcagcgacgugagccugaccgccugcaagguguga

SEQ ID NO: 411 - RNA, 1098 nt, Artificial Sequence
  derived and/or modified sequence opt5 from 1A02__Homo_sapiens__AAA59606
auggccgugauggcucccagaacccugguccuccugcuuagcggcgcccuggcgcucacacagacgugggcugggucccacucuaugcgguacuucuuuaccagcguuucccgcccuggaagaggcgagccgcgguucaucgccgugggguauguggacgauacacaauuuguccgcuucgacucugaugccgcuagccagagaauggaaccccgggccccuuggauugagcaggaaggacccgaguacugggacggcgaaacccgcaaggugaaagcucauucccagacacacagaguugaucuggggacccuucggggauauuacaaccaaucugaggccggcagccauacagugcagcgcauguauggcugcgacgucggguccgauuggagauuucugcggggauaccaccaguaugcguacgacggcaaggauuacaucgcccucaaagaggaccugcgcagcuggaccgcugccgauauggcugcccagacgaccaagcauaaaugggaagcggcccacguggcugagcaacugagagccuaucucgaagggacauguguugaguggcugcggcgcuaccuugagaauggaaaggaaacccugcagagaacagacgcuccuaagacccacaugacgcaucacgccgugucugaucaugaggccacacuccggugcugggcucuguccuucuaucccgcggaaauuacccuuacauggcagagagacggcgaggaccagacccaagauaccgaacuggucgagacacgcccugccggggacggaacguuucagaaaugggcugccgugguggucccgagcggccaggagcaacgguacaccugucacguucagcacgaaggccuccccaagccucugacacugagaugggagcccucuucccagccuaccauccccauuguggggaucaucgccggacucgugcuguucggcgcugucauuacaggggccgugguugcggcugugauguggcgccggaaaagcucugauagaaagggaggcuccuauagccaggccgccuccucugacagcgcucaaggguccgaugucagccuuaccgccugcaaaguguga

SEQ ID NO: 412 - protein, 420 aa, Artificial Sequence
  5T4__Homo_sapiens__Q13641
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 413 - RNA, 1263 nt, Artificial Sequence
  5T4__Homo_sapiens__AAH37161
augccuggggggugcucccggggccccgccgccggggacgggcgucugcggcuggcgcgacuagcgcugguacuccugggcugggucuccucgucuucucccaccuccucggcauccuccuucuccuccucggcgccguuccuggcuuccgccguguccgcccagcccccgcugccggaccagugccccgcgcugugcgagugcuccgaggcagcgcgcacagucaagugcguuaaccgcaaucugaccgaggugcccacggaccugcccgccuacgugcgcaaccucuuccuuaccggcaaccagcuggccgugcucccugccggcgccuucgcccgccggccgccgcuggcggagcuggccgcgcucaaccucagcggcagccgccuggacgaggugcgcgcgggcgccuucgagcaucugcccagccugcgccagcucgaccucagccacaacccacuggccgaccucagucccuucgcuuucucgggcagcaaugccagcgucucggcccccaguccccuuguggaacugauccugaaccacaucgugcccccugaagaugagcggcagaaccggagcuucgagggcauggugguggcggcccugcuggcgggccgugcacugcaggggcuccgccgcuuggagcuggccagcaaccacuuccuuuaccugccgcgggaugugcuggcccaacugcccagccucaggcaccuggacuuaaguaauaauucgcuggugagccugaccuacguguccuuccgcaaccugacacaucuagaaagccuccaccuggaggacaaugcccucaagguccuucacaauggcacccuggcugaguugcaaggucuaccccacauuaggguuuuccuggacaacaaucccugggucugcgacugccacauggcagacauggugaccuggcucaaggaaacagagguagugcagggcaaagaccggcucaccugugcauauccggaaaaaaugaggaaucggguccucuuggaacucaacagugcugaccuggacugugacccgauucuucccccaucccugcaaaccucuuaugucuuccuggguauuguuuuagcccugauaggcgcuauuuuccuccugguuuuguauuugaaccgcaaggggauaaaaaaguggaugcauaacaucagagaugccugcagggaucacauggaaggguaucauuacagauaugaaaucaaugcggaccccagauuaacgaaccucaguucuaacucggaugucuga

SEQ ID NO: 414 - RNA, 1263 nt, Artificial Sequence
  derived and/or modified sequence opt1 from 5T4__Homo_sapiens__AAH37161
augcccggcgggugcagccgcggccccgccgccggggacggccggcugcgccucgcgcggcuggcccuggugcuccuggggugggucuccagcuccagccccaccuccagcgccuccagcuucuccagcuccgcccccuuccuggccagcgcgguguccgcccagcccccgcuccccgaccagugccccgcccugugcgagugcagcgaggccgcgcgcaccgugaagugcgucaaccggaaccugacggaggugcccaccgaccucccggccuacgugcgcaaccuguuccugaccggcaaccagcucgccguccugcccgccggcgccuucgcgcggcgcccgccccuggccgagcucgccgcccugaaccuguccgggagccggcucgacgaggugcgcgccggcgcguucgagcaccuccccucccugcggcagcuggaccugagccacaacccccuggccgaccucucccccuucgccuucagcgggagcaacgccuccgugagcgcccccuccccgcuggucgagcugauccucaaccacaucgugccgcccgaggacgagcgccagaaccggagcuucgagggcaugguggucgcggcccugcuggccgggcgcgcccuccagggccugcggcgccuggagcucgccuccaaccacuuccuguaccugccccgggacgugcucgcgcagcugcccagccugcgccaccucgaccuguccaacaacagccuggugucccucaccuacgucagcuuccggaaccugacgcaccuggagucccuccaccuggaggacaacgcccugaaggugcuccacaacggcacccuggccgagcugcaggggcugccccacauccgcguguuccucgacaacaaccccugggucugcgacugccacauggccgacauggugaccuggcugaaggagaccgaggugguccagggcaaggaccggcugacgugcgcguaccccgagaagaugcgcaaccgcgugcuccuggagcugaacagcgccgaccucgacugcgacccgauccugccgcccucccugcagaccagcuacguguuccucgggaucguccuggcccugaucggcgccaucuuccuccuggugcuguaccucaaccggaagggcaucaagaaguggaugcacaacauccgcgacgccugccgggaccacauggagggguaccacuaccgcuacgagaucaacgcggacccccggcugaccaaccuguccagcaacuccgacgucuga

SEQ ID NO: 415 - RNA, 1263 nt, Artificial Sequence
  derived and/or modified sequence opt2 from 5T4__Homo_sapiens__AAH37161
augcccggcggcugcucccgcggccccgccgccggcgacggccgccuccgccucgcccgccucgcccucguccuccucggcugggucuccuccuccucccccaccuccuccgccuccuccuucuccuccuccgcccccuuccucgccuccgccgucuccgcccagcccccccuccccgaccagugccccgcccucugcgagugcuccgaggccgcccgcaccgucaagugcgucaaccgcaaccucaccgagguccccaccgaccuccccgccuacguccgcaaccucuuccucaccggcaaccagcucgccguccuccccgccggcgccuucgcccgccgccccccccucgccgagcucgccgcccucaaccucuccggcucccgccucgacgagguccgcgccggcgccuucgagcaccuccccucccuccgccagcucgaccucucccacaacccccucgccgaccucucccccuucgccuucuccggcuccaacgccuccgucuccgcccccuccccccucgucgagcucauccucaaccacaucgucccccccgaggacgagcgccagaaccgcuccuucgagggcauggucgucgccgcccuccucgccggccgcgcccuccagggccuccgccgccucgagcucgccuccaaccacuuccucuaccucccccgcgacguccucgcccagcuccccucccuccgccaccucgaccucuccaacaacucccucgucucccucaccuacgucuccuuccgcaaccucacccaccucgagucccuccaccucgaggacaacgcccucaagguccuccacaacggcacccucgccgagcuccagggccucccccacauccgcgucuuccucgacaacaaccccugggucugcgacugccacauggccgacauggucaccuggcucaaggagaccgaggucguccagggcaaggaccgccucaccugcgccuaccccgagaagaugcgcaaccgcguccuccucgagcucaacuccgccgaccucgacugcgaccccauccucccccccucccuccagaccuccuacgucuuccucggcaucguccucgcccucaucggcgccaucuuccuccucguccucuaccucaaccgcaagggcaucaagaaguggaugcacaacauccgcgacgccugccgcgaccacauggagggcuaccacuaccgcuacgagaucaacgccgacccccgccucaccaaccucuccuccaacuccgacgucuga

SEQ ID NO: 416 - RNA, 1263 nt, Artificial Sequence
  derived and/or modified sequence opt3 from 5T4__Homo_sapiens__AAH37161
augcccggcgggugcagcagaggaccugccgcuggugacggcaggcugcggcucgcacgccuugcccugguguuguuagggugggucuccucuucaaguccaaccagcuccgcgucuucguucucaagcagugcuccguuucuggccuccgcaguuucugcccagcccccucuaccagaucaaugucccgcucucugcgaguguagcgaagcagcccgaacagugaagugcguaaaccguaaucugacugaggugccuacggaccuuccagcuuacgucagaaaccuguucuugaccggaaaucagcucgccgugcugcccgcgggcgcauuugccaggcggccuccacuggcugaacucgccgcauuaaaccuguccgguucacgccuugaugagguuagagcuggggccuucgaacacuugccgagucugaggcagcuagaccucagccauaauccccuggcggaucuuucuccuuuugccuucuccggaucaaacgcaagcgugagugcuccaucuccccuggucgaguugauccucaaucacauugugccuccagaggacgaacggcagaaccgcuccuuugagggcaugguaguugccgcucuguuagccggccgagcacugcaagggcucagaaggcuugaacuggccagcaaucauuucuuguaucuaccccgggaugugcuggcucagcucccgucgcugcgucaccuugaccugucuaacaauuccuuggucucacucacauacgugaguuuucgcaaccugacucauuuagagagccugcaccuagaggauaaugcgcucaaagugcugcacaacggaacccuugcagaauugcagggucugccucauauaagagucuuccucgacaauaaccccuggguuugugauugccacauggccgacauggugacauggcugaaggagaccgaaguagugcagggcaaagauaggcuuacuugugcuuauccagagaagaugcggaaccgaguccuguuggaacucaauuccgccgaccuggacugcgauccuaucuuacccccaucucugcaaacaagcuacguguuucuagggauuguucucgcacugaucggagccauuuuccuuuuggugcuguaucucaaccgcaaaggcaucaagaaguggaugcauaauauaagagacgcuuguagggaucacauggaggguuaccacuaucgguacgagaucaacgccgacccccgccugaccaauuuaucaaguaacuccgaugucuga

SEQ ID NO: 417 - RNA, 1263 nt, Artificial Sequence
  derived and/or modified sequence opt4 from 5T4__Homo_sapiens__AAH37161
augcccggcggcugcagcagaggccccgccgccggcgacggcagacugagacuggccagacuggcccuggugcugcugggcugggugagcagcagcagccccaccagcagcgccagcagcuucagcagcagcgcccccuuccuggccagcgccgugagcgcccagcccccccugcccgaccagugccccgcccugugcgagugcagcgaggccgccagaaccgugaagugcgugaacagaaaccugaccgaggugcccaccgaccugcccgccuacgugagaaaccuguuccugaccggcaaccagcuggccgugcugcccgccggcgccuucgccagaagacccccccuggccgagcuggccgcccugaaccugagcggcagcagacuggacgaggugagagccggcgccuucgagcaccugcccagccugagacagcuggaccugagccacaacccccuggccgaccugagccccuucgccuucagcggcagcaacgccagcgugagcgcccccagcccccugguggagcugauccugaaccacaucgugccccccgaggacgagagacagaacagaagcuucgagggcauggugguggccgcccugcuggccggcagagcccugcagggccugagaagacuggagcuggccagcaaccacuuccuguaccugcccagagacgugcuggcccagcugcccagccugagacaccuggaccugagcaacaacagccuggugagccugaccuacgugagcuucagaaaccugacccaccuggagagccugcaccuggaggacaacgcccugaaggugcugcacaacggcacccuggccgagcugcagggccugccccacaucagaguguuccuggacaacaaccccugggugugcgacugccacauggccgacauggugaccuggcugaaggagaccgagguggugcagggcaaggacagacugaccugcgccuaccccgagaagaugagaaacagagugcugcuggagcugaacagcgccgaccuggacugcgaccccauccugccccccagccugcagaccagcuacguguuccugggcaucgugcuggcccugaucggcgccaucuuccugcuggugcuguaccugaacagaaagggcaucaagaaguggaugcacaacaucagagacgccugcagagaccacauggagggcuaccacuacagauacgagaucaacgccgaccccagacugaccaaccugagcagcaacagcgacguguga

SEQ ID NO: 418 - RNA, 1263 nt, Artificial Sequence
  derived and/or modified sequence opt5 from 5T4__Homo_sapiens__AAH37161
augcccggcgggugcagcagaggaccugccgcuggcgacgggcggcugcgccucgccagacuggcgcuugugcugcucggaugggucuccucuagcuccccgaccucuagcgcuuccucuuucagcuccagcgcccccuuucuggccucugcuguuuccgcccagccuccccuuccugaucaaugucccgcucugugcgaguguagcgaagccgcgcggacagugaagugcgugaaccgcaaucucacggaggucccuaccgaccugccggccuacgugagaaaccuguuccucacaggcaaucagcuggcuguucuucccgccggggcuuuugcccggcgcccuccccuggcggaacucgccgcucugaaccuuucuggauccagacuggaugaggugcgggccggcgcuuucgaacaccucccuagccugcgccagcuggaccucucucauaauccccuggccgaucuuuccccguuugccuucagcggcuccaacgcuucugucagcgcgccuagcccccugguggagcucauccugaaucacauuguuccucccgaggacgaaagacagaaccgguccuuugaggggaugguggucgccgcccuucuggcuggacgcgcccuccaaggccugagacggcuggaacucgcuucuaaucauuuccuguaucuuccccgcgaugugcuggcccagcucccuucccugagacaccuugaccugagcaacaauucucucgugagccugaccuacgucuccuuucggaaccugacacaucucgagucucugcaccuugaggauaaugcgcugaaaguucuccacaacgggacccuggcugaacugcagggacuuccgcauaucagaguguuccucgacaauaaccccugggugugugauugccacauggccgacauggucacauggcugaaggagaccgaagugguucagggcaaagaucgccugacgugugccuauccugagaagaugcggaacagagugcuccuggaacuuaauagcgcugaccuggacugcgaucccauucucccucccucccugcaaaccagcuacgucuuucuggggaucgugcuugcccucauuggagcuaucuuccugcugguucucuaucugaaccgcaaaggcaucaagaaguggaugcauaauauucgggacgccuguagagaucacauggagggcuaccacuaucgcuacgagaucaacgcggacccgcggcuuacaaaucugucuuccaacagcgauguguga

SEQ ID NO: 419 - protein, 543 aa, Artificial Sequence
  ACRBP__Homo_sapiens__Q8NEB7
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 420 - RNA, 1632 nt, Artificial Sequence
  ACRBP__Homo_sapiens__AAH33010
augaggaagccagccgcuggcuuccuucccucacuccugaaggugcugcuccugccucuggcaccugccgcagcccaggauucgacucaggccuccacuccaggcagcccucucucuccuaccgaauacgaacgcuucuucgcacugcugacuccaaccuggaaggcagagacuaccugccgucuccgugcaacccacggcugccggaaucccacacucguccagcuggaccaauaugaaaaccacggcuuagugcccgauggugcugucugcuccaaccucccuuaugccuccugguuugagucuuucugccaguucacucacuaccguugcuccaaccacgucuacuaugccaagagaguccuguguucccagccagucucuauucucucaccuaacacucucaaggagauagaagcuucagcugaagucucacccaccacgaugaccucccccaucucaccccacuucacagugacagaacgccagaccuuccagcccuggccugagaggcucagcaacaacguggaagagcuccuacaauccuccuugucccugggaggccaggagcaagcgccagagcacaagcaggagcaaggaguggagcacaggcaggagccgacacaagaacacaagcaggaagaggggcagaaacaggaagagcaagaagaggaacaggaagaggagggaaagcaggaagaaggacaggggacuaaggagggacgggaggcugugucucagcugcagacagacucagagcccaaguuucacucugaaucucuaucuucuaacccuuccucuuuugcuccccggguacgagaaguagagucuacuccuaugauaauggagaacauccaggagcucauucgaucagcccaggaaauagaugaaaugaaugaaauauaugaugagaacuccuacuggagaaaccaaaacccuggcagccuccugcagcugccccacacagaggccuugcuggugcugugcuauucgaucguggagaauaccugcaucauaacccccacagccaaggccuggaaguacauggaggaggagauccuugguuucgggaagucggucugugacagccuugggcggcgacacaugucuaccugugcccucugugacuucugcuccuugaagcuggagcagugccacucagaggccagccugcagcggcaacaaugcgacaccucccacaagacucccuuugucagccccuugcuugccucccagagccuguccaucggcaaccagguaggguccccagaaucaggccgcuuuuacgggcuggauuuguacggugggcuccacauggacuucuggugugcccggcuugccacgaaaggcugugaagauguccgagucucuggguggcuccagacugaguuccuuagcuuccaggauggggauuucccuaccaagauuugugacacagacuauauccaguacccaaacuacuguuccuucaaaagccagcagugucugaugagaaaccgcaaucggaaggugucccgcaugagaugucugcagaaugagacuuacagugcgcugagcccuggcaaaagugaggacguugugcuucgauggagccaggaguucagcaccuugacucuaggccaguucggauga

SEQ ID NO: 421 - RNA, 1632 nt, Artificial Sequence
  derived and/or modified sequence opt1 from ACRBP__Homo_sapiens__AAH33010
augcgcaagcccgccgccggcuuccugccgagccuccugaaggugcugcuccugccccuggcgcccgccgccgcccaggacuccacccaggccagcacccccggguccccgcucagccccacggaguacgagcgguucuucgcgcugcugacccccaccuggaaggccgagaccacgugccgccuccgggccacccacggcugccgcaaccccacccugguccagcuggaccaguacgagaaccacgggcucgugccggacggcgccgugugcuccaaccugcccuacgcgagcugguucgaguccuucugccaguucacccacuaccggugcagcaaccacgucuacuacgccaagcgcgugcugugcucccagcccgugagcauccucucccccaacacgcugaaggagaucgaggccagcgccgaggucuccccgaccaccaugaccagccccaucagcccccacuucacggugaccgagcggcagaccuuccagcccuggccggagcgccugagcaacaacguggaggagcuccugcaguccagccugucccucgggggccaggagcaggcccccgagcacaagcaggagcagggcgucgagcaccggcaggagcccacccaggagcacaagcaggaggaggggcagaagcaggaggagcaggaggaggagcaggaggaggagggcaagcaggaggaggggcagggcacgaaggaggggcgcgaggcggugagccagcugcagaccgacagcgagcccaaguuccacuccgagagccuguccagcaacccguccagcuucgcgccccgggugcgcgaggucgaguccacccccaugaucauggagaacauccaggagcucauccggagcgcccaggagaucgacgagaugaacgagaucuacgacgagaacuccuacuggcgcaaccagaaccccggcagccugcugcagcucccgcacaccgaggcccugcuggugcucugcuacuccaucguggagaacacgugcaucaucacccccaccgccaaggccuggaaguacauggaggaggagauccugggcuucgggaaguccgucugcgacucccugggccggcgccacaugagcacgugcgcccucugcgacuucugcucccugaagcuggagcagugccacagcgaggccucccuccagcggcagcagugcgacaccagccacaagacccccuucgugagcccccugcuggccucccagagccucuccaucgggaaccaggugggcagcccggaguccggccgcuucuacgggcuggaccuguacggcgggcuccacauggacuucuggugcgcccggcuggcgaccaagggcugcgaggacguccgcgugagcggguggcugcagaccgaguuccucuccuuccaggacggcgacuuccccacgaagaucugcgacaccgacuacauccaguaccccaacuacugcagcuucaagucccagcagugccugaugcggaaccgcaaccgcaaggugagccggaugcgcugccugcagaacgagaccuacuccgcccucagcccgggcaaguccgaggacgucgugcugcgguggagccaggaguucuccacccugacgcuggggcaguucggcuga

SEQ ID NO: 422 - RNA, 1632 nt, Artificial Sequence
  derived and/or modified sequence opt2 from ACRBP__Homo_sapiens__AAH33010
augcgcaagcccgccgccggcuuccuccccucccuccucaagguccuccuccucccccucgcccccgccgccgcccaggacuccacccaggccuccacccccggcuccccccucucccccaccgaguacgagcgcuucuucgcccuccucacccccaccuggaaggccgagaccaccugccgccuccgcgccacccacggcugccgcaaccccacccucguccagcucgaccaguacgagaaccacggccucguccccgacggcgccgucugcuccaaccuccccuacgccuccugguucgaguccuucugccaguucacccacuaccgcugcuccaaccacgucuacuacgccaagcgcguccucugcucccagcccgucuccauccucucccccaacacccucaaggagaucgaggccuccgccgaggucucccccaccaccaugaccucccccaucuccccccacuucaccgucaccgagcgccagaccuuccagcccuggcccgagcgccucuccaacaacgucgaggagcuccuccaguccucccucucccucggcggccaggagcaggcccccgagcacaagcaggagcagggcgucgagcaccgccaggagcccacccaggagcacaagcaggaggagggccagaagcaggaggagcaggaggaggagcaggaggaggagggcaagcaggaggagggccagggcaccaaggagggccgcgaggccgucucccagcuccagaccgacuccgagcccaaguuccacuccgagucccucuccuccaaccccuccuccuucgccccccgcguccgcgaggucgaguccacccccaugaucauggagaacauccaggagcucauccgcuccgcccaggagaucgacgagaugaacgagaucuacgacgagaacuccuacuggcgcaaccagaaccccggcucccuccuccagcucccccacaccgaggcccuccucguccucugcuacuccaucgucgagaacaccugcaucaucacccccaccgccaaggccuggaaguacauggaggaggagauccucggcuucggcaaguccgucugcgacucccucggccgccgccacauguccaccugcgcccucugcgacuucugcucccucaagcucgagcagugccacuccgaggccucccuccagcgccagcagugcgacaccucccacaagacccccuucgucuccccccuccucgccucccagucccucuccaucggcaaccaggucggcucccccgaguccggccgcuucuacggccucgaccucuacggcggccuccacauggacuucuggugcgcccgccucgccaccaagggcugcgaggacguccgcgucuccggcuggcuccagaccgaguuccucuccuuccaggacggcgacuuccccaccaagaucugcgacaccgacuacauccaguaccccaacuacugcuccuucaagucccagcagugccucaugcgcaaccgcaaccgcaaggucucccgcaugcgcugccuccagaacgagaccuacuccgcccucucccccggcaaguccgaggacgucguccuccgcuggucccaggaguucuccacccucacccucggccaguucggcuga

SEQ ID NO: 423 - RNA, 1632 nt, Artificial Sequence
  derived and/or modified sequence opt3 from ACRBP__Homo_sapiens__AAH33010
augagaaagcccgccgcuggcuuccugccuagccuccuuaaagugcuguuguuaccacuggcaccggccgcggcucaggacuccacccaagccucuacacccgggucaccucuaaguccaacugaguacgaaagguuuuucgcacuccugacgcccaccuggaaggccgagacaacuugccggcuucgcgcuacccacggaugucgaaacccuacacugguccaguuggaucaguaugaaaaucauggucucguuccagacggcgcagugugcagcaaccugcccuacgccuccugguuugagucuuucugucaguuuacccacuaucguugcucgaaucauguauacuaugcuaaaagagugcuguguucacaaccugucagcauccucaguccaaacacuuuaaaggaaauugaggccuccgcggaggugucuccgacaaccaugacgagccccauauccccucacuucacuguuaccgaaaggcagacauuucagccauggcccgagcggcugucaaauaacguggaagaacuuuugcagaguagccugucucuagggggacaagagcaggcaccugaacauaaacaggagcagggcgucgaacaccgccaagagccaacucaggaacacaagcaggaggagggucaaaagcaggaggagcaggaagaggaacaggaggaggaagggaaacaagaggaaggacagggcaccaaggagggcagagaagccgugucccagcuccagacagauucagagcccaaauuccauagcgagagucugucuuccaauccgagcucguuugcuccuaggguacgggaaguugagucuacccccaugaucauggaaaacauucaagagcuuauccgcuccgcccaggagauugacgaaaugaaugagaucuacgaugaaaacucauauuggcgaaaucagaacccagggagucuguugcagcucccucacacggaggcacuguuagugcugugcuacagcauagucgaaaauacuuguaucauuacacccaccgcuaaggccuggaaauacauggaggaggaaauccucggauucgguaaguccgugugcgacucucuuggcagaaggcauaugagcacuugugcgcugugcgauuuuuguucauugaagcuagagcaaugccacagugaagccucccugcagcggcagcagugcgacacaagccacaaaaccccauucgugucuccccuccuggcaucacaaagucuuagcauugggaaccaggucggauccccugagucuggccguuuuuauggucuggauuuguacgggggacuccauauggacuucuggugugcucgccuggccacgaagggcugcgaagauguuagagugucgggcugguuacagaccgaguuccugagcuuucaagacggggauuucccaacaaaaaucugugacacugacuauauacaguacccgaauuauugcuccuuuaagucacagcagugucuaaugaggaaccggaaccgaaaaguaagucgcaugagaugccuccaaaaugagaccuacucugcucugagccccggaaaguccgaagaugugguccuuagguggucacaggaguucagcacauugacucugggucaguuuggcuga

SEQ ID NO: 424 - RNA, 1632 nt, Artificial Sequence
  derived and/or modified sequence opt4 from ACRBP__Homo_sapiens__AAH33010
augagaaagcccgccgccggcuuccugcccagccugcugaaggugcugcugcugccccuggcccccgccgccgcccaggacagcacccaggccagcacccccggcagcccccugagccccaccgaguacgagagauucuucgcccugcugacccccaccuggaaggccgagaccaccugcagacugagagccacccacggcugcagaaaccccacccuggugcagcuggaccaguacgagaaccacggccuggugcccgacggcgccgugugcagcaaccugcccuacgccagcugguucgagagcuucugccaguucacccacuacagaugcagcaaccacguguacuacgccaagagagugcugugcagccagcccgugagcauccugagccccaacacccugaaggagaucgaggccagcgccgaggugagccccaccaccaugaccagccccaucagcccccacuucaccgugaccgagagacagaccuuccagcccuggcccgagagacugagcaacaacguggaggagcugcugcagagcagccugagccugggcggccaggagcaggcccccgagcacaagcaggagcagggcguggagcacagacaggagcccacccaggagcacaagcaggaggagggccagaagcaggaggagcaggaggaggagcaggaggaggagggcaagcaggaggagggccagggcaccaaggagggcagagaggccgugagccagcugcagaccgacagcgagcccaaguuccacagcgagagccugagcagcaaccccagcagcuucgcccccagagugagagagguggagagcacccccaugaucauggagaacauccaggagcugaucagaagcgcccaggagaucgacgagaugaacgagaucuacgacgagaacagcuacuggagaaaccagaaccccggcagccugcugcagcugccccacaccgaggcccugcuggugcugugcuacagcaucguggagaacaccugcaucaucacccccaccgccaaggccuggaaguacauggaggaggagauccugggcuucggcaagagcgugugcgacagccugggcagaagacacaugagcaccugcgcccugugcgacuucugcagccugaagcuggagcagugccacagcgaggccagccugcagagacagcagugcgacaccagccacaagacccccuucgugagcccccugcuggccagccagagccugagcaucggcaaccaggugggcagccccgagagcggcagauucuacggccuggaccuguacggcggccugcacauggacuucuggugcgccagacuggccaccaagggcugcgaggacgugagagugagcggcuggcugcagaccgaguuccugagcuuccaggacggcgacuuccccaccaagaucugcgacaccgacuacauccaguaccccaacuacugcagcuucaagagccagcagugccugaugagaaacagaaacagaaaggugagcagaaugagaugccugcagaacgagaccuacagcgcccugagccccggcaagagcgaggacguggugcugagauggagccaggaguucagcacccugacccugggccaguucggcuga

SEQ ID NO: 425 - RNA, 1632 nt, Artificial Sequence
  derived and/or modified sequence opt5 from ACRBP__Homo_sapiens__AAH33010
augagaaagcccgccgcuggcuuccugccuagccuccugaaagugcuucugcucccgcuggcccccgcggcugcccaggacuccacccaagccucuacaccugggagcccccuuuccccuacggaguacgaacgguuuuucgcucugcucacccccacauggaaggccgagaccacaugccgccugagagcuacccacggaugucggaacccuacacugguccagcucgaucaguaugaaaaucauggccugguuccggacggggccgugugcucuaaccuucccuacgcgagcugguuugaguccuucugucaguuuacccacuaucgcugcucuaaucauguguacuaugccaaaagaguccuguguagccaaccuguguccauccucagccccaacacgcugaaggaaauugaggcuucugccgagguuuccccuaccacaaugaccagccccaucucuccgcacuucacagugaccgaacggcagacguuucagccuuggcccgagcgccuuuccaauaacgucgaagaacugcuccagagcucucugucccugggaggccaagagcaggcuccugaacauaaacaggagcaggggguggaacacagacaagagcccacacaggaacacaagcaggaggagggacaaaagcaggaggagcaggaagaggaacaggaggaggaaggcaaacaagaggaaggccaggggaccaaggagggacgggaagccguuagccagcuccagacagauuccgagcccaaauuccauucugagagccuguccagcaauccuucuuccuuugcgccgcgcgugagagaagucgagagcacccccaugauuauggaaaacauccaagagcuuauucggucugcccaggagaucgacgaaaugaaugagaucuacgaugaaaacagcuauuggcgcaaucagaacccuggcucccugcuccagcugccccacaccgaggcccuucuggugcucugcuacucuauuguggaaaauacauguaucauuacgccuaccgcuaaggcuuggaaauacauggaggaggaaauccugggguucggaaagagcgucugcgacucccugggcagacggcauaugagcacaugugcccucugcgauuuuuguucucugaaacuugagcaaugccacuccgaagccagccugcagcgccagcagugcgacaccucucacaagacacccuucguuuccccgcuccuggcuagccaaucccuuucuauugggaaccaggugggaagcccugaguccggcagauuuuauggccuggaucucuacgggggacugcauauggacuucuggugugcgcggcuggccaccaagggcugcgaagaugugagagucucuggguggcuccagacggaguuccugagcuuucaagacggagauuuccccacaaaaaucugugacaccgacuauauucaguacccuaauuauugcuccuuuaagagccagcagugucuuaugcgcaaccggaacagaaaagugucucgcaugcggugccugcaaaaugagaccuacuccgcucucagccccggcaagucugaagauguugugcugagauggucccaggaguucagcacacugacccuugggcaguuuggauga

SEQ ID NO: 426 - protein, 609 aa, Artificial Sequence
  AFP__Homo_sapiens__P02771
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 427 - RNA, 1830 nt, Artificial Sequence
  AFP__Homo_sapiens__AAB58754
augaaguggguggaaucaauuuuuuuaauuuuccuacuaaauuuuacugaauccagaacacugcauagaaaugaauauggaauagcuuccauauuggauucuuaccaauguacugcagagauaaguuuagcugaccuggcuaccauauuuuuugcccaguuuguucaagaagccacuuacaaggaaguaagcaaaauggugaaagaugcauugacugcaauugagaaacccacuggagaugaacagucuucaggguguuuagaaaaccagcuaccugccuuucuggaagaacuuugccaugagaaagaaauuuuggagaaguacggacauucagacugcugcagccaaagugaagagggaagacauaacuguuuucuugcacacaaaaagcccacuccagcaucgaucccacuuuuccaaguuccagaaccugucacaagcugugaagcauaugaagaagacagggagacauucaugaacaaauucauuuaugagauagcaagaaggcaucccuuccuguaugcaccuacaauucuucuuugggcugcucgcuaugacaaaauaauuccaucuugcugcaaagcugaaaaugcaguugaaugcuuccaaacaaaggcagcaacaguuacaaaagaauuaagagaaagcagcuuguuaaaucaacaugcaugugcaguaaugaaaaauuuugggacccgaacuuuccaagccauaacuguuacuaaacugagucagaaguuuaccaaaguuaauuuuacugaaauccagaaacuaguccuggauguggcccauguacaugagcacuguugcagaggagaugugcuggauugucugcaggauggggaaaaaaucauguccuacauauguucucaacaagacacucugucaaacaaaauaacagaaugcugcaaacugaccacgcuggaacguggucaauguauaauucaugcagaaaaugaugaaaaaccugaaggucuaucuccaaaucuaaacagguuuuuaggagauagagauuuuaaccaauuuucuucaggggaaaaaaauaucuucuuggcaaguuuuguucaugaauauucaagaagacauccucagcuugcugucucaguaauucuaagaguugcuaaaggauaccaggaguuauuggagaaguguuuccagacugaaaacccucuugaaugccaagauaaaggagaagaagaauuacagaaauacauccaggagagccaagcauuggcaaagcgaagcugcggccucuuccagaaacuaggagaauauuacuuacaaaaugcguuucucguugcuuacacaaagaaagccccccagcugaccucgucggagcugauggccaucaccagaaaaauggcagccacagcagccacuuguugccaacucagugaggacaaacuauuggccuguggcgagggagcggcugacauuauuaucggacacuuauguaucagacaugaaaugacuccaguaaacccugguguuggccagugcugcacuucuucauaugccaacaggaggccaugcuucagcagcuuggugguggaugaaacauaugucccuccugcauucucugaugacaaguucauuuuccauaaggaucugugccaagcucaggguguagcgcugcaaacgaugaagcaagaguuucucauuaaccuugugaagcaaaagccacaaauaacagaggaacaacuugaggcugucauugcagauuucucaggccuguuggagaaaugcugccaaggccaggaacaggaagucugcuuugcugaagagggacaaaaacugauuucaaaaacucgugcugcuuugggaguuuaa

SEQ ID NO: 428 - RNA, 1830 nt, Artificial Sequence
  derived and/or modified sequence opt1 from AFP__Homo_sapiens__AAB58754
augaaguggguggagagcaucuuccugaucuuccuccugaacuucaccgagucccgcacccugcaccggaacgaguacggcaucgccagcauccucgacuccuaccagugcacggccgagaucagccuggcggaccuggccaccaucuucuucgcccaguucguccaggaggccaccuacaaggagguguccaagauggugaaggacgcccucaccgcgaucgagaagcccacgggggacgagcagagcuccggcugccuggagaaccagcugcccgccuuccucgaggagcugugccacgagaaggagauccuggagaaguacgggcacagcgacugcugcucccagagcgaggagggccgccacaacugcuuccucgcccacaagaagcccacccccgccuccaucccccuguuccaggucccggagcccgugaccagcugcgaggcguacgaggaggaccgggagaccuucaugaacaaguucaucuacgagaucgcccgccggcaccccuuccuguacgcccccacgauccuccugugggccgcccgcuacgacaagaucaucccguccugcugcaaggcggagaacgccguggagugcuuccagaccaaggccgccaccgucaccaaggagcugcgggagagcucccuccugaaccagcacgccugcgcggugaugaagaacuucgggacgcgcaccuuccaggccaucaccgugaccaagcugagccagaaguucacgaaggucaacuucaccgagauccagaagcucgugcuggacguggcccacguccacgagcacugcugccggggcgacgugcuggacugccuccaggacggcgagaagaucauguccuacaucugcagccagcaggacacccuguccaacaagaucaccgagugcugcaagcugacgacccucgagcgcgggcagugcaucauccacgccgagaacgacgagaagcccgagggccugagccccaaccugaaccgguuccucggggaccgcgacuucaaccaguucagcuccggcgagaagaacaucuuccuggccagcuucgugcacgaguacucccggcgccacccccagcuggcggucagcgugauccuccggguggccaagggguaccaggagcugcuggagaagugcuuccagaccgagaacccgcucgagugccaggacaagggcgaggaggagcugcagaaguacauccaggagucccaggcccuggccaagcgcagcugcggccucuuccagaagcugggggaguacuaccugcagaacgccuuccucgucgcguacaccaagaaggcgccccagcugacguccagcgagcugauggccaucacccggaagauggccgccaccgccgcgaccugcugccagcucuccgaggacaagcugcuggccugcggcgagggggccgccgacaucaucaucggccaccucugcauccgccacgagaugacgcccgugaaccccggcguggggcagugcugcaccagcuccuacgccaaccggcgcccgugcuucagcucccuggucguggacgagaccuacgugccgcccgccuucagcgacgacaaguucaucuuccacaaggaccugugccaggcccagggcgucgcccugcagaccaugaagcaggaguuccucaucaaccuggugaagcagaagccccagaucacggaggagcagcuggaggcggucaucgccgacuucuccgggcuccuggagaagugcugccagggccaggagcaggaggugugcuucgccgaggaggggcagaagcugaucagcaagacccgggccgcccucggcguguga

SEQ ID NO: 429 - RNA, 1830 nt, Artificial Sequence
  derived and/or modified sequence opt2 from AFP__Homo_sapiens__AAB58754
augaagugggucgaguccaucuuccucaucuuccuccucaacuucaccgagucccgcacccuccaccgcaacgaguacggcaucgccuccauccucgacuccuaccagugcaccgccgagaucucccucgccgaccucgccaccaucuucuucgcccaguucguccaggaggccaccuacaaggaggucuccaagauggucaaggacgcccucaccgccaucgagaagcccaccggcgacgagcaguccuccggcugccucgagaaccagcuccccgccuuccucgaggagcucugccacgagaaggagauccucgagaaguacggccacuccgacugcugcucccaguccgaggagggccgccacaacugcuuccucgcccacaagaagcccacccccgccuccaucccccucuuccagguccccgagcccgucaccuccugcgaggccuacgaggaggaccgcgagaccuucaugaacaaguucaucuacgagaucgcccgccgccaccccuuccucuacgcccccaccauccuccucugggccgcccgcuacgacaagaucauccccuccugcugcaaggccgagaacgccgucgagugcuuccagaccaaggccgccaccgucaccaaggagcuccgcgaguccucccuccucaaccagcacgccugcgccgucaugaagaacuucggcacccgcaccuuccaggccaucaccgucaccaagcucucccagaaguucaccaaggucaacuucaccgagauccagaagcucguccucgacgucgcccacguccacgagcacugcugccgcggcgacguccucgacugccuccaggacggcgagaagaucauguccuacaucugcucccagcaggacacccucuccaacaagaucaccgagugcugcaagcucaccacccucgagcgcggccagugcaucauccacgccgagaacgacgagaagcccgagggccucucccccaaccucaaccgcuuccucggcgaccgcgacuucaaccaguucuccuccggcgagaagaacaucuuccucgccuccuucguccacgaguacucccgccgccacccccagcucgccgucuccgucauccuccgcgucgccaagggcuaccaggagcuccucgagaagugcuuccagaccgagaacccccucgagugccaggacaagggcgaggaggagcuccagaaguacauccaggagucccaggcccucgccaagcgcuccugcggccucuuccagaagcucggcgaguacuaccuccagaacgccuuccucgucgccuacaccaagaaggccccccagcucaccuccuccgagcucauggccaucacccgcaagauggccgccaccgccgccaccugcugccagcucuccgaggacaagcuccucgccugcggcgagggcgccgccgacaucaucaucggccaccucugcauccgccacgagaugacccccgucaaccccggcgucggccagugcugcaccuccuccuacgccaaccgccgccccugcuucuccucccucgucgucgacgagaccuacgucccccccgccuucuccgacgacaaguucaucuuccacaaggaccucugccaggcccagggcgucgcccuccagaccaugaagcaggaguuccucaucaaccucgucaagcagaagccccagaucaccgaggagcagcucgaggccgucaucgccgacuucuccggccuccucgagaagugcugccagggccaggagcaggaggucugcuucgccgaggagggccagaagcucaucuccaagacccgcgccgcccucggcgucuga

SEQ ID NO: 430 - RNA, 1830 nt, Artificial Sequence
  derived and/or modified sequence opt3 from AFP__Homo_sapiens__AAB58754
augaaguggguggagagcaucuuccugauuuuucuccuuaacuucaccgaauccagaacacugcacaggaaugaguacggcauagccucuaucuuggacucauaucagugcacugcugaaauuaguuuagcagaucuggccacgaucuuuuucgcgcaauuuguccaggaggcuaccuacaaagaaguuagcaagauggugaaagacgcccuaacagcaauugagaagcccacuggggaugagcaguccucuggaugucucgaaaaccagcugccugccuuccuugaggaacugugccaugagaaagagaucuuggaaaaguauggucacucggacuguugcucacaaagcgaggaaggccggcauaauuguuuucucgcucacaagaaaccaaccccggcaaguauaccccuguuccagguaccugagccagugacauccugcgaagccuacgaggaggaucgcgaaaccuuuaugaacaaguucaucuaugagauugcucgacgucaucccuuucuguacgccccuacuauccucuuaugggcggcaagauaugacaaaauuaucccaucuuguugcaaggccgaaaaugcugucgaguguuuccagacaaaagccgcaaccgugacgaaggaacugagggagagcucccuuuugaaccagcacgcuugcgccguuaugaagaauuuugggacucggaccuuccaagcgauaacagugacuaaacugucacagaaguucaccaaagucaacuuuacagagauucagaagcuagugcucgauguagcccacguucaugaacacuguugccgcggagacgugcuggauugccuucaggacggcgagaaaaucaugaguuacauuuguagccaacaggauacccugucuaauaagaucacggaaugcuguaaauugacuacacucgagagaggucagugcaucauucaugcagaaaacgacgagaagcccgaggggcuguccccuaauuuaaacagguuccugggagaucgggacuuuaaucaauucucaagcggcgaaaagaacauauuucucgcuaguuucguccacgaguacucucgccgacacccacagcuugccguguccgugauccugagagucgcuaaaggcuaucaggaauugcuagagaaguguuuucagaccgagaauccgcuggaaugccaagacaaaggggaggaagaacuccagaaguacauucaggaaagccaggcccuggcaaaaaggucguguggacuuuuccaaaagcugggugaguauuacuugcagaacgccuuucucguugcuuauacuaagaaagcgccccagcugacaucuuccgaguuaauggcaaucacccggaagauggccgcuacggccgcaaccugcugucagcugucagaagauaaacuacucgccugcggcgagggggcugccgacauaauuaucggacaucuguguauccgucacgaaaugacaccugugaacccaggcguaggucaaugcugcaccaguagcuacgcaaaucgcagacccuguuucuccucucuuguggucgaugagacuuaugugccuccagcguuuagcgacgauaaguucauuuuucauaaagacuugugccaggcucaggggguugcccugcagacaaugaagcaagaguuccucaucaaccuggugaagcagaaaccccagauuacugaggagcaacuugaagcagucauagccgauuucucaggacuguuggagaaguguugccagggccaggaacaggagguguguuuugcugaagagggccaaaaacucaucaguaagaccagggccgcacuggggguauga

SEQ ID NO: 431 - RNA, 1830 nt, Artificial Sequence
  derived and/or modified sequence opt4 from AFP__Homo_sapiens__AAB58754
augaaguggguggagagcaucuuccugaucuuccugcugaacuucaccgagagcagaacccugcacagaaacgaguacggcaucgccagcauccuggacagcuaccagugcaccgccgagaucagccuggccgaccuggccaccaucuucuucgcccaguucgugcaggaggccaccuacaaggaggugagcaagauggugaaggacgcccugaccgccaucgagaagcccaccggcgacgagcagagcagcggcugccuggagaaccagcugcccgccuuccuggaggagcugugccacgagaaggagauccuggagaaguacggccacagcgacugcugcagccagagcgaggagggcagacacaacugcuuccuggcccacaagaagcccacccccgccagcaucccccuguuccaggugcccgagcccgugaccagcugcgaggccuacgaggaggacagagagaccuucaugaacaaguucaucuacgagaucgccagaagacaccccuuccuguacgcccccaccauccugcugugggccgccagauacgacaagaucauccccagcugcugcaaggccgagaacgccguggagugcuuccagaccaaggccgccaccgugaccaaggagcugagagagagcagccugcugaaccagcacgccugcgccgugaugaagaacuucggcaccagaaccuuccaggccaucaccgugaccaagcugagccagaaguucaccaaggugaacuucaccgagauccagaagcuggugcuggacguggcccacgugcacgagcacugcugcagaggcgacgugcuggacugccugcaggacggcgagaagaucaugagcuacaucugcagccagcaggacacccugagcaacaagaucaccgagugcugcaagcugaccacccuggagagaggccagugcaucauccacgccgagaacgacgagaagcccgagggccugagccccaaccugaacagauuccugggcgacagagacuucaaccaguucagcagcggcgagaagaacaucuuccuggccagcuucgugcacgaguacagcagaagacacccccagcuggccgugagcgugauccugagaguggccaagggcuaccaggagcugcuggagaagugcuuccagaccgagaacccccuggagugccaggacaagggcgaggaggagcugcagaaguacauccaggagagccaggcccuggccaagagaagcugcggccuguuccagaagcugggcgaguacuaccugcagaacgccuuccugguggccuacaccaagaaggccccccagcugaccagcagcgagcugauggccaucaccagaaagauggccgccaccgccgccaccugcugccagcugagcgaggacaagcugcuggccugcggcgagggcgccgccgacaucaucaucggccaccugugcaucagacacgagaugacccccgugaaccccggcgugggccagugcugcaccagcagcuacgccaacagaagacccugcuucagcagccuggugguggacgagaccuacgugccccccgccuucagcgacgacaaguucaucuuccacaaggaccugugccaggcccagggcguggcccugcagaccaugaagcaggaguuccugaucaaccuggugaagcagaagccccagaucaccgaggagcagcuggaggccgugaucgccgacuucagcggccugcuggagaagugcugccagggccaggagcaggaggugugcuucgccgaggagggccagaagcugaucagcaagaccagagccgcccugggcguguga

SEQ ID NO: 432 - RNA, 1830 nt, Artificial Sequence
  derived and/or modified sequence opt5 from AFP__Homo_sapiens__AAB58754
augaaguggguggagagcaucuuccugauuuuucuccugaacuucaccgaauccagaacacuucaccggaaugaguacggcaucgccucuauucuggacagcuaucagugcacggcugaaaucucccucgccgaucuggcgaccauuuucuucgcucaauuuguccaggaggccacauacaaagaaguuucuaagauggugaaagacgcccuuaccgcuaucgagaagcccacaggggaugagcagagcuccggaugucuggaaaaccagcucccugccuuccuggaggaacugugccaugagaaagagauccucgaaaaguauggccacucugacuguugcagccaauccgaggaagggcgccauaauuguuuucuggcucacaagaaaccgacccccgccagcauuccucuuuuccaggugcccgagccugucacaucuugcgaagcguacgaggaggauagagaaaccuuuaugaacaaguucaucuaugagauugcccggcgccaucccuuucuguacgcuccuacgauccuccugugggccgcuagauaugacaaaauuaucccguccuguugcaaggccgaaaaugcgguggaguguuuccagaccaaagccgcuacaguuaccaaggaacuucgggagagcucucugcucaaccagcacgccugcgcugugaugaagaauuuuggaacacgcaccuuccaagccauuacggucacaaaacugucccagaaguucaccaaagugaacuuuacagagauccagaagcugguucucgauguggcccacguccaugaacacuguugcagaggcgacgugcuggauugccuucaggacggggagaaaaucaugagcuacauuuguucucaacaggauacccuguccaauaagaucaccgaaugcuguaaacucacaacgcuggagcggggacagugcauuauccaugcugaaaacgacgagaagcccgagggccuuagcccuaaucugaaccgcuuccucggcgauagagacuuuaaucaauucuccucuggggaaaagaacauuuuucuggcgagcuucgugcacgaguacucccggcgccacccccagcuggccgucagcguuauccucagaguggcuaaaggauaucaggaacugcuugagaaguguuuucagaccgagaauccucuggaaugccaagacaaaggcgaggaggaacuccagaaguacauccaggaaucucaggcccuggccaaacgguccugugggcuuuuccaaaagcugggagaguauuaccuccagaacgcuuuucugguggccuauacaaagaaagcgccccagcugaccagcucugagcucauggcuauuacacgcaagauggccgccaccgcugccacgugcugucagcugagcgaagauaaacuucuggcuugcggcgagggggccgcggacaucauuaucggacaucucuguauuagacacgaaaugacaccggucaacccuggcgugggccaaugcugcaccuccucuuacgccaaucggagacccuguuucagcucccugguuguggaugagaccuaugucccucccgcuuuuagcgacgauaaguucaucuuucauaaagaccugugccaggcccaggggguggcccuucagacaaugaagcaagaauuucucaucaaccugguuaagcagaaaccccagauuaccgaggagcaacuggaagcugugaucgcggauuucucuggacuccuggagaaguguugccagggccaggaacaggaggucuguuuugccgaagaggggcaaaaacuuauuuccaagacacgcgcugcccugggaguguga

SEQ ID NO: 433 - protein, 854 aa, Artificial Sequence
  AKAP4__Homo_sapiens__Q5JQC9
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 434 - RNA, 2565 nt, Artificial Sequence
  AKAP4__Homo_sapiens__AAI26251
augauggcguacucugauacuacaaugaugucugaugauauugacugguuacgcagccacaggggugugugcaagguagaucucuacaacccagaaggacagcaagaucaggaccggaaagugauaugcuuugucgauguguccacccugaauguagaagauaaagauuacaaggaugcugcuaguuccagcucagaaggcaacuuaaaccugggaagucuggaagaaaaagagauuaucgugaucaaggacacugagaagaaagaccagucuaagacagagggaucuguaugccuuuucaaacaagcucccucugauccuguaaguguccucaacuggcuucucagugaucuccagaaguaugccuuggguuuccaacaugcacugagccccucaaccucuaccuguaaacauaaaguaggagacacagagggcgaauaucacagagcauccucugagaacugcuacagugucuaugccgaucaagugaacauagauuauuugaugaacagaccucaaaaccuacgucuagaaaugacagcagcuaaaaacaccaacaauaaucaaaguccuucagcuccuccagccaaaccuccuagcacucagagagcagucauuuccccugauggagaauguucuauagaugaccuuuccuucuacgucaaccgacuaucuucucugguaauccagauggcccauaaggaaaucaaggagaaguuggaagguaaaagcaaaugccuucaucauucaaucuguccauccccugggaacaaagagagaaucaguccccgaacuccugcgagcaagauugcuucugaaauggccuaugaagcuguggaacugacagcugcagaaaugcguggcacuggagaggaguccagggaagguggccagaaaagcuuucuauauagcgaauuauccaacaagagcaaaaguggagacaaacagaugucccagagagagagcaaagaauuugcagauuccaucagcaaggggcucaugguuuaugcaaaucagguggcaucugacaugauggucucucucaugaagaccuugaaagugcacagcucugggaagccaauuccagcaucugugguccugaagaggguguugcuaaggcacaccaaggagauuguguccgauuugauugauucuugcaugaagaaccugcauaauauuacugggguccugaugacugacucagacuuugucucagcugucaagagaaaucuguucaaccaguggaaacaaaaugcuacagacaucauggaggccaugcugaagcgcuuggucagugcccuuauaggugaggagaaggagacuaagucucagagucugucauaugcaucuuuaaaagcugggucccaugaucccaaaugcaggaaucagagucuugaauucuccaccaugaaagcugaaaugaaagagagggacaaaggcaaaaugaaaucagacccaugcaagucacugacuagugcugagaaagucggugaacacauucucaaagagggccuaaccaucuggaaccaaaagcaaggaaacucaugcaagguggcuaccaaagcaugcagcaauaaagaugagaaaggagaaaagaucaaugcuuccacagauucacuggccaaggaccugauugucucugcccuuaagcugauccaguaccaucugacccagcagacuaagggcaaagauacaugugaagaagacuguccugguuccaccaugggcuauauggcucagaguacucaauaugaaaaguguggagguggccaaagugccaaagcacuuucagugaaacaacuagaaucucacagagccccuggaccauccaccugucaaaaggagaaccaacaccuggacucccagaaaauggauaugucaaacaucguucuaaugcugauucagaaacugcuuaaugagaaccccuucaaaugugaggauccaugcgaaggugagaacaaguguucugagcccagggcaagcaaagcagcuuccauguccaacagaucugacaaagcggaagaacaaugccaggagcaucaagaacuugacuguaccagugggaugaagcaagcgaacgggcaauuuauagauaaacuaguagaaucugugaugaagcucugccuuaucauggcuaaguauagcaacgauggggcagcccuugcugaguuggaagaacaagcagccucggcaaauaagcccaauuucaggggcaccagaugcauucacaguggugcaaugccacagaacuaucaagacucucuuggacaugaaguaauugucaauaaucagugcucuacaaauagcuugcagaagcagcuccaggcuguccugcaguggauugcagccucccaguuuaacgugcccaugcucuacuucaugggagauaaggauggacaacuggaaaagcuuccucagguuucagcuaaagcagcagagaagggguacaguguaggaggucuucuucaagaggucaugaaguuugccaaggaacggcaaccagaugaagcugugggaaagguggccaggaaacaguugcuggacuggcugcucgcuaaccuguga

SEQ ID NO: 435 - RNA, 2565 nt, Artificial Sequence
  derived and/or modified sequence opt1 from AKAP4__Homo_sapiens__AAI26251
augauggccuacagcgacaccaccaugauguccgacgacaucgacuggcugcgcagccaccggggcgugugcaaggucgaccucuacaaccccgaggggcagcaggaccaggaccgcaaggugaucugcuucguggacgucuccacccugaacguggaggacaaggacuacaaggacgccgcgagcuccagcuccgagggcaaccugaaccucgggagccuggaggagaaggagaucaucgugaucaaggacaccgagaagaaggaccaguccaagaccgagggcagcgucugccuguucaagcaggccccguccgaccccgugagcgugcucaacuggcugcuguccgaccuccagaaguacgcccugggguuccagcacgcccugagccccuccaccagcacgugcaagcacaaggucggcgacaccgagggcgaguaccaccgggccuccagcgagaacugcuacuccguguacgcggaccaggugaacaucgacuaccucaugaaccgcccccagaaccugcggcuggagaugaccgccgccaagaacaccaacaacaaccagagcccgagcgccccgcccgcgaagccgcccuccacgcagcgcgccgucaucagccccgacggggagugcuccaucgacgaccucagcuucuacgugaaccggcuguccagccuggugauccagauggcccacaaggagaucaaggagaagcucgagggcaaguccaagugccugcaccacagcaucugccccucccccgggaacaaggagcgcaucagcccccggacccccgccuccaagaucgccagcgagauggcguacgaggccgucgagcugaccgccgccgagaugcgcggcaccggggaggagucccgggagggcggccagaaguccuuccucuacagcgagcugagcaacaaguccaagagcggggacaagcagaugucccagcgcgagagcaaggaguucgccgacagcaucuccaagggccugaugguguacgcgaaccagguggccagcgacaugauggucucccucaugaagacgcugaaggugcacagcuccgggaagcccauccccgccagcgugguccugaagcgggugcuccugcgccacaccaaggagaucguguccgaccugaucgacagcugcaugaagaaccuccacaacaucaccggcguccugaugaccgacuccgacuucgugagcgccgucaagcggaaccuguucaaccaguggaagcagaacgccacggacaucauggaggcgaugcucaagcgccugguguccgcccugaucggcgaggagaaggagaccaagagccagucccucagcuacgccucccugaaggccgggagccacgacccgaagugccggaaccagucccuggaguucagcaccaugaaggccgagaugaaggagcgcgacaagggcaagaugaaguccgaccccugcaagagccucaccagcgcggagaaggugggggagcacauccugaaggagggccugacgaucuggaaccagaagcaggggaacuccugcaaggucgccaccaaggccugcagcaacaaggacgagaagggcgagaagaucaacgccuccaccgacagccucgcgaaggaccugaucguguccgcccugaagcucauccaguaccaccugacccagcagacgaagggcaaggacacgugcgaggaggacugccccgggagcaccaugggcuacauggcccaguccacccaguacgagaagugcgggggcgggcagagcgccaaggcccuguccgugaagcagcucgagagccaccgggcgcccggcccguccacgugccagaaggagaaccagcaccuggacagccagaagauggacauguccaacaucguccugaugcugauccagaagcuccugaacgagaaccccuucaagugcgaggaccccugcgagggcgagaacaagugcagcgagccccgcgccuccaaggccgccagcauguccaaccggagcgacaaggccgaggagcagugccaggagcaccaggagcuggacugcaccagcgggaugaagcaggcgaacggccaguucaucgacaagcucguggaguccgugaugaagcugugccugaucauggccaaguacagcaacgacggggccgcccucgccgagcuggaggagcaggcggccuccgccaacaagccgaacuuccgcggcacccgcugcauccacagcggggccaugccccagaacuaccaggacucccugggccacgaggucaucgugaacaaccagugcagcaccaacucccuccagaagcagcugcaggcggugcugcaguggaucgccgccagccaguucaacguccccaugcucuacuucaugggcgacaaggacgggcagcuggagaagcugccccagguguccgccaaggccgcggagaagggcuacagcgucgggggccuccugcaggaggugaugaaguucgccaaggagcggcagccggacgaggccgugggcaagguggcccgcaagcagcugcucgacuggcugcuggccaaccucuga

SEQ ID NO: 436 - RNA, 2565 nt, Artificial Sequence
  derived and/or modified sequence opt2 from AKAP4__Homo_sapiens__AAI26251
augauggccuacuccgacaccaccaugauguccgacgacaucgacuggcuccgcucccaccgcggcgucugcaaggucgaccucuacaaccccgagggccagcaggaccaggaccgcaaggucaucugcuucgucgacgucuccacccucaacgucgaggacaaggacuacaaggacgccgccuccuccuccuccgagggcaaccucaaccucggcucccucgaggagaaggagaucaucgucaucaaggacaccgagaagaaggaccaguccaagaccgagggcuccgucugccucuucaagcaggcccccuccgaccccgucuccguccucaacuggcuccucuccgaccuccagaaguacgcccucggcuuccagcacgcccucucccccuccaccuccaccugcaagcacaaggucggcgacaccgagggcgaguaccaccgcgccuccuccgagaacugcuacuccgucuacgccgaccaggucaacaucgacuaccucaugaaccgcccccagaaccuccgccucgagaugaccgccgccaagaacaccaacaacaaccagucccccuccgccccccccgccaagccccccuccacccagcgcgccgucaucucccccgacggcgagugcuccaucgacgaccucuccuucuacgucaaccgccucuccucccucgucauccagauggcccacaaggagaucaaggagaagcucgagggcaaguccaagugccuccaccacuccaucugccccucccccggcaacaaggagcgcaucuccccccgcacccccgccuccaagaucgccuccgagauggccuacgaggccgucgagcucaccgccgccgagaugcgcggcaccggcgaggagucccgcgagggcggccagaaguccuuccucuacuccgagcucuccaacaaguccaaguccggcgacaagcagaugucccagcgcgaguccaaggaguucgccgacuccaucuccaagggccucauggucuacgccaaccaggucgccuccgacaugauggucucccucaugaagacccucaagguccacuccuccggcaagcccauccccgccuccgucguccucaagcgcguccuccuccgccacaccaaggagaucgucuccgaccucaucgacuccugcaugaagaaccuccacaacaucaccggcguccucaugaccgacuccgacuucgucuccgccgucaagcgcaaccucuucaaccaguggaagcagaacgccaccgacaucauggaggccaugcucaagcgccucgucuccgcccucaucggcgaggagaaggagaccaagucccagucccucuccuacgccucccucaaggccggcucccacgaccccaagugccgcaaccagucccucgaguucuccaccaugaaggccgagaugaaggagcgcgacaagggcaagaugaaguccgaccccugcaagucccucaccuccgccgagaaggucggcgagcacauccucaaggagggccucaccaucuggaaccagaagcagggcaacuccugcaaggucgccaccaaggccugcuccaacaaggacgagaagggcgagaagaucaacgccuccaccgacucccucgccaaggaccucaucgucuccgcccucaagcucauccaguaccaccucacccagcagaccaagggcaaggacaccugcgaggaggacugccccggcuccaccaugggcuacauggcccaguccacccaguacgagaagugcggcggcggccaguccgccaaggcccucuccgucaagcagcucgagucccaccgcgcccccggccccuccaccugccagaaggagaaccagcaccucgacucccagaagauggacauguccaacaucguccucaugcucauccagaagcuccucaacgagaaccccuucaagugcgaggaccccugcgagggcgagaacaagugcuccgagccccgcgccuccaaggccgccuccauguccaaccgcuccgacaaggccgaggagcagugccaggagcaccaggagcucgacugcaccuccggcaugaagcaggccaacggccaguucaucgacaagcucgucgaguccgucaugaagcucugccucaucauggccaaguacuccaacgacggcgccgcccucgccgagcucgaggagcaggccgccuccgccaacaagcccaacuuccgcggcacccgcugcauccacuccggcgccaugccccagaacuaccaggacucccucggccacgaggucaucgucaacaaccagugcuccaccaacucccuccagaagcagcuccaggccguccuccaguggaucgccgccucccaguucaacguccccaugcucuacuucaugggcgacaaggacggccagcucgagaagcucccccaggucuccgccaaggccgccgagaagggcuacuccgucggcggccuccuccaggaggucaugaaguucgccaaggagcgccagcccgacgaggccgucggcaaggucgcccgcaagcagcuccucgacuggcuccucgccaaccucuga

SEQ ID NO: 437 - RNA, 2565 nt, Artificial Sequence
  derived and/or modified sequence opt3 from AKAP4__Homo_sapiens__AAI26251
augauggccuacagcgacaccacaaugauguccgaugacaucgauuggcugagaucucacaggggcgugugcaaggucgaccucuauaaccccgaggggcagcaagaucaggaccggaaaguuauuuguuucguggauguaucaacucuuaauguggaagacaaggauuacaaagacgcugcaaguagcuccucugagggaaaccugaauuuggguucguuagaagagaaggaaauaaucgucauuaaagauacggagaagaaggaccagucaaaaaccgagggcagcgugugccuguuuaagcaggccccuagugauccaguuuccgugcuaaacuggcuccugucugaccuucaaaaauaugcgcugggguuccagcaugcuuugagcccguccacaucaacuuguaagcacaaagucggagacaccgaaggcgaguaccaucgcgccaguagcgaaaauugcuauucuguguacgcagaucagguaaacaucgacuaucucaugaaucgaccccagaaccugcgucuggagaugacagccgcuaagaauaccaacaauaaccaauccccuucagcaccacccgccaagccuccaagcacucagagagcuguuauuagucccgauggugaguguucuaucgacgaucucuccuuuuacgugaauagguuaagcucgcuggucauacagauggcccacaaagaaaucaaggagaaacuugaagggaagucuaaaugcuugcaucacuccauuuguccuucaccaggaaacaaggagcggaucaguccgcgcacacccgcgagcaaaauugcauccgaaauggccuacgaggcuguggagcugaccgccgcagaaaugagaggcacgggcgaggaaucuagggaagggggacaaaagagcuuccuauauucagaacucaguaauaaguccaaaagcggugacaagcagaugucucagcgggagucaaaagaguuugcugauaguaucagcaagggccugaugguguacgccaaccaggucgcguccgacaugaugguuucucuuaugaaaacucugaaggugcacucgagcgggaagccuauaccagccuccguaguguugaaacgcguccuccugcgacauaccaaggaaauugugucagauuuaaucgacaguugcaugaaaaaccugcacaauauuacaggaguucucaugacugauucugacuucgugagcgcagucaagagaaaccuuuuuaaucaauggaaacagaacgcuaccgacaucauggaggccaugcugaagagguugguguccgcucuaaucggcgaagagaaggaaacaaaaucacagagccugucuuaugccucccucaaggcagguagucaugaucccaaaugucggaaucagagccuggaguucucuaccaugaaggccgagaugaaagaacgugacaaggggaagaugaaauccgauccuugcaagucacuuacgagugcugagaaaguaggagaacacauucugaaggagggcuugacuauauggaaccaaaaacagggcaauagcuguaagguugcgacaaaagcaugcucgaacaaggacgagaagggggagaaaaucaaugccuccaccgauucucucgcuaaggaccugauugugagcgccuuaaaacugauccaguaccaccuaacucagcaaacaaagggaaaagauaccugcgaggaagacuguccagguucaacgaugggcuauauggcacagaguacccaguacgagaagugcgggggaggccaguccgccaaggcucucucugucaaacaacuggaaagccaucgcgcccccgguccguccacaugucagaaggagaaccagcaccuugauucacagaaaauggacaugagcaauauaguguugaugcugauucaaaagcuccugaacgagaauccuuuuaaaugcgaagaucccugugagggggaaaacaagugcagugagccaagagcaucuaaggcggcuuccaugagcaauaggucggacaaagccgaggaacagugucaggagcaucaagaacuugauugcacuucaggcaugaagcaggcaaacggacaguucaucgacaaacuggucgagucugugaugaaguugugucucaucauggccaaauauaguaacgacggcgcugcccuggcagaauuagaggaacaggcugccuccgcgaauaagccuaacuuucgggggacccgaugcauucacagcggagccaugccccaaaauuaccaggauucucugggucaugagguuaucgugaacaaucaguguagcacaaacucccuacagaagcaacuccaggcuguacugcaguggauugcagccucacaguucaaugucccaaugcuuuacuuuaugggcgacaaagaugggcaauuggagaagcugccccaggugagugcuaaagccgcagaaaagggauauagcguuggcggucuccugcaggaggugaugaaauucgcgaaggaacgccaaccugacgaggccgucgggaaaguggcuagaaagcaguuacuggauuggcuuuuggccaaccucuga

SEQ ID NO: 438 - RNA, 2565 nt, Artificial Sequence
  derived and/or modified sequence opt4 from AKAP4__Homo_sapiens__AAI26251
augauggccuacagcgacaccaccaugaugagcgacgacaucgacuggcugagaagccacagaggcgugugcaagguggaccuguacaaccccgagggccagcaggaccaggacagaaaggugaucugcuucguggacgugagcacccugaacguggaggacaaggacuacaaggacgccgccagcagcagcagcgagggcaaccugaaccugggcagccuggaggagaaggagaucaucgugaucaaggacaccgagaagaaggaccagagcaagaccgagggcagcgugugccuguucaagcaggcccccagcgaccccgugagcgugcugaacuggcugcugagcgaccugcagaaguacgcccugggcuuccagcacgcccugagccccagcaccagcaccugcaagcacaaggugggcgacaccgagggcgaguaccacagagccagcagcgagaacugcuacagcguguacgccgaccaggugaacaucgacuaccugaugaacagaccccagaaccugagacuggagaugaccgccgccaagaacaccaacaacaaccagagccccagcgccccccccgccaagccccccagcacccagagagccgugaucagccccgacggcgagugcagcaucgacgaccugagcuucuacgugaacagacugagcagccuggugauccagauggcccacaaggagaucaaggagaagcuggagggcaagagcaagugccugcaccacagcaucugccccagccccggcaacaaggagagaaucagccccagaacccccgccagcaagaucgccagcgagauggccuacgaggccguggagcugaccgccgccgagaugagaggcaccggcgaggagagcagagagggcggccagaagagcuuccuguacagcgagcugagcaacaagagcaagagcggcgacaagcagaugagccagagagagagcaaggaguucgccgacagcaucagcaagggccugaugguguacgccaaccagguggccagcgacaugauggugagccugaugaagacccugaaggugcacagcagcggcaagcccauccccgccagcguggugcugaagagagugcugcugagacacaccaaggagaucgugagcgaccugaucgacagcugcaugaagaaccugcacaacaucaccggcgugcugaugaccgacagcgacuucgugagcgccgugaagagaaaccuguucaaccaguggaagcagaacgccaccgacaucauggaggccaugcugaagagacuggugagcgcccugaucggcgaggagaaggagaccaagagccagagccugagcuacgccagccugaaggccggcagccacgaccccaagugcagaaaccagagccuggaguucagcaccaugaaggccgagaugaaggagagagacaagggcaagaugaagagcgaccccugcaagagccugaccagcgccgagaaggugggcgagcacauccugaaggagggccugaccaucuggaaccagaagcagggcaacagcugcaagguggccaccaaggccugcagcaacaaggacgagaagggcgagaagaucaacgccagcaccgacagccuggccaaggaccugaucgugagcgcccugaagcugauccaguaccaccugacccagcagaccaagggcaaggacaccugcgaggaggacugccccggcagcaccaugggcuacauggcccagagcacccaguacgagaagugcggcggcggccagagcgccaaggcccugagcgugaagcagcuggagagccacagagcccccggccccagcaccugccagaaggagaaccagcaccuggacagccagaagauggacaugagcaacaucgugcugaugcugauccagaagcugcugaacgagaaccccuucaagugcgaggaccccugcgagggcgagaacaagugcagcgagcccagagccagcaaggccgccagcaugagcaacagaagcgacaaggccgaggagcagugccaggagcaccaggagcuggacugcaccagcggcaugaagcaggccaacggccaguucaucgacaagcugguggagagcgugaugaagcugugccugaucauggccaaguacagcaacgacggcgccgcccuggccgagcuggaggagcaggccgccagcgccaacaagcccaacuucagaggcaccagaugcauccacagcggcgccaugccccagaacuaccaggacagccugggccacgaggugaucgugaacaaccagugcagcaccaacagccugcagaagcagcugcaggccgugcugcaguggaucgccgccagccaguucaacgugcccaugcuguacuucaugggcgacaaggacggccagcuggagaagcugccccaggugagcgccaaggccgccgagaagggcuacagcgugggcggccugcugcaggaggugaugaaguucgccaaggagagacagcccgacgaggccgugggcaagguggccagaaagcagcugcuggacuggcugcuggccaaccuguga

SEQ ID NO: 439 - RNA, 2565 nt, Artificial Sequence
  derived and/or modified sequence opt5 from AKAP4__Homo_sapiens__AAI26251
augauggccuacagcgacaccacaaugauguccgaugacaucgauuggcugagaucucaccggggcgugugcaaggucgaccucuauaaccccgaggggcagcaagaucaggaccgcaaaguuauuuguuucguggaugugagcacgcugaaugucgaagacaaggauuacaaagacgcugccuccucuagcuccgagggaaaccuuaaucugggcucucucgaagagaaggaaaucauugugaucaaagauaccgagaagaaggaccagagcaaaacagagggguccguuugccuguuuaagcaggcgccuagcgauccggugucuguccuuaacuggcugcucuccgaccugcaaaaauaugcucugggauuccagcaugcccucagccccucuaccuccacauguaagcacaaagugggcgacaccgaaggggaguaccauagagccagcucugaaaauugcuauuccguuuacgcugaucaggugaacauugacuaucugaugaaucggccucagaaccuucgccuggagaugacagccgcuaagaauaccaacaauaaccaaagccccuccgccccucccgcgaagccuccgucuacgcagagagccgucaucagccccgauggagaguguuccaucgacgaucucagcuuuuacgugaaucggcugucuucccuugugauucagauggcucacaaagaaaucaaggagaaacuggaaggcaagagcaaaugccuccaucacucuauuuguccuagccccggcaacaaggagcgcaucuccccuagaacccccgccucuaaaauugcuagcgaaauggccuacgaggcggucgagcugacagccgcugaaaugcgggggaccggagaggaaucccgcgagggcgggcagaagucuuuccuguauucugaacucuccaauaagagcaaaucuggagacaagcaaaugucccagagagagagcaaagaguuugccgauuccaucucuaagggccugaugguuuacgcuaaccagguggccagcgacaugauggugucccuuaugaaaacacugaagguccacucuagcgggaagccgauuccugccuccgugguucucaaacgggugcugcuucgccauaccaaggaaaucgucagcgaucugaucgacucuugcaugaaaaaccuccacaauauuacgggagugcugaugacagauuccgacuucguuagcgcugugaagagaaaccuguuuaaucaauggaaacagaacgcgaccgacaucauggaggccaugcucaagcggcuggucucugcucuuauuggcgaagagaaggaaacaaaaucccagagccugucuuaugccagccucaaggccggcucccaugaucccaaaugucgcaaucagagccuggaguucucuaccaugaaggcugagaugaaagaaagagacaaggggaagaugaaauccgauccuugcaagagccuuaccuccgccgagaaagugggagaacacauccugaaggagggccucacaauuuggaaccaaaaacaggggaauagcuguaaggucgcgacgaaggcuugcagcaacaaagacgagaagggagagaaaaucaaugccuccaccgauucucuggccaaggaccugaucgugagcgcucucaaacugauucaguaccaccuuacacagcaaaccaagggcaaagauacaugcgaggaagacugucccggguccaccaugggauauauggcccagucuacgcaguacgagaagugcggcggcgggcagagcgcuaaggcccuguccguuaaacaacucgaaagccaucgggcgcccggaccuucuacaugucagaaggagaaccagcaccuggauucccagaaaauggacaugagcaauaucgugcugaugcuuauucaaaagcuccugaacgagaauccguuuaaaugcgaagaucccugugagggcgaaaacaagugcucugagccuagagccuccaaggcugccagcaugucuaaucgcuccgacaaagcugaagaacagugucaggagcaucaagaacuggauugcaccagcgggaugaagcaggccaacggacaguucaucgacaaacucgucgaguccgugaugaagcugugucuuauuauggcgaaauauagcaacgacggcgccgcucuggccgaacucgaggaacaggcugccucugccaauaagcccaacuuucgggggaccagaugcauccacagcggcgcuaugccucaaaauuaccaggauucccugggacaugagguuaucgugaacaaucaguguucuacaaacagccugcagaagcaacuucaggcgguccuccaguggauugccgcuucccaguucaaugugcccaugcuguacuuuaugggcgacaaagaugggcaacuggagaagcucccucaggugucugccaaagccgcugaaaagggauauagcguuggcgggcugcuucaggaggucaugaaauucgccaaggaacgccaaccggacgaggcggugggaaaaguggcucggaagcagcugcucgauuggcugcuggccaaccuuuga

SEQ ID NO: 440 - protein, 416 aa, Artificial Sequence
  alpha-actinin-_4/m__Homo_sapiens__B4DSX0
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSWRSRASSSPTSTCAASSPARPMLWGPGSRPRWRRSGASPLR

SEQ ID NO: 441 - RNA, 1251 nt, Artificial Sequence
  alpha-actinin-_4/m__Homo_sapiens__BAG61782
augguggacuaccacgcggcgaaccagucguaccaguacggccccagcagcgcgggcaauggcgcuggcggcgggggcagcaugggcgacuacauggcccaggaggacgacugggaccgggaccugcugcuggacccggccugggagaagcagcagcgcaagaccuucacggcauggugcaacucccaccugcggaaggcaggcacacagaucgagaacauugaugaggacuuccgagacgggcucaagcucaugcugcuccuggaggucauaucaggggagcgguuaccuaagccggagcgggggaagaugagagugcacaaaaucaacaaugugaacaaagcgcuggacuuuauugccagcaaaggcgucaagcuggucuccaucggggcagaagagauuguggacggcaacgcaaagaugacccugggaaugaucuggaccaucauccuuagguucgccauccaggacaucuccguggaagagaccucggccaaggaagggcuccuucucuggugccagagaaagacagccccguauaagaacgucaaugugcagaacuuccacaucagcuggaaggauggucuugccuucaaugcccugauccaccggcacagaccagagcugauugaguaugacaagcugaggaaggacgacccugucaccaaccugaacaaugccuucgaaguggcugagaaauaccucgacauccccaagaugcuggaugcagaggacaucgugaacacggcccggcccgacgagaaggccauaaugaccuauguguccagcuucuaccaugccuuuucaggagcgcagaaggcugaaacugccgccaaccggaucuguaaggugcuggcugucaaccaagagaacgagcaccugauggaggacuacgagaagcuggccagcgaccuccuggaguggauccggcgcaccauccccuggcuggaggaccgugugccccaaaagacuauccaggagaugcagcagaagcuggaggacuuccgcgacuaccggcgugugcacaagccgcccaaggugcaggagaagugccagcuggagaucaacuucaacacgcugcagaccaagcugcgccucagcaaccggcccgccuucaugcccuccuggaggagcagagcaagcagcaguccaacgagcaccugcgccgccaguucgccagccaggccaauguuguggggcccuggauccagaccaagauggaggagaucgggcgcaucuccauugagauga

SEQ ID NO: 442 - RNA, 1251 nt, Artificial Sequence
  derived and/or modified sequence opt1 from alpha-actinin-_4/m__Homo_sapiens__BAG61782
augguggacuaccacgccgccaaccaguccuaccaguacggccccuccagcgcggggaacggcgccgggggcgggggcuccaugggcgacuacauggcccaggaggacgacugggaccgcgaccugcuccuggacccggccugggagaagcagcagcggaagaccuucaccgccuggugcaacagccaccuccgcaaggcggggacccagaucgagaacaucgacgaggacuuccgggacggccugaagcugaugcugcuccuggaggucaucuccggggagcgccugcccaagcccgagcggggcaagaugcgcgugcacaagaucaacaacgugaacaaggcccucgacuucaucgccagcaagggggucaagcugguguccaucggcgccgaggagaucguggacggcaacgcgaagaugacccuggggaugaucuggaccaucauccuccgguucgccauccaggacaucagcgucgaggagaccuccgccaaggagggccugcugcucuggugccagcgcaagacggcccccuacaagaacgugaacgugcagaacuuccacaucagcuggaaggacgggcuggccuucaacgcgcugauccaccggcaccgcccggagcucaucgaguacgacaagcugcggaaggacgaccccgucaccaaccugaacaacgccuucgagguggccgagaaguaccucgacauccccaagaugcuggacgccgaggacaucgugaacaccgcccgccccgacgagaaggcgaucaugaccuacgucuccagcuucuaccacgccuucuccggcgcccagaaggccgagacggccgcgaaccggaucugcaaggugcuggccgugaaccaggagaacgagcaccucauggaggacuacgagaagcuggccagcgaccugcucgaguggauccgccggaccaucccguggcuggaggaccgcgucccccagaagaccauccaggagaugcagcagaagcuggaggacuuccgggacuaccgccgggugcacaagccgcccaaggugcaggagaagugccagcucgagaucaacuucaacacccugcagacgaagcugcgccucuccaaccggcccgccuucaugcccagcuggcgcucccgcgccagcuccagccccaccagcacgugcgcggccuccagccccgcccggccgaugcuguggggccccgggucccgcccccgguggcgccggagcggcgccagcccccugcgcuga

SEQ ID NO: 443 - RNA, 1251 nt, Artificial Sequence
  derived and/or modified sequence opt2 from alpha-actinin-_4/m__Homo_sapiens__BAG61782
auggucgacuaccacgccgccaaccaguccuaccaguacggccccuccuccgccggcaacggcgccggcggcggcggcuccaugggcgacuacauggcccaggaggacgacugggaccgcgaccuccuccucgaccccgccugggagaagcagcagcgcaagaccuucaccgccuggugcaacucccaccuccgcaaggccggcacccagaucgagaacaucgacgaggacuuccgcgacggccucaagcucaugcuccuccucgaggucaucuccggcgagcgccuccccaagcccgagcgcggcaagaugcgcguccacaagaucaacaacgucaacaaggcccucgacuucaucgccuccaagggcgucaagcucgucuccaucggcgccgaggagaucgucgacggcaacgccaagaugacccucggcaugaucuggaccaucauccuccgcuucgccauccaggacaucuccgucgaggagaccuccgccaaggagggccuccuccucuggugccagcgcaagaccgcccccuacaagaacgucaacguccagaacuuccacaucuccuggaaggacggccucgccuucaacgcccucauccaccgccaccgccccgagcucaucgaguacgacaagcuccgcaaggacgaccccgucaccaaccucaacaacgccuucgaggucgccgagaaguaccucgacauccccaagaugcucgacgccgaggacaucgucaacaccgcccgccccgacgagaaggccaucaugaccuacgucuccuccuucuaccacgccuucuccggcgcccagaaggccgagaccgccgccaaccgcaucugcaagguccucgccgucaaccaggagaacgagcaccucauggaggacuacgagaagcucgccuccgaccuccucgaguggauccgccgcaccauccccuggcucgaggaccgcgucccccagaagaccauccaggagaugcagcagaagcucgaggacuuccgcgacuaccgccgcguccacaagccccccaagguccaggagaagugccagcucgagaucaacuucaacacccuccagaccaagcuccgccucuccaaccgccccgccuucaugcccuccuggcgcucccgcgccuccuccucccccaccuccaccugcgccgccuccucccccgcccgccccaugcucuggggccccggcucccgcccccgcuggcgccgcuccggcgccuccccccuccgcuga

SEQ ID NO: 444 - RNA, 1251 nt, Artificial Sequence
  derived and/or modified sequence opt3 from alpha-actinin-_4/m__Homo_sapiens__BAG61782
augguggacuaccacgccgcuaaccagagcuaucaauacggccccuccucugcagggaauggagccgguggcgggggaucaaugggcgauuauauggcgcaggaggacgauugggacagagaucugcuccuugacccugcuugggaaaagcagcagaggaaaaccuucacagccuggugcaacagucaucugcggaaggcagguacucaaaucgagaauauugaugaagacuuucgcgauggguugaaauuaaugcugcuacucgaggucauaagcggagaacgacugccaaagccggagcguggcaaaaugagaguucacaagaucaacaaugugaacaaggcccuugacuucauugcuuccaaaggcguaaagcuggugucuaucggggcagaggaaauugucgauggaaaugccaaaaugacguuggguaugaucuggaccauaauccucagguuugcuauucaggacaucucgguggaggaaacaucagccaaggagggccugcugcucuggugucagcggaaaacugcgcccuacaagaacguuaaugugcagaacuuccauauuagcuggaaggauggguuagcauuuaaugcccugauccaccgccauagaccugagcuuauagaauaugacaaauugaggaaggacgauccagucaccaaccugaauaacgcuuucgagguggccgaaaaauaccuagacauucccaagaugcucgaugcagaggacaucguaaauacagcucggccugaugaaaaagccauuaugaccuauguuaguuccuuuuaccacgcguucucuggagcccaaaaggcagagacugcugccaaccgcaucugcaaagugcuggcugucaaccaggagaaugaacaccuuauggaggacuacgaaaagcuggccagcgauuugcucgaguggauccgaagaacaauuccauggcuggaagacagggugccccagaagaccauacaggagaugcaacagaaauuagaggauuuucgggacuaucgucgcgugcauaagccuccaaaaguccaggaaaagugucaacuggagaucaacuucaauacgcuccagacuaaacuuagacuguccaacaggccggcauuuaugcccucauggcggagucgagccucuagcuccccuaccucaacaugcgcugcgagcaguccagcacgccccauguuguggggcccugguucuagaccaagguggcggcgcuccggggccagcccccuaagauga

SEQ ID NO: 445 - RNA, 1251 nt, Artificial Sequence
  derived and/or modified sequence opt4 from alpha-actinin-_4/m__Homo_sapiens__BAG61782
augguggacuaccacgccgccaaccagagcuaccaguacggccccagcagcgccggcaacggcgccggcggcggcggcagcaugggcgacuacauggcccaggaggacgacugggacagagaccugcugcuggaccccgccugggagaagcagcagagaaagaccuucaccgccuggugcaacagccaccugagaaaggccggcacccagaucgagaacaucgacgaggacuucagagacggccugaagcugaugcugcugcuggaggugaucagcggcgagagacugcccaagcccgagagaggcaagaugagagugcacaagaucaacaacgugaacaaggcccuggacuucaucgccagcaagggcgugaagcuggugagcaucggcgccgaggagaucguggacggcaacgccaagaugacccugggcaugaucuggaccaucauccugagauucgccauccaggacaucagcguggaggagaccagcgccaaggagggccugcugcuguggugccagagaaagaccgcccccuacaagaacgugaacgugcagaacuuccacaucagcuggaaggacggccuggccuucaacgcccugauccacagacacagacccgagcugaucgaguacgacaagcugagaaaggacgaccccgugaccaaccugaacaacgccuucgagguggccgagaaguaccuggacauccccaagaugcuggacgccgaggacaucgugaacaccgccagacccgacgagaaggccaucaugaccuacgugagcagcuucuaccacgccuucagcggcgcccagaaggccgagaccgccgccaacagaaucugcaaggugcuggccgugaaccaggagaacgagcaccugauggaggacuacgagaagcuggccagcgaccugcuggaguggaucagaagaaccauccccuggcuggaggacagagugccccagaagaccauccaggagaugcagcagaagcuggaggacuucagagacuacagaagagugcacaagccccccaaggugcaggagaagugccagcuggagaucaacuucaacacccugcagaccaagcugagacugagcaacagacccgccuucaugcccagcuggagaagcagagccagcagcagccccaccagcaccugcgccgccagcagccccgccagacccaugcuguggggccccggcagcagacccagauggagaagaagcggcgccagcccccugagauga

SEQ ID NO: 446 - RNA, 1251 nt, Artificial Sequence
  derived and/or modified sequence opt5 from alpha-actinin-_4/m__Homo_sapiens__BAG61782
augguggacuaccacgccgcuaaccagagcuaucaauacggccccuccucugccgggaauggagcgggcgggggaggcagcaugggggauuauauggcucaggaggacgauugggacagagaucugcuccuggacccugccugggaaaagcagcagcggaaaaccuucacagccuggugcaacucccaucuucgcaaggcuggaacgcaaaucgagaauauugaugaagacuuuagagauggccugaaacucaugcugcuucuggaggucaucucuggcgaacggcucccgaagcccgagcgcgggaaaaugagaguucacaagauuaacaaugugaacaaggcccuggacuucaucgcuagcaaaggagugaagcuggucuccauuggcgccgaggaaaucguggaugggaaugcgaaaaugacccucggaaugaucuggacaauuauccugcgguuugccauucaggacaucucuguugaggaaaccagcgcuaaggagggccuucugcucuggugucagcgcaaaacagccccuuacaagaacgugaauguccagaacuuccauauuuccuggaaggaugggcuggcuuuuaaugcccuuauccacagacaucggcccgagcugauugaauaugacaaacuccgcaaggacgauccugugaccaaccugaauaacgcguucgagguugccgaaaaauaccuggacauccccaagaugcucgaugcugaggacaucgugaauacagccagaccugaugaaaaagcuauuaugaccuaugucagcucuuuuuaccacgccuucuccggagcccaaaaggcugagacggcggccaaccggaucugcaaagugcuggcugugaaccaggagaaugaacaccuuauggaggacuacgaaaagcuggccagcgaucuccuggaguggauucgcagaaccaucccguggcuugaagaccgggucccccagaagacaauucaggagaugcaacagaaacuggaggauuuucgcgacuauagacggguucauaagccucccaaagugcaggaaaagugucaacucgagaucaacuucaauacccugcagacaaaacugagacucucuaaccgcccugccuuuaugcccuccuggcggagcagagcuucuuccagcccgaccuccacgugcgccgcgucuagcccugcucgccccaugcuguggggcccuggcucccggcccagauggcgccggagcggggccucuccccuuagauga

SEQ ID NO: 447 - protein, 562 aa, Artificial Sequence [sequence omitted]

SEQ ID NO: 448 - RNA, 1689 nt, Artificial Sequence
  alpha-actinin-_4/m__Homo_sapiens__BAG65349
augguggacuaccacgcggcgaaccagucguaccaguacggccccagcagcgcgggcaauggcgcuggcggcgggggcagcaugggcgacuacauggcccaggaggacgacugggaccgggaccugcugcuggacccggccugggagaagcagcagcgcaagaccuucacggcauggugcaacucccaccugcggaaggcaggcacacagaucgagaacauugaugaggacuuccgagacgggcucaagcucaugcugcuccuggaggucauaucaggggagcgguuaccuaagccggagcgggggaagaugagagugcacaaaaucaacaaugugaacaaagcgcuggacuuuauugccagcaaaggcgucaagcuggucuccaucggggcagaagagauuguggacggcaacgcaaagaugacccugggaaugaucuggaccaucauccuuagguucgccauccaggacaucuccguggaagagaccucggccaaggaagggcuccuucucuggugccagagaaagacagccccauauaagaacgucaaugugcagaacuuccacaucagcuggaaggauggucuugccuucaaugcccugauccaccggcacagaccagagcugauugaguaugacaagcugaggaaggacgacccugucaccaaccugaacaaugccuucgaaguggcugagaaauaccucgacauccccaagaugcuggaugcagaggacaucgugaacacggcccggcccgacgagaaggccauaaugaccuauguguccagcuucuaccaugccuuuucaggagcgcagaaggcugaaacugccgccaaccggaucuguaaggugcuggcugucaaccaagagaacgagcaccugauggaggacuacgagaagcuggccagcgaccuccuggaguggauccagcgcaccauccccuggcuggaggaccgugugccccaaaaggcuauccaggagaugcagcagaagcuggaggacuuccgcgacuaccggcgugugcacaagccgcccaaggugcaggagaagugccagcuggagaucaacuucaacacgcugcagaccaagcugcgccucagcaaccggcccgccuucaugcccuccgagggcaagauggucucggacaucaacaauggcuggcagcacuuggagcaggcugagaagggcuacgaggaguggcugcugaaugagauccgcaggcuggagcggcucgaccaccuggcagagaaguuccggcagaaggccuccauccacgaggccuggacugacgggaaggaagccaugcugaagcaccgggacuacgagacggccacacuaucggacaucaaagcccucauucgcaagcacgaggccuucgagagcgaccuggcugcgcaccaggaccgcguggagcagaucgccgccauugcccaggagcucaacgagcuggauuacuacgacucccacaaugucaacacccccgacggccuccaggaggggccugggcagccccacagucccauuccuccacucuguaucuaugcaaagcacucucugcaguccuccggggugggugggugggcagggaggggcuggggcaggcucucuccucucucucuuuguggguuggccaggagguucccccgaccagguuggggagacuuggggccagcgcuucuggucugguaa

SEQ ID NO: 449 - RNA, 1689 nt, Artificial Sequence
  derived and/or modified sequence opt1 from alpha-actinin-_4/m__Homo_sapiens__BAG65349
augguggacuaccacgccgccaaccagagcuaccaguacggccccuccagcgcggggaacggcgccgggggcgggggcuccaugggcgacuacauggcccaggaggacgacugggaccgcgaccugcuccuggacccggccugggagaagcagcagcggaagaccuucaccgccuggugcaacagccaccuccgcaaggcggggacgcagaucgagaacaucgacgaggacuuccgggacggccugaagcugaugcugcuccuggaggucaucuccggggagcgccugcccaagcccgagcggggcaagaugcgcgugcacaagaucaacaacgugaacaaggcccucgacuucaucgccagcaagggggucaagcugguguccaucggcgccgaggagaucguggacggcaacgcgaagaugacccuggggaugaucuggaccaucauccuccgguucgccauccaggacaucagcgucgaggagaccuccgccaaggagggccugcugcucuggugccagcgcaagacggcccccuacaagaacgugaacgugcagaacuuccacaucagcuggaaggacgggcuggccuucaacgcgcugauccaccggcaccgcccggagcucaucgaguacgacaagcugcggaaggacgaccccgucaccaaccugaacaacgccuucgagguggccgagaaguaccucgacauccccaagaugcuggacgccgaggacaucgugaacaccgcccgccccgacgagaaggcgaucaugaccuacgucuccagcuucuaccacgccuucuccggcgcccagaaggccgagacggccgcgaaccggaucugcaaggugcuggccgugaaccaggagaacgagcaccucauggaggacuacgagaagcuggccagcgaccugcucgaguggauccagcgcaccaucccguggcuggaggaccgggucccccagaaggccauccaggagaugcagcagaagcuggaggacuuccgcgacuaccggcgcgugcacaagccgcccaaggugcaggagaagugccagcucgagaucaacuucaacacccugcagaccaagcugcggcucuccaaccgccccgccuucaugcccagcgagggcaagauggucuccgacaucaacaacggguggcagcaccuggagcaggcggagaagggcuacgaggaguggcugcucaacgagauccggcgccuggagcgccuggaccaccucgccgagaaguuccggcagaaggccagcauccacgaggccuggacggacgggaaggaggcgaugcugaagcaccgcgacuacgagaccgccacccuguccgacaucaaggcccucauccggaagcacgaggccuucgagagcgaccuggccgcgcaccaggaccgcguggagcagaucgccgccaucgcccaggagcugaacgagcucgacuacuacgacagccacaacgugaacacccccgacggccugcaggaggggcccggccagccgcacucccccaucccgccccugugcaucuacgccaagcacagccuccaguccagcggcgucgggggcugggcggggcggggcugggggcgccugagcccccugucccugugcggccucgcccggcgcuucccccggcccggcuggggcgaccuggggcccgcccugcucgugugguga

SEQ ID NO: 450 - RNA, 1689 nt, Artificial Sequence
  derived and/or modified sequence opt2 from alpha-actinin-_4/m__Homo_sapiens__BAG65349
auggucgacuaccacgccgccaaccaguccuaccaguacggccccuccuccgccggcaacggcgccggcggcggcggcuccaugggcgacuacauggcccaggaggacgacugggaccgcgaccuccuccucgaccccgccugggagaagcagcagcgcaagaccuucaccgccuggugcaacucccaccuccgcaaggccggcacccagaucgagaacaucgacgaggacuuccgcgacggccucaagcucaugcuccuccucgaggucaucuccggcgagcgccuccccaagcccgagcgcggcaagaugcgcguccacaagaucaacaacgucaacaaggcccucgacuucaucgccuccaagggcgucaagcucgucuccaucggcgccgaggagaucgucgacggcaacgccaagaugacccucggcaugaucuggaccaucauccuccgcuucgccauccaggacaucuccgucgaggagaccuccgccaaggagggccuccuccucuggugccagcgcaagaccgcccccuacaagaacgucaacguccagaacuuccacaucuccuggaaggacggccucgccuucaacgcccucauccaccgccaccgccccgagcucaucgaguacgacaagcuccgcaaggacgaccccgucaccaaccucaacaacgccuucgaggucgccgagaaguaccucgacauccccaagaugcucgacgccgaggacaucgucaacaccgcccgccccgacgagaaggccaucaugaccuacgucuccuccuucuaccacgccuucuccggcgcccagaaggccgagaccgccgccaaccgcaucugcaagguccucgccgucaaccaggagaacgagcaccucauggaggacuacgagaagcucgccuccgaccuccucgaguggauccagcgcaccauccccuggcucgaggaccgcgucccccagaaggccauccaggagaugcagcagaagcucgaggacuuccgcgacuaccgccgcguccacaagccccccaagguccaggagaagugccagcucgagaucaacuucaacacccuccagaccaagcuccgccucuccaaccgccccgccuucaugcccuccgagggcaagauggucuccgacaucaacaacggcuggcagcaccucgagcaggccgagaagggcuacgaggaguggcuccucaacgagauccgccgccucgagcgccucgaccaccucgccgagaaguuccgccagaaggccuccauccacgaggccuggaccgacggcaaggaggccaugcucaagcaccgcgacuacgagaccgccacccucuccgacaucaaggcccucauccgcaagcacgaggccuucgaguccgaccucgccgcccaccaggaccgcgucgagcagaucgccgccaucgcccaggagcucaacgagcucgacuacuacgacucccacaacgucaacacccccgacggccuccaggagggccccggccagccccacucccccauccccccccucugcaucuacgccaagcacucccuccaguccuccggcgucggcggcugggccggccgcggcuggggccgccucuccccccucucccucugcggccucgcccgccgcuucccccgccccggcuggggcgaccucggccccgcccuccucgucugguga

SEQ ID NO: 451 - RNA, 1689 nt, Artificial Sequence
  derived and/or modified sequence opt3 from alpha-actinin-_4/m__Homo_sapiens__BAG65349
augguggacuaccacgcugcuaaccagagcuaucaauacggccccuccucugcagggaauggagccgguggcgggggaucaaugggcgauuauauggcgcaggaggacgauugggacagagaucugcuccuugacccugcuugggaaaagcagcagaggaaaaccuucacagccuggugcaacagucaucugcggaaggcagguacucaaaucgagaauauugaugaagacuuucgcgauggguugaaauuaaugcugcuacucgaggucauaagcggagaacgacugccaaagccggagcguggcaaaaugagaguucacaagaucaacaaugugaacaaggcccuugacuucauugcuuccaaaggcguaaagcuggugucuaucggggcagaggaaauugucgauggaaaugccaaaaugacguuggguaugaucuggaccauaauccucagguuugcuauucaggacaucucgguggaggaaacaucagccaaggagggccugcugcucuggugucagcggaaaacugcgcccuacaagaacguuaaugugcagaacuuccauauuagcuggaaggauggguuagcauuuaaugcccugauccaccgccauagaccugagcuuauagaauaugacaaauugaggaaggacgauccagucaccaaccugaauaacgcuuucgagguggccgaaaaauaccuagacauucccaagaugcucgaugcagaggacaucguaaauacagcucggccugaugaaaaagccauuaugaccuauguuaguuccuuuuaccacgcguucucuggagcccaaaaggcagagacugcugccaaccgcaucugcaaagugcuggcugucaaccaggagaaugaacaccuuauggaggacuacgaaaagcuggccagcgauuugcucgaguggauccagcgaacaauuccauggcuggaagacagagugccccagaaggcaauacaagagaugcagcagaaauuagaggauuuuagggacuaucggcgugugcauaagccuccaaaaguccaagaaaagugucagcuggagaucaacuucaauacccuccagacgaaacuucgccuguccaacagaccggccuuuaugcccucagaaggcaagaugguuagugauauuaauaacgguuggcagcacuuggagcaagcugaaaagggguacgaggaguggcuacugaaugaaaucaggcggcucgagcgacuggaccaucuugcggaaaaauuccgccagaaggcaagcauacacgaggccuggacugacggaaaagaggcuaugcugaagcacagagauuaugaaaccgccacauugucugacauuaaagcacucaucaggaagcaugaggccuuugaauccgaucuggcugcccaccaggaccggguggagcagaucgcagcgauugcucaagaauuaaacgagcuggauuacuaugacucacauaauguaaacacuccugauggccuacaggagggcccagggcagccccacagcccuaucccaccccucugcauuuacgccaagcauagucugcagucuuccggaguggguggcugggcagggcgcggauggggcagacuuagcccguugucgcuguguggucucgccaggcguuucccucggcccggguggggcgaccugggaccagcccuucuggucugguga

SEQ ID NO: 452 - RNA, 1689 nt, Artificial Sequence
  derived and/or modified sequence opt4 from alpha-actinin-_4/m__Homo_sapiens__BAG65349
augguggacuaccacgccgccaaccagagcuaccaguacggccccagcagcgccggcaacggcgccggcggcggcggcagcaugggcgacuacauggcccaggaggacgacugggacagagaccugcugcuggaccccgccugggagaagcagcagagaaagaccuucaccgccuggugcaacagccaccugagaaaggccggcacccagaucgagaacaucgacgaggacuucagagacggccugaagcugaugcugcugcuggaggugaucagcggcgagagacugcccaagcccgagagaggcaagaugagagugcacaagaucaacaacgugaacaaggcccuggacuucaucgccagcaagggcgugaagcuggugagcaucggcgccgaggagaucguggacggcaacgccaagaugacccugggcaugaucuggaccaucauccugagauucgccauccaggacaucagcguggaggagaccagcgccaaggagggccugcugcuguggugccagagaaagaccgcccccuacaagaacgugaacgugcagaacuuccacaucagcuggaaggacggccuggccuucaacgcccugauccacagacacagacccgagcugaucgaguacgacaagcugagaaaggacgaccccgugaccaaccugaacaacgccuucgagguggccgagaaguaccuggacauccccaagaugcuggacgccgaggacaucgugaacaccgccagacccgacgagaaggccaucaugaccuacgugagcagcuucuaccacgccuucagcggcgcccagaaggccgagaccgccgccaacagaaucugcaaggugcuggccgugaaccaggagaacgagcaccugauggaggacuacgagaagcuggccagcgaccugcuggaguggauccagagaaccauccccuggcuggaggacagagugccccagaaggccauccaggagaugcagcagaagcuggaggacuucagagacuacagaagagugcacaagccccccaaggugcaggagaagugccagcuggagaucaacuucaacacccugcagaccaagcugagacugagcaacagacccgccuucaugcccagcgagggcaagauggugagcgacaucaacaacggcuggcagcaccuggagcaggccgagaagggcuacgaggaguggcugcugaacgagaucagaagacuggagagacuggaccaccuggccgagaaguucagacagaaggccagcauccacgaggccuggaccgacggcaaggaggccaugcugaagcacagagacuacgagaccgccacccugagcgacaucaaggcccugaucagaaagcacgaggccuucgagagcgaccuggccgcccaccaggacagaguggagcagaucgccgccaucgcccaggagcugaacgagcuggacuacuacgacagccacaacgugaacacccccgacggccugcaggagggccccggccagccccacagccccauccccccccugugcaucuacgccaagcacagccugcagagcagcggcgugggcggcugggccggcagaggcuggggcagacugagcccccugagccugugcggccuggccagaagauuccccagacccggcuggggcgaccugggccccgcccugcuggugugguga

SEQ ID NO: 453 - RNA, 1689 nt, Artificial Sequence
  derived and/or modified sequence opt5 from alpha-actinin-_4/m__Homo_sapiens__BAG65349
augguggacuaccacgccgcuaaccagagcuaucaauacggccccuccucugccgggaauggagcgggcgggggaggcagcaugggggauuauauggcucaggaggacgauugggacagagaucugcuccuggacccugccugggaaaagcagcagcggaaaaccuucacagccuggugcaacucccaucuucgcaaggcuggaacgcaaaucgagaauauugaugaagacuuuagagauggccugaaacucaugcugcuucuggaggucaucucuggcgaacggcucccgaagcccgagcgcgggaaaaugagaguucacaagauuaacaaugugaacaaggcccuggacuucaucgcuagcaaaggagugaagcuggucuccauuggcgccgaggaaaucguggaugggaaugcgaaaaugacccucggaaugaucuggacaauuauccugcgguuugccauucaggacaucucuguugaggaaaccagcgcuaaggagggccuucugcucuggugucagcgcaaaacagccccuuacaagaacgugaauguccagaacuuccauauuuccuggaaggaugggcuggcuuuuaaugcccuuauccacagacaucggcccgagcugauugaauaugacaaacuccgcaaggacgauccugugaccaaccugaauaacgcguucgagguugccgaaaaauaccuggacauccccaagaugcucgaugcugaggacaucgugaauacagccagaccugaugaaaaagcuauuaugaccuaugucagcucuuuuuaccacgccuucuccggagcccaaaaggcugagacggcggccaaccggaucugcaaagugcuggcugugaaccaggagaaugaacaccuuauggaggacuacgaaaagcuggccagcgaucuccuggaguggauucagcgcaccaucccguggcuugaagacagagucccccagaaggccauucaagagaugcagcagaaacuggaggauuuucgggacuaucgcagaguucauaagccucccaaagugcaagaaaagugucagcucgagaucaacuucaauacacugcagaccaaacugcggcucucuaacagaccugcuuuuaugcccuccgaaggcaagauggugagcgauaucaauaacggcuggcagcaccuggagcaagccgaaaagggguacgaggaguggcuucugaaugaaauucgccggcucgagagacuggaccaucuugcggaaaaauuccgccagaaggcuucuauccacgaggccuggacagacggaaaagaggccaugcugaagcaccgggauuaugaaaccgcuacgcucuccgacauuaaagcccugaucagaaagcaugaggcuuuugaaagcgaucuggccgcgcaccaggaccgcgucgagcagauugccgcuaucgcccaagaacucaacgagcuggauuacuaugacucccauaaugugaacacaccggauggccuucaggaggggccuggacagccccacucuccuaucccuccccugugcauuuacgcuaagcauagccuccaguccagcggcguugggggaugggccggccggggcugggggagacugucuccccugucccuuuguggacucgcgcgccgguucccgagacccggcuggggagaccuggggccugcccugcucgugugguga

SEQ ID NO: 454 - protein, 911 aa, Artificial Sequence
  alpha-actinin-_4/m__Homo_sapiens__O43707
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 455 - RNA, 2736 nt, Artificial Sequence
  alpha-actinin-_4/m__Homo_sapiens__AAH05033
augguggacuaccacgcggcgaaccagucguaccaguacggccccagcagcgcgggcaauggcgcuggcggcgggggcagcaugggcgacuacauggcccaggaggacgacugggaccgggaccugcugcuggacccggccugggagaagcagcagcgcaagaccuucacggcauggugcaacucccaccugcggaaggcaggcacacagaucgagaacauugaugaggacuuccgagacgggcucaagcucaugcugcuccuggaggucauaucaggggagcgguuaccuaagccggagcgggggaagaugagagugcacaaaaucaacaaugugaacaaagcgcuggacuuuauugccagcaaaggcgucaagcuggucuccaucggggcagaagagauuguggacggcaacgcaaagaugacccugggaaugaucuggaccaucauccuuagguucgccauccaggacaucuccguggaagagaccucggccaaggaagggcuccuucucuggugccagagaaagacagccccguauaagaacgucaaugugcagaacuuccacaucagcuggaaggauggucuugccuucaaugcccugauccaccggcacagaccagagcugauugaguaugacaagcugaggaaggacgacccugucaccaaccugaacaaugccuucgaaguggcugagaaauaccucgacauccccaagaugcuggaugcagaggacaucgugaacacggcccggcccgacgagaaggccauaaugaccuauguguccagcuucuaccaugccuuuucaggagcgcagaaggcugaaacugccgccaaccggaucuguaaggugcuggcugucaaccaagagaacgagcaccugauggaggacuacgagaagcuggccagcgaccuccuggaguggauccggcgcaccauccccuggcuggaggaccgugugccccaaaagacuauccaggagaugcagcagaagcuggaggacuuccgcgacuaccggcgugugcacaagccgcccaaggugcaggagaagugccagcuggagaucaacuucaacacgcugcagaccaagcugcgccucagcaaccggcccgccuucaugcccuccgagggcaagauggucucggacaucaacaauggcuggcagcacuuggagcaggcugagaagggcuacgaggaguggcugcugaaugagauccgcaggcuggagcggcucgaccaccuggcagagaaguuccggcagaaggccuccauccacgaggccuggacugacgggaaggaagccaugcugaagcaccgggacuacgagacggccacacuaucggacaucaaagcccucauucgcaagcacgaggccuucgagagcgaccuggcugcgcaccaggaccgcguggagcagaucgccgccauugcccaggagcucaacgagcuggauuacuacgacucccacaaugucaacacccggugccagaagaucugugaccagugggacgcccucggcucucugacacauagucgcagggaagcccuggagaaaacagagaagcagcuggaggccaucgaccagcugcaccuggaauacgccaagcgcgcggcccccuucaacaacuggauggagagcgccauggaggaccuccaggacauguucaucguccauaccaucgaggagauugagggccugaucucagcccaugaccaguucaaguccacccugccggacgccgauagggagcgcgaggccauccuggccauccacaaggaggcccagaggaucgcugagagcaaccacaucaagcugucgggcagcaaccccuacaccaccgucaccccgcaaaucaucaacuccaagugggagaaggugcagcagcuggugccaaaacgggaccaugcccuccuggaggagcagagcaagcagcaguccaacgagcaccugcgccgccaguucgccagccaggccaauguuguggggcccuggauccagaccaagauggaggagaucgggcgcaucuccauugagaugaacgggacccuggaggaccagcugagccaccugaagcaguaugaacgcagcaucguggacuacaagcccaaccuggaccugcuggagcagcagcaccagcucauccaggaggcccucaucuucgacaacaagcacaccaacuauaccauggagcacauccgcgugggcugggagcagcugcucaccaccauugcccgcaccaucaacgagguggagaaccagauccucacccgcgacgccaagggcaucagccaggagcagaugcaggaguuccgggcguccuucaaccacuucgacaaggaucauggcggggcgcuggggcccgaggaguucaaggccugccucaucagccugggcuacgacguggagaacgaccggcagggugaggccgaguucaaccgcaucaugagccuggucgaccccaaccauagcggccuugugaccuuccaagccuucaucgacuucaugucgcgggagaccaccgacacggacacggcugaccaggucaucgcuuccuucaaggucuuagcaggggacaagaacuucaucacagcugaggagcugcggagagagcugccccccgaccaggccgaguacugcaucgcccgcauggcgccauaccagggcccugacgccgugcccggugcccucgacuacaaguccuucuccacggccuuguauggcgagagcgaccuguga

SEQ ID NO: 456 - RNA, 2736 nt, Artificial Sequence
  derived and/or modified sequence opt1 from alpha-actinin-_4/m__Homo_sapiens__AAH05033
augguggacuaccacgccgccaaccagagcuaccaguacggccccuccagcgcggggaacggcgccgggggcgggggcuccaugggcgacuacauggcccaggaggacgacugggaccgcgaccugcuccuggacccggccugggagaagcagcagcggaagaccuucaccgccuggugcaacagccaccuccgcaaggcggggacgcagaucgagaacaucgacgaggacuuccgggacggccucaagcugaugcugcuccuggaggucaucuccggggagcgccugcccaagcccgagcggggcaagaugcgcgugcacaagaucaacaacgugaacaaggcccucgacuucaucgccagcaagggggucaagcugguguccaucggcgccgaggagaucguggacggcaacgcgaagaugacccuggggaugaucuggaccaucauccuccgguucgccauccaggacaucagcgucgaggagaccuccgccaaggagggccugcugcucuggugccagcgcaagacggcccccuacaagaacgugaacgugcagaacuuccacaucagcuggaaggacgggcuggccuucaacgcgcugauccaccggcaccgcccggagcucaucgaguacgacaagcugcggaaggacgaccccgucaccaaccugaacaacgccuucgagguggccgagaaguaccucgacauccccaagaugcuggacgccgaggacaucgugaacaccgcccgccccgacgagaaggcgaucaugaccuacgucuccagcuucuaccacgccuucuccggcgcccagaaggccgagacggccgcgaaccggaucugcaaggugcuggccgugaaccaggagaacgagcaccucauggaggacuacgagaagcuggccagcgaccugcucgaguggauccgccggaccaucccguggcuggaggaccgcgucccccagaagaccauccaggagaugcagcagaagcuggaggacuuccgggacuaccgccgggugcacaagccgcccaaggugcaggagaagugccagcucgagaucaacuucaacacccugcagacgaagcugcgccucuccaaccggcccgccuucaugcccagcgagggcaagauggucuccgacaucaacaacggguggcagcaccuggagcaggccgagaagggcuacgaggaguggcugcucaacgagauccgccgccuggagcggcuggaccaccucgcggagaaguuccgccagaaggccagcauccacgaggccuggaccgacgggaaggaggccaugcugaagcaccgggacuacgagaccgcgacccuguccgacaucaaggcccucauccgcaagcacgaggccuucgagagcgaccuggccgcccaccaggaccggguggagcagaucgcggccaucgcccaggagcugaacgagcucgacuacuacgacagccacaacgugaacacgcgcugccagaagaucugcgaccagugggacgcccugggcucccugacccacagccggcgcgaggcccucgagaagaccgagaagcagcuggaggcgaucgaccagcugcaccuggaguacgccaagcgggccgcccccuucaacaacuggauggaguccgccauggaggaccuccaggacauguucaucguccacaccaucgaggagaucgaggggcugaucagcgcgcacgaccaguucaaguccacgcugcccgacgccgaccgcgagcgggaggccauccucgccauccacaaggaggcgcagcgcaucgccgagagcaaccacaucaagcuguccggcagcaacccguacaccaccgugacgccccagaucaucaacuccaagugggagaaggugcagcagcugguccccaagcgggaccacgcccuccuggaggagcagagcaagcagcaguccaacgagcaccuccgccggcaguucgccagccaggccaacguggucggccccuggauccagaccaagauggaggagaucgggcgcaucuccaucgagaugaacggcacccuggaggaccagcugagccaccugaagcaguacgagcgguccaucguggacuacaagccgaaccucgaccugcuggagcagcagcaccagcucauccaggaggcgcugaucuucgacaacaagcacaccaacuacaccauggagcacauccgcguggggugggagcagcugcucacgaccaucgcccggaccaucaacgaggucgagaaccagauccugacccgcgacgccaagggcaucagccaggagcagaugcaggaguuccgcgccuccuucaaccacuucgacaaggaccacgggggcgcccugggccccgaggaguucaaggcgugccucaucagccugggguacgacguggagaacgaccggcagggcgaggccgaguucaaccgcaucaugucccugguggaccccaaccacagcgggcucgucacguuccaggccuucaucgacuucaugagccgggagaccaccgacaccgacacggccgaccaggugaucgccuccuucaaggugcuggcgggcgacaagaacuucaucaccgccgaggagcugcgccgggagcugcccccggaccaggccgaguacugcaucgcccgcauggcgcccuaccaggggcccgacgccguccccggcgcccuggacuacaagagcuucuccaccgcccuguacggcgagagcgaccucuga

SEQ ID NO: 457 - RNA, 2736 nt, Artificial Sequence
  derived and/or modified sequence opt2 from alpha-actinin-_4/m__Homo_sapiens__AAH05033
auggucgacuaccacgccgccaaccaguccuaccaguacggccccuccuccgccggcaacggcgccggcggcggcggcuccaugggcgacuacauggcccaggaggacgacugggaccgcgaccuccuccucgaccccgccugggagaagcagcagcgcaagaccuucaccgccuggugcaacucccaccuccgcaaggccggcacccagaucgagaacaucgacgaggacuuccgcgacggccucaagcucaugcuccuccucgaggucaucuccggcgagcgccuccccaagcccgagcgcggcaagaugcgcguccacaagaucaacaacgucaacaaggcccucgacuucaucgccuccaagggcgucaagcucgucuccaucggcgccgaggagaucgucgacggcaacgccaagaugacccucggcaugaucuggaccaucauccuccgcuucgccauccaggacaucuccgucgaggagaccuccgccaaggagggccuccuccucuggugccagcgcaagaccgcccccuacaagaacgucaacguccagaacuuccacaucuccuggaaggacggccucgccuucaacgcccucauccaccgccaccgccccgagcucaucgaguacgacaagcuccgcaaggacgaccccgucaccaaccucaacaacgccuucgaggucgccgagaaguaccucgacauccccaagaugcucgacgccgaggacaucgucaacaccgcccgccccgacgagaaggccaucaugaccuacgucuccuccuucuaccacgccuucuccggcgcccagaaggccgagaccgccgccaaccgcaucugcaagguccucgccgucaaccaggagaacgagcaccucauggaggacuacgagaagcucgccuccgaccuccucgaguggauccgccgcaccauccccuggcucgaggaccgcgucccccagaagaccauccaggagaugcagcagaagcucgaggacuuccgcgacuaccgccgcguccacaagccccccaagguccaggagaagugccagcucgagaucaacuucaacacccuccagaccaagcuccgccucuccaaccgccccgccuucaugcccuccgagggcaagauggucuccgacaucaacaacggcuggcagcaccucgagcaggccgagaagggcuacgaggaguggcuccucaacgagauccgccgccucgagcgccucgaccaccucgccgagaaguuccgccagaaggccuccauccacgaggccuggaccgacggcaaggaggccaugcucaagcaccgcgacuacgagaccgccacccucuccgacaucaaggcccucauccgcaagcacgaggccuucgaguccgaccucgccgcccaccaggaccgcgucgagcagaucgccgccaucgcccaggagcucaacgagcucgacuacuacgacucccacaacgucaacacccgcugccagaagaucugcgaccagugggacgcccucggcucccucacccacucccgccgcgaggcccucgagaagaccgagaagcagcucgaggccaucgaccagcuccaccucgaguacgccaagcgcgccgcccccuucaacaacuggauggaguccgccauggaggaccuccaggacauguucaucguccacaccaucgaggagaucgagggccucaucuccgcccacgaccaguucaaguccacccuccccgacgccgaccgcgagcgcgaggccauccucgccauccacaaggaggcccagcgcaucgccgaguccaaccacaucaagcucuccggcuccaaccccuacaccaccgucaccccccagaucaucaacuccaagugggagaagguccagcagcucguccccaagcgcgaccacgcccuccucgaggagcaguccaagcagcaguccaacgagcaccuccgccgccaguucgccucccaggccaacgucgucggccccuggauccagaccaagauggaggagaucggccgcaucuccaucgagaugaacggcacccucgaggaccagcucucccaccucaagcaguacgagcgcuccaucgucgacuacaagcccaaccucgaccuccucgagcagcagcaccagcucauccaggaggcccucaucuucgacaacaagcacaccaacuacaccauggagcacauccgcgucggcugggagcagcuccucaccaccaucgcccgcaccaucaacgaggucgagaaccagauccucacccgcgacgccaagggcaucucccaggagcagaugcaggaguuccgcgccuccuucaaccacuucgacaaggaccacggcggcgcccucggccccgaggaguucaaggccugccucaucucccucggcuacgacgucgagaacgaccgccagggcgaggccgaguucaaccgcaucaugucccucgucgaccccaaccacuccggccucgucaccuuccaggccuucaucgacuucaugucccgcgagaccaccgacaccgacaccgccgaccaggucaucgccuccuucaagguccucgccggcgacaagaacuucaucaccgccgaggagcuccgccgcgagcucccccccgaccaggccgaguacugcaucgcccgcauggcccccuaccagggccccgacgccguccccggcgcccucgacuacaaguccuucuccaccgcccucuacggcgaguccgaccucuga

SEQ ID NO: 458 - RNA, 2736 nt, Artificial Sequence
  derived and/or modified sequence opt3 from alpha-actinin-_4/m__Homo_sapiens__AAH05033
augguggacuaccacgccgcuaaccagagcuaucaauacggccccuccucugcagggaauggagccgguggcgggggaucaaugggcgauuauauggcgcaggaggacgauugggacagagaucugcuccuugacccugcuugggaaaagcagcagaggaaaaccuucacagccuggugcaacagucaucugcggaaggcagguacucaaaucgagaauauugaugaagacuuucgcgauggguugaaauuaaugcugcuacucgaggucauaagcggagaacgacugccaaagccggagcguggcaaaaugagaguucacaagaucaacaaugugaacaaggcccuugacuucauugcuuccaaaggcguaaagcuggugucuaucggggcagaggaaauugucgauggaaaugccaaaaugacguuggguaugaucuggaccauaauccucagguuugcuauucaggacaucucgguggaggaaacaucagccaaggagggccugcugcucuggugucagcggaaaacugcgcccuacaagaacguuaaugugcagaacuuccauauuagcuggaaggauggguuagcauuuaaugcccugauccaccgccauagaccugagcuuauagaauaugacaaauugaggaaggacgauccagucaccaaccugaauaacgcuuucgagguggccgaaaaauaccuagacauucccaagaugcucgaugcagaggacaucguaaauacagcucggccugaugaaaaagccauuaugaccuauguuaguuccuuuuaccacgcguucucuggagcccaaaaggcagagacugcugccaaccgcaucugcaaagugcuggcugucaaccaggagaaugaacaccuuauggaggacuacgaaaagcuggccagcgauuugcucgaguggauccgaagaacaauuccauggcuggaagacagggugccccagaagaccauacaggagaugcaacagaaauuagaggauuuucgggacuaucgucgcgugcauaagccuccaaaaguccaggaaaagugucaacuggagaucaacuucaauacgcuccagacuaaacuuagacuguccaacaggccggcauuuaugcccucagaaggcaagaugguuagugauauuaauaacgguuggcagcacuuggagcaggccgaaaagggguacgaggaguggcuacugaaugaaauccggcgacucgagcgccuggaccaucuugcugaaaaauucagacaaaaggcgagcauacacgaggcauggaccgacggaaaagaggccaugcugaagcacagggauuaugaaacagcuacuuugucugacauuaaagcccucauccggaagcaugaggcauuugaauccgaucuggccgcucaccaggaccgcguggagcagaucgccgcaauugcgcaggaauuaaacgagcuggauuacuaugacucacauaauguaaacaccagaugccaaaagaucugugaucagugggacgcucuaggcagccucacacacaguaggcgugaggcccuggagaaaaccgagaagcagcuugaagcaauugaucaguugcaucuggaguacgccaaacgggcugccccuuucaauaacuggauggaaucugcaauggaggaccuccaagauauguucauagugcacacgaucgaggaaauugagggccugaucuccgcucacgaccaguuuaagagcacucuuccagaugccgaccgagaaagagaggcgauccuggccauucauaaagaagcucagaggauagcagagucgaaucacaucaaguugucuggguccaaccccuauacaaccgucacuccucagauuaucaauucaaagugggagaaagugcaacagcucguuccaaagcgcgaccaugcccuguuagaagaacagaguaaacaacagagcaacgaacaucugcggagacaguucgcuucccaggccaacguggucggacccuggauucaaacaaagauggaggagaucgguaggauaucuaucgaaaugaauggcacccuagaggaucagcucagccaccugaaacaguacgaacgcucaauuguggacuacaagccgaaccuugauuugcuggagcagcaacaccagcucauccaggaagcacugauuuuugacaauaaacacacgaacuauaccauggagcauauccgaguagggugggagcaguuacugacaacuauagcgcggaccauuaaugaaguugagaaccaaauccuuacacgugaugccaagggaauuagucaggaacagaugcaagaguucagagcuuccuuuaaucacuucgacaaggaucauggcggugccuuggggccugaagaguuuaaagcaugccucaucagccugggcuacgacguggagaacgauaggcagggagaagcugaguucaaucgcauaaugucucuagucgaccccaaccacucaggccuggugacuuuucaggccuucaucgauuuuaugagucgggaaaccacagacaccgauacugcagaccaggucauugccagcuucaaggugcucgcuggggacaaaaauuuuaucacggcggaggaacugagaagggagcuuccaccugaucaagccgaguauuguauugcacgaauggcucccuaccagggaccagacgccguucccggugccuuggauuauaaguccuucucuacagcucuguacggcgaaucggacuuauga

SEQ ID NO: 459 - RNA, 2736 nt, Artificial Sequence
  derived and/or modified sequence opt4 from alpha-actinin-_4/m__Homo_sapiens__AAH05033
augguggacuaccacgccgccaaccagagcuaccaguacggccccagcagcgccggcaacggcgccggcggcggcggcagcaugggcgacuacauggcccaggaggacgacugggacagagaccugcugcuggaccccgccugggagaagcagcagagaaagaccuucaccgccuggugcaacagccaccugagaaaggccggcacccagaucgagaacaucgacgaggacuucagagacggccugaagcugaugcugcugcuggaggugaucagcggcgagagacugcccaagcccgagagaggcaagaugagagugcacaagaucaacaacgugaacaaggcccuggacuucaucgccagcaagggcgugaagcuggugagcaucggcgccgaggagaucguggacggcaacgccaagaugacccugggcaugaucuggaccaucauccugagauucgccauccaggacaucagcguggaggagaccagcgccaaggagggccugcugcuguggugccagagaaagaccgcccccuacaagaacgugaacgugcagaacuuccacaucagcuggaaggacggccuggccuucaacgcccugauccacagacacagacccgagcugaucgaguacgacaagcugagaaaggacgaccccgugaccaaccugaacaacgccuucgagguggccgagaaguaccuggacauccccaagaugcuggacgccgaggacaucgugaacaccgccagacccgacgagaaggccaucaugaccuacgugagcagcuucuaccacgccuucagcggcgcccagaaggccgagaccgccgccaacagaaucugcaaggugcuggccgugaaccaggagaacgagcaccugauggaggacuacgagaagcuggccagcgaccugcuggaguggaucagaagaaccauccccuggcuggaggacagagugccccagaagaccauccaggagaugcagcagaagcuggaggacuucagagacuacagaagagugcacaagccccccaaggugcaggagaagugccagcuggagaucaacuucaacacccugcagaccaagcugagacugagcaacagacccgccuucaugcccagcgagggcaagauggugagcgacaucaacaacggcuggcagcaccuggagcaggccgagaagggcuacgaggaguggcugcugaacgagaucagaagacuggagagacuggaccaccuggccgagaaguucagacagaaggccagcauccacgaggccuggaccgacggcaaggaggccaugcugaagcacagagacuacgagaccgccacccugagcgacaucaaggcccugaucagaaagcacgaggccuucgagagcgaccuggccgcccaccaggacagaguggagcagaucgccgccaucgcccaggagcugaacgagcuggacuacuacgacagccacaacgugaacaccagaugccagaagaucugcgaccagugggacgcccugggcagccugacccacagcagaagagaggcccuggagaagaccgagaagcagcuggaggccaucgaccagcugcaccuggaguacgccaagagagccgcccccuucaacaacuggauggagagcgccauggaggaccugcaggacauguucaucgugcacaccaucgaggagaucgagggccugaucagcgcccacgaccaguucaagagcacccugcccgacgccgacagagagagagaggccauccuggccauccacaaggaggcccagagaaucgccgagagcaaccacaucaagcugagcggcagcaaccccuacaccaccgugaccccccagaucaucaacagcaagugggagaaggugcagcagcuggugcccaagagagaccacgcccugcuggaggagcagagcaagcagcagagcaacgagcaccugagaagacaguucgccagccaggccaacguggugggccccuggauccagaccaagauggaggagaucggcagaaucagcaucgagaugaacggcacccuggaggaccagcugagccaccugaagcaguacgagagaagcaucguggacuacaagcccaaccuggaccugcuggagcagcagcaccagcugauccaggaggcccugaucuucgacaacaagcacaccaacuacaccauggagcacaucagagugggcugggagcagcugcugaccaccaucgccagaaccaucaacgagguggagaaccagauccugaccagagacgccaagggcaucagccaggagcagaugcaggaguucagagccagcuucaaccacuucgacaaggaccacggcggcgcccugggccccgaggaguucaaggccugccugaucagccugggcuacgacguggagaacgacagacagggcgaggccgaguucaacagaaucaugagccugguggaccccaaccacagcggccuggugaccuuccaggccuucaucgacuucaugagcagagagaccaccgacaccgacaccgccgaccaggugaucgccagcuucaaggugcuggccggcgacaagaacuucaucaccgccgaggagcugagaagagagcugccccccgaccaggccgaguacugcaucgccagaauggcccccuaccagggccccgacgccgugcccggcgcccuggacuacaagagcuucagcaccgcccuguacggcgagagcgaccuguga

SEQ ID NO: 460 - RNA, 2736 nt, Artificial Sequence
  derived and/or modified sequence opt5 from alpha-actinin-_4/m__Homo_sapiens__AAH05033
augguggacuaccacgccgcuaaccagagcuaucaauacggccccuccucugccgggaauggagcgggcgggggaggcagcaugggggauuauauggcucaggaggacgauugggacagagaucugcuccuggacccugccugggaaaagcagcagcggaaaaccuucacagccuggugcaacucccaucuucgcaaggcuggaacgcaaaucgagaauauugaugaagacuuuagagauggccugaaacucaugcugcuucuggaggucaucucuggcgaacggcucccgaagcccgagcgcgggaaaaugagaguucacaagauuaacaaugugaacaaggcccuggacuucaucgcuagcaaaggagugaagcuggucuccauuggcgccgaggaaaucguggaugggaaugcgaaaaugacccucggaaugaucuggacaauuauccugcgguuugccauucaggacaucucuguugaggaaaccagcgcuaaggagggccuucugcucuggugucagcgcaaaacagccccuuacaagaacgugaauguccagaacuuccauauuuccuggaaggaugggcuggcuuuuaaugcccuuauccacagacaucggcccgagcugauugaauaugacaaacuccgcaaggacgauccugugaccaaccugaauaacgcguucgagguugccgaaaaauaccuggacauccccaagaugcucgaugcugaggacaucgugaauacagccagaccugaugaaaaagcuauuaugaccuaugucagcucuuuuuaccacgccuucuccggagcccaaaaggcugagacggcggccaaccggaucugcaaagugcuggcugugaaccaggagaaugaacaccuuauggaggacuacgaaaagcuggccagcgaucuccuggaguggauucgcagaaccaucccguggcuugaagaccgggucccccagaagacaauucaggagaugcaacagaaacuggaggauuuucgcgacuauagacggguucauaagccucccaaagugcaggaaaagugucaacucgagaucaacuucaauacccugcagacaaaacugagacucucuaaccgcccugccuuuaugcccuccgaaggcaagauggugagcgauaucaauaacggcuggcagcaccuggagcaggcugaaaagggguacgaggaguggcuucugaaugaaauucggagacucgagcgccuggaccaucuugccgaaaaauuccggcaaaaggcgucuauccacgaggcuuggaccgacggaaaagaggccaugcugaagcacagagauuaugaaacggccacacucuccgacauuaaagcucugauccgcaagcaugaggccuuugaaagcgaucuggcugcccaccaggaccgggucgagcagauugcggccaucgcucaggaacucaacgagcuggauuacuaugacucccauaaugugaacaccagaugccaaaagaucugugaucagugggacgcccuuggcucucugacacacagccgccgggaggcucucgagaaaaccgagaagcagcuggaagccauugaucagcugcaucuugaguacgcgaaaagagccgcuccguucaauaacuggauggaauccgccauggaggaccuccaagauauguucaucguucacaccauugaggaaaucgaggggcugauuagcgcucacgaccaguuuaagucuacacugccugaugccgaccgcgaacgggaggccauccucgcuauucauaaagaagcgcagagaaucgccgaguccaaucacaucaagcugagcggaucuaaccccuauacgaccgugacaccucagauuaucaauagcaagugggagaaaguccaacagcuugugcccaagcgggaccaugcucugcucgaagaacaguccaaacaacagucuaacgaacaucugcgcagacaguucgccagccaggccaacguugugggccccuggauucaaaccaagauggaggagaucgggcggauuuccaucgaaaugaauggaacacuggaggaucagcuuagccaccucaaacaguacgaaagaucuaucgucgacuacaagccuaaccuggaucugcucgagcagcaacaccagcugauucaggaagcucuuaucuuugacaauaaacacaccaacuauacgauggagcauauucgcgugggcugggagcagcugcucacaaccaucgcccggaccauuaaugaagucgagaaccaaauccugacaagagaugcgaagggcaucucccaggaacagaugcaagaguuccgcgcuagcuuuaaucacuucgacaaggaucaugggggagcccugggcccggaagaguuuaaagccugccuuauuucucucggguacgacguggagaacgauagacagggagaagcugaguucaaucggaucaugucccugguugaccccaaccacagcggccuggugaccuuucaggccuucauugauuuuaugucccgcgaaacaacggacaccgauacagcggaccaggucaucgcuucuuucaaggugcucgccggggacaaaaauuuuauuaccgccgaggaacugagacgggagcuuccucccgaucaagcugaguauuguaucgcccgcauggcuccuuaccagggccccgacgccguuccgggagcgcuggauuauaagagcuucuccacagcccucuacggcgaaucugaccuguga

SEQ ID NO: 461 - protein, 198 aa, Artificial Sequence [sequence omitted]

SEQ ID NO: 462 - RNA, 597 nt, Artificial Sequence
  alpha-methylacyl-coenzyme_A_racemase__Homo_sapiens__EAX10817
auggcacugcagggcaucucggucauggagcuguccggccuggccccgggcccguucugugcuaugguccuggcugacuucggggcgcgugugguacgcguggaccggcccggcucccgcuacgacgugagccgcuugggccggggcaagcgcucgcuagugcuggaccugaagcagccgcggggagccgccgugcugcggcgucugugcaagcggucggaugugcugcuggagcccuuccgccgcggugucauggagaaacuccagcugggcccagagauucugcagcgggaaaauccaaggcuuauuuaugccaggcugaguggauuuggccagucaggaagcuucugccgguuagcuggccacgauaucaacuauuuggcuuugucagguggaaggaacagcauauuuaaguucuuuucuguggaaaacucagaaaucgagucugugggaagcaccucgaggacagaacauguuggaugguggagcaccuuucuauacgacuuacaggacagcagauggggaauucauggcuguuggagcaauagaaccccaguucuacgagcugcugaucaaaggacuuggacuaaagucuga

SEQ ID NO: 463 - RNA, 597 nt, Artificial Sequence
  derived and/or modified sequence opt1 from alpha-methylacyl-coenzyme_A_racemase__Homo_sapiens__EAX10817
auggcccugcagggcaucagcgugauggagcucuccgggcuggcccccggcccguucugcgcgaugguccuggccgacuucggggcccgcguggugcgggucgaccgccccggcagccgguacgacgugucccgccucgggcggggcaagcgcagccuggugcuggaccucaagcagccccggggcgccgccguccugcgccggcugugcaagcgcuccgacgugcuccuggagcccuuccggcgcggggugauggagaagcugcagcucggcccggagauccugcagcgggagaacccccgccugaucuacgcgcggcucagcggguucggccaguccgggagcuucugccgccuggccggccacgacaucaacuaccuggcccucuccggcgggcggaacagcaucuucaaguucuucuccgucgagaacagcgagaucgaguccgugggcagcaccucccgcaccgagcacguggggugguggagcacguuccuguacgaccugcaggacucccgguggggcauccacggcugcuggagcaaccgcacccccguccuccgggccgcggaccagcgcaccuggaccaagguguga

SEQ ID NO: 464 - RNA, 597 nt, Artificial Sequence
  derived and/or modified sequence opt2 from alpha-methylacyl-coenzyme_A_racemase__Homo_sapiens__EAX10817
auggcccuccagggcaucuccgucauggagcucuccggccucgcccccggccccuucugcgccaugguccucgccgacuucggcgcccgcgucguccgcgucgaccgccccggcucccgcuacgacgucucccgccucggccgcggcaagcgcucccucguccucgaccucaagcagccccgcggcgccgccguccuccgccgccucugcaagcgcuccgacguccuccucgagcccuuccgccgcggcgucauggagaagcuccagcucggccccgagauccuccagcgcgagaacccccgccucaucuacgcccgccucuccggcuucggccaguccggcuccuucugccgccucgccggccacgacaucaacuaccucgcccucuccggcggccgcaacuccaucuucaaguucuucuccgucgagaacuccgagaucgaguccgucggcuccaccucccgcaccgagcacgucggcuggugguccaccuuccucuacgaccuccaggacucccgcuggggcauccacggcugcugguccaaccgcacccccguccuccgcgccgccgaccagcgcaccuggaccaaggucuga

SEQ ID NO: 465 - RNA, 597 nt, Artificial Sequence
  derived and/or modified sequence opt3 from alpha-methylacyl-coenzyme_A_racemase__Homo_sapiens__EAX10817
auggcccugcagggcaucagcgugauggagcucuccgggcuugcucccggaccuuucugcgcaaugguccuggccgacuuuggugcgagaguugugaggguagaucggccaggcucucgcuacgacgugucacgauuggggcguggaaagagaaguuuaguccuggaucuaaaacaaccgaggggcgcugccgugcuccggcgccuguguaagagaagcgacguucuucuggaacccuucaggcggggugugauggagaaauugcagcucgggccugaaauucugcagcgcgagaacccacgacugauauaugcaagacucuccggauuuggccagucuggcucguucugcagguuagccgggcacgauaucaauuaccuggcucuuucaggaggucggaacagcauuuuuaaguucuuuagugucgaaaauuccgagaucgagucugugggcagcaccucccguacagaacauguagggugguggucaacuuucuuguaugaccugcaagauagucgcuggggcauucacggauguuggagcaacagaacgcccguucuaagggcagccgaccagcggaccuggacaaaaguguga

SEQ ID NO: 466 - RNA, 597 nt, Artificial Sequence
  derived and/or modified sequence opt4 from alpha-methylacyl-coenzyme_A_racemase__Homo_sapiens__EAX10817
auggcccugcagggcaucagcgugauggagcugagcggccuggcccccggccccuucugcgccauggugcuggccgacuucggcgccagaguggugagaguggacagacccggcagcagauacgacgugagcagacugggcagaggcaagagaagccuggugcuggaccugaagcagcccagaggcgccgccgugcugagaagacugugcaagagaagcgacgugcugcuggagcccuucagaagaggcgugauggagaagcugcagcugggccccgagauccugcagagagagaaccccagacugaucuacgccagacugagcggcuucggccagagcggcagcuucugcagacuggccggccacgacaucaacuaccuggcccugagcggcggcagaaacagcaucuucaaguucuucagcguggagaacagcgagaucgagagcgugggcagcaccagcagaaccgagcacgugggcugguggagcaccuuccuguacgaccugcaggacagcagauggggcauccacggcugcuggagcaacagaacccccgugcugagagccgccgaccagagaaccuggaccaagguguga

SEQ ID NO: 467 - RNA, 597 nt, Artificial Sequence
  derived and/or modified sequence opt5 from alpha-methylacyl-coenzyme_A_racemase__Homo_sapiens__EAX10817
auggcccugcagggcaucagcgugauggagcucuccgggcuggcucccggaccuuucugcgccaugguccuugcggacuuuggcgcuagaguugugcggguggaucgcccggggucuagauacgacgucagccggcugggacgcggcaagagaucccucgugcuggaucuuaaacaaccccgcggggccgccguucugcggagacucuguaagcggucugacgugcugcuggaaccuuuccgcagaggagucauggagaaacuccagcugggccccgaaauucuucagcgggagaacccucgccugaucuaugcuagacucagcggcuuugggcaguccggaucuuucugccggcuggccggccacgauauuaauuaccuugcucugagcgggggacgcaacuccaucuuuaaguucuuuagcguggaaaauucugagauugaguccguuggcagcaccucuagaacagaacaugugggguggugguccacguuccucuaugaccugcaagauagccgguggggaauccacggcuguuggucuaacagaacccccguccugcgcgccgcggaccagcggacauggaccaaaguguga

SEQ ID NO: 468 - protein, 198 aa, Artificial Sequence [sequence omitted]

SEQ ID NO: 469 - RNA, 597 nt, Artificial Sequence
  alpha-methylacyl-coenzyme_A_racemase__Homo_sapiens__BAF85677
auggcacugcagggcaucucggucguggagcuguccggccuggccccgggcccguucugugcuaugguccuggcugacuucggggcgcgugugguacgcguggaccggcccggcucccgcuacgacgugagccgcuugggccggggcaagcgcucgcuagugcuggaccugaagcagccgcggggagccgccgugcugcggcgucugugcaagcggucggaugugcugcuggagcccuuccgccgcggugucauggagaaacuccagcugggcccagagauucugcagcgggaaaauccaaggcuuauuuaugccaggcugaguggauuuggccagucaggaagcuucugccgguuagcuggccacgauaucaacuauuuggcuuugucagguggaaggaacagcauauuuaaguucuuuucuguggaaaacucagaaaucgagucugugggaagcaccucgaggacagaacauguuggaugguggagcaccuuucuauacgacuuacaggacagcagauggggaauucauggcuguuggagcaauagaaccccauuucuacgagcugcugaucaaaggacuuggacuaaagucuga

SEQ ID NO: 470 - RNA, 597 nt, Artificial Sequence
  derived and/or modified sequence opt1 from alpha-methylacyl-coenzyme_A_racemase__Homo_sapiens__BAF85677
auggcccugcagggcaucagcguggucgagcucuccgggcuggcccccggcccguucugcgcgauggugcuggccgacuucggggcccgcgugguccggguggaccgccccggcagccgguacgacgugucccgccucgggcggggcaagcgcagccugguccuggaccucaagcagccccggggcgccgccgugcugcgccggcugugcaagcgcuccgacgugcuccuggagcccuuccggcgcggggucauggagaagcugcagcucggcccggagauccugcagcgggagaacccccgccugaucuacgcgcggcucagcggguucggccaguccgggagcuucugccgccuggccggccacgacaucaacuaccuggcccucuccggcgggcggaacagcaucuucaaguucuucuccguggagaacagcgagaucgaguccgugggcagcaccucccgcaccgagcacgucgggugguggagcacguuccuguacgaccugcaggacucccgguggggcauccacggcugcuggagcaaccgcacccccuuccuccgggccgcggaccagcgcaccuggaccaagguguga

SEQ ID NO: 471 - RNA, 597 nt, Artificial Sequence
  derived and/or modified sequence opt2 from alpha-methylacyl-coenzyme_A_racemase__Homo_sapiens__BAF85677
auggcccuccagggcaucuccgucgucgagcucuccggccucgcccccggccccuucugcgccaugguccucgccgacuucggcgcccgcgucguccgcgucgaccgccccggcucccgcuacgacgucucccgccucggccgcggcaagcgcucccucguccucgaccucaagcagccccgcggcgccgccguccuccgccgccucugcaagcgcuccgacguccuccucgagcccuuccgccgcggcgucauggagaagcuccagcucggccccgagauccuccagcgcgagaacccccgccucaucuacgcccgccucuccggcuucggccaguccggcuccuucugccgccucgccggccacgacaucaacuaccucgcccucuccggcggccgcaacuccaucuucaaguucuucuccgucgagaacuccgagaucgaguccgucggcuccaccucccgcaccgagcacgucggcuggugguccaccuuccucuacgaccuccaggacucccgcuggggcauccacggcugcugguccaaccgcacccccuuccuccgcgccgccgaccagcgcaccuggaccaaggucuga

SEQ ID NO: 472 - RNA, 597 nt, Artificial Sequence
  derived and/or modified sequence opt3 from alpha-methylacyl-coenzyme_A_racemase__Homo_sapiens__BAF85677
auggcccugcagggcaucagcguggucgagcucuccgggcuugcucccggaccuuucugcgcaaugguucuggccgacuuuggugcgagagugguaaggguggaucggccaggcucucgcuacgacgucucacgauuggggcguggaaagagaaguuuagugcuggaucuaaaacaaccgaggggcgcugccguucuccggcgccuguguaagagaagcgacgugcuucuggaacccuucaggcggggugucauggagaaauugcagcucgggccugaaauucugcagcgcgagaacccacgacugauauaugcaagacucuccggauuuggccagucuggcucguucugcagguuagccgggcacgauaucaauuaccuggcucuuucaggaggucggaacagcauuuuuaaguucuuuaguguggaaaauuccgagaucgagucuguaggcagcaccucccguacagaacauguugggugguggucaacuuucuuguaugaccugcaagauagucgcuggggcauucacggauguuggagcaacagaacgcccuuucuaagggcagccgaccagcggaccuggacaaaaguguga

SEQ ID NO: 473 - RNA, 597 nt, Artificial Sequence
  derived and/or modified sequence opt4 from alpha-methylacyl-coenzyme_A_racemase__Homo_sapiens__BAF85677
auggcccugcagggcaucagcgugguggagcugagcggccuggcccccggccccuucugcgccauggugcuggccgacuucggcgccagaguggugagaguggacagacccggcagcagauacgacgugagcagacugggcagaggcaagagaagccuggugcuggaccugaagcagcccagaggcgccgccgugcugagaagacugugcaagagaagcgacgugcugcuggagcccuucagaagaggcgugauggagaagcugcagcugggccccgagauccugcagagagagaaccccagacugaucuacgccagacugagcggcuucggccagagcggcagcuucugcagacuggccggccacgacaucaacuaccuggcccugagcggcggcagaaacagcaucuucaaguucuucagcguggagaacagcgagaucgagagcgugggcagcaccagcagaaccgagcacgugggcugguggagcaccuuccuguacgaccugcaggacagcagauggggcauccacggcugcuggagcaacagaacccccuuccugagagccgccgaccagagaaccuggaccaagguguga

SEQ ID NO: 474 - RNA, 597 nt, Artificial Sequence
  derived and/or modified sequence opt5 from alpha-methylacyl-coenzyme_A_racemase__Homo_sapiens__BAF85677
auggcccugcagggcaucagcguggucgagcucuccgggcuggcucccggaccuuucugcgccaugguucuugcggacuuuggcgcuagaguggugcgggucgaucgcccggggucuagauacgacgugagccggcugggacgcggcaagagaucccucguucuggaucuuaaacaaccccgcggggccgccgugcugcggagacucuguaagcggucugacguccugcuggaaccuuuccgcagaggagugauggagaaacuccagcugggccccgaaauucuucagcgggagaacccucgccugaucuaugcuagacucagcggcuuugggcaguccggaucuuucugccggcuggccggccacgauauuaauuaccuugcucugagcgggggacgcaacuccaucuuuaaguucuuuagcguugaaaauucugagauugaguccgugggcagcaccucuagaacagaacaugucggguggugguccacguuccucuaugaccugcaagauagccgguggggaauccacggcuguuggucuaacagaacccccuuucugcgcgccgcggaccagcggacauggaccaaaguguga

SEQ ID NO: 475 - protein, 920 aa, Artificial Sequence
  ANDR__Homo_sapiens__P10275
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 476 - RNA, 2763 nt, Artificial Sequence
  ANDR__Homo_sapiens__EAX05380
auggaagugcaguuagggcugggaagggucuacccucggccgccguccaagaccuaccgaggagcuuuccagaaucuguuccagagcgugcgcgaagugauccagaacccgggccccaggcacccagaggccgcgagcgcagcaccucccggcgccaguuugcugcugcugcagcagcagcagcagcagcagcagcagcagcagcagcagcagcagcagcagcagcagcagcagcagcaagagacuagccccaggcagcagcagcagcagcagggugaggaugguucuccccaagcccaucguagaggccccacaggcuaccugguccuggaugaggaacagcaaccuucacagccgcagucggcccuggagugccaccccgagagagguugcgucccagagccuggagccgccguggccgccagcaaggggcugccgcagcagcugccagcaccuccggacgaggaugacucagcugccccauccacguugucccugcugggccccacuuuccccggcuuaagcagcugcuccgcugaccuuaaagacauccugagcgaggccagcaccaugcaacuccuucagcaacagcagcaggaagcaguauccgaaggcagcagcagcgggagagcgagggaggccucgggggcucccacuuccuccaaggacaauuacuuagggggcacuucgaccauuucugacaacgccaaggaguuguguaaggcagugucgguguccaugggccuggguguggaggcguuggagcaucugaguccaggggaacagcuucggggggauugcauguacgccccacuuuugggaguuccacccgcugugcgucccacuccuugugccccauuggccgaaugcaaagguucucugcuagacgacagcgcaggcaagagcacugaagauacugcugaguauuccccuuucaagggagguuacaccaaagggcuagaaggcgagagccuaggcugcucuggcagcgcugcagcagggagcuccgggacacuugaacugccgucuacccugucucucuacaaguccggagcacuggacgaggcagcugcguaccagagucgcgacuacuacaacuuuccacuggcucuggccggaccgccgcccccuccgccgccuccccauccccacgcucgcaucaagcuggagaacccgcuggacuacggcagcgccugggcggcugcggcggcgcagugccgcuauggggaccuggcgagccugcauggcgcgggugcagcgggacccgguucugggucacccucagccgccgcuuccucauccuggcacacucucuucacagccgaagaaggccaguuguauggaccguguggugguggugggggugguggcggcggcggcggcggcggcggcggcggcggcggcggcggcggcggcggcgaggcgggagcuguagcccccuacggcuacacucggcccccucaggggcuggcgggccaggaaagcgacuucaccgcaccugaugugugguacccuggcggcauggugagcagagugcccuaucccagucccacuugugucaaaagcgaaaugggccccuggauggauagcuacuccggaccuuacggggacaugcguuuggagacugccagggaccauguuuugcccauugacuauuacuuuccaccccagaagaccugccugaucuguggagaugaagcuucugggugucacuauggagcucucacauguggaagcugcaaggucuucuucaaaagagccgcugaagggaaacagaaguaccugugcgccagcagaaaugauugcacuauugauaaauuccgaaggaaaaauuguccaucuugucgucuucggaaauguuaugaagcagggaugacucugggagcccggaagcugaagaaacuugguaaucugaaacuacaggaggaaggagaggcuuccagcaccaccagccccacugaggagacaacccagaagcugacagugucacacauugaaggcuaugaaugucagcccaucuuucugaauguccuggaagccauugagccagguguagugugugcuggacacgacaacaaccagcccgacuccuuugcagccuugcucucuagccucaaugaacugggagagagacagcuuguacacguggucaagugggccaaggccuugccuggcuuccgcaacuuacacguggacgaccagauggcugucauucaguacuccuggauggggcucaugguguuugccaugggcuggcgauccuucaccaaugucaacuccaggaugcucuacuucgccccugaucugguuuucaaugaguaccgcaugcacaagucccggauguacagccaguguguccgaaugaggcaccucucucaagaguuuggauggcuccaaaucaccccccaggaauuccugugcaugaaagcacugcuacucuucagcauuauuccaguggaugggcugaaaaaucaaaaauucuuugaugaacuucgaaugaacuacaucaaggaacucgaucguaucauugcaugcaaaagaaaaaaucccacauccugcucaagacgcuucuaccagcucaccaagcuccuggacuccgugcagccuauugcgagagagcugcaucaguucacuuuugaccugcuaaucaagucacacauggugagcguggacuuuccggaaaugauggcagagaucaucucugugcaagugcccaagauccuuucugggaaagucaagcccaucuauuuccacacccaguga

SEQ ID NO: 477 - RNA, 2763 nt, Artificial Sequence
  derived and/or modified sequence opt1 from ANDR__Homo_sapiens__EAX05380
auggaggugcagcugggccucgggcgcgucuacccccggccgcccagcaagaccuaccgcggcgccuuccagaaccuguuccaguccgugcgggaggugauccagaaccccgggccccgccacccggaggccgcgagcgccgccccccccggcgccucccugcuccugcugcagcagcagcagcagcagcagcagcagcagcagcagcagcagcagcagcagcagcagcagcagcagcaggagaccagcccccggcagcagcagcagcagcagggggaggacggcuccccgcaggcccaccgccggggccccacgggguaccucguccuggacgaggagcagcagcccagccagccccaguccgcgcuggagugccacccggagcgcggcugcgugcccgagcccggggccgccguggccgcgagcaagggccucccccagcagcugccggccccccccgacgaggacgacuccgccgcccccagcacccugucccuccuggggccgaccuuccccggccugagcuccugcagcgccgaccucaaggacauccuguccgaggcgagcaccaugcagcugcuccagcagcagcagcaggaggccgucuccgagggcagcuccagcgggcgggcccgcgaggccagcggcgcccccacguccagcaaggacaacuaccuggggggcaccuccaccaucagcgacaacgcgaaggagcugugcaaggccguguccgugagcaugggccucggggucgaggcccuggagcaccugucccccggcgagcagcuccggggggacugcauguacgccccgcugcugggcgugccccccgccgugcgccccaccccgugcgcgccccucgccgagugcaaggggagccugcuggacgacuccgccggcaagagcacggaggacaccgccgaguacucccccuucaagggcggguacaccaagggccucgagggggagagccugggcugcuccgggagcgccgcggccggcuccagcggcacccuggagcucccguccacgcugagccuguacaaguccggggcccucgacgaggccgcggccuaccagagccgggacuacuacaacuucccccuggcccuggccggcccccccccgcccccccccccgccccacccccacgcccgcaucaagcucgagaacccccuggacuacgggagcgcgugggccgccgccgccgcgcagugccgguacggcgaccuggccucccuccacggggccggcgccgccggcccggggagcggcucccccagcgcggccgccuccagcuccuggcacacccuguucaccgccgaggaggggcagcuguacggccccugcggcgggggcgggggcgggggcggcgggggcgggggcgggggcggcgggggcgggggcgggggcggcggggaggcgggcgccgucgcccccuacggguacacccgcccgccccagggccucgccgggcaggagagcgacuucacggcccccgacgugugguaccccggcggcauggugucccgggucccguaccccagccccaccugcgugaaguccgagauggggcccuggauggacagcuacuccggcccguacggggacaugcgccuggagaccgcgcgggaccacgugcugcccaucgacuacuacuuccccccgcagaagaccugccucaucugcggcgacgaggccagcggcugccacuacggggcccugacgugcggcuccugcaaggucuucuucaagcgcgccgccgaggggaagcagaaguaccugugcgcgagccggaacgacugcaccaucgacaaguuccgccgcaagaacugccccuccugccggcugcgcaagugcuacgaggccggcaugacccucggggcccggaagcugaagaagcugggcaaccucaagcugcaggaggagggcgaggccagcagcaccacgucccccaccgaggagaccacccagaagcugacggugagccacaucgagggguacgagugccagcccaucuuccucaacgugcuggaggccaucgagccgggcgucgugugcgcggggcacgacaacaaccagcccgacuccuucgccgcccugcucagcucccugaacgagcugggcgagcgccagcucgugcacgucgugaagugggccaaggcgcugcccggguuccggaaccugcacgucgacgaccagauggccgugauccaguacagcuggaugggccucaugguguucgccaugggcuggcgcuccuucaccaacgucaacagccggaugcuguacuucgcccccgaccugguguucaacgaguaccgcaugcacaagucccggauguacagccagugcgugcgcaugcggcaccucucccaggaguucggguggcugcagaucaccccgcaggaguuccugugcaugaaggcccuccugcuguucagcaucauccccgucgacggccucaagaaccagaaguucuucgacgagcugcgcaugaacuacaucaaggagcuggaccggaucaucgcgugcaagcgcaagaaccccaccuccugcagccggcgcuucuaccagcucacgaagcugcuggacuccgugcagcccaucgcccgggagcuccaccaguucaccuucgaccugcugaucaagagccacaugguguccgucgacuucccggagaugauggccgagaucaucagcgugcaggugcccaagauccucuccgggaaggucaagcccaucuacuuccacacccaguga

SEQ ID NO: 478 - RNA, 2763 nt, Artificial Sequence
  derived and/or modified sequence opt2 from ANDR__Homo_sapiens__EAX05380
auggagguccagcucggccucggccgcgucuacccccgcccccccuccaagaccuaccgcggcgccuuccagaaccucuuccaguccguccgcgaggucauccagaaccccggcccccgccaccccgaggccgccuccgccgccccccccggcgccucccuccuccuccuccagcagcagcagcagcagcagcagcagcagcagcagcagcagcagcagcagcagcagcagcagcagcaggagaccuccccccgccagcagcagcagcagcagggcgaggacggcuccccccaggcccaccgccgcggccccaccggcuaccucguccucgacgaggagcagcagcccucccagccccaguccgcccucgagugccaccccgagcgcggcugcguccccgagcccggcgccgccgucgccgccuccaagggccucccccagcagcuccccgccccccccgacgaggacgacuccgccgcccccuccacccucucccuccucggccccaccuuccccggccucuccuccugcuccgccgaccucaaggacauccucuccgaggccuccaccaugcagcuccuccagcagcagcagcaggaggccgucuccgagggcuccuccuccggccgcgcccgcgaggccuccggcgcccccaccuccuccaaggacaacuaccucggcggcaccuccaccaucuccgacaacgccaaggagcucugcaaggccgucuccgucuccaugggccucggcgucgaggcccucgagcaccucucccccggcgagcagcuccgcggcgacugcauguacgccccccuccucggcgucccccccgccguccgccccacccccugcgccccccucgccgagugcaagggcucccuccucgacgacuccgccggcaaguccaccgaggacaccgccgaguacucccccuucaagggcggcuacaccaagggccucgagggcgagucccucggcugcuccggcuccgccgccgccggcuccuccggcacccucgagcuccccuccacccucucccucuacaaguccggcgcccucgacgaggccgccgccuaccagucccgcgacuacuacaacuucccccucgcccucgccggccccccccccccccccccccccccccacccccacgcccgcaucaagcucgagaacccccucgacuacggcuccgccugggccgccgccgccgcccagugccgcuacggcgaccucgccucccuccacggcgccggcgccgccggccccggcuccggcucccccuccgccgccgccuccuccuccuggcacacccucuucaccgccgaggagggccagcucuacggccccugcggcggcggcggcggcggcggcggcggcggcggcggcggcggcggcggcggcggcggcggcggcggcggcgaggccggcgccgucgcccccuacggcuacacccgccccccccagggccucgccggccaggaguccgacuucaccgcccccgacgucugguaccccggcggcauggucucccgcguccccuaccccucccccaccugcgucaaguccgagaugggccccuggauggacuccuacuccggccccuacggcgacaugcgccucgagaccgcccgcgaccacguccuccccaucgacuacuacuuccccccccagaagaccugccucaucugcggcgacgaggccuccggcugccacuacggcgcccucaccugcggcuccugcaaggucuucuucaagcgcgccgccgagggcaagcagaaguaccucugcgccucccgcaacgacugcaccaucgacaaguuccgccgcaagaacugccccuccugccgccuccgcaagugcuacgaggccggcaugacccucggcgcccgcaagcucaagaagcucggcaaccucaagcuccaggaggagggcgaggccuccuccaccaccucccccaccgaggagaccacccagaagcucaccgucucccacaucgagggcuacgagugccagcccaucuuccucaacguccucgaggccaucgagcccggcgucgucugcgccggccacgacaacaaccagcccgacuccuucgccgcccuccucuccucccucaacgagcucggcgagcgccagcucguccacgucgucaagugggccaaggcccuccccggcuuccgcaaccuccacgucgacgaccagauggccgucauccaguacuccuggaugggccucauggucuucgccaugggcuggcgcuccuucaccaacgucaacucccgcaugcucuacuucgcccccgaccucgucuucaacgaguaccgcaugcacaagucccgcauguacucccagugcguccgcaugcgccaccucucccaggaguucggcuggcuccagaucaccccccaggaguuccucugcaugaaggcccuccuccucuucuccaucauccccgucgacggccucaagaaccagaaguucuucgacgagcuccgcaugaacuacaucaaggagcucgaccgcaucaucgccugcaagcgcaagaaccccaccuccugcucccgccgcuucuaccagcucaccaagcuccucgacuccguccagcccaucgcccgcgagcuccaccaguucaccuucgaccuccucaucaagucccacauggucuccgucgacuuccccgagaugauggccgagaucaucuccguccagguccccaagauccucuccggcaaggucaagcccaucuacuuccacacccaguga

SEQ ID NO: 479 - RNA, 2763 nt, Artificial Sequence
  derived and/or modified sequence opt3 from ANDR__Homo_sapiens__EAX05380
auggaggugcagcugggccucgggagagucuaccccaggccuccaagcaagaccuaucggggagccuuccaaaaccuuuuucaguccguucgcgaagugauccagaauccggguccccgacacccugaggcugcaucugccgcgccacccggcgcuucacuguuguuacugcagcaacagcagcagcaacagcagcagcaacagcagcaacagcagcagcaacagcagcagcaacagcaggaaacaaguccucgucagcaacagcagcagcaaggggaggacggaagcccacaggcccauagaaggggccccacugguuaccuaguacucgaugaggaacagcaaccuucccagccacagucugcacuggagugccacccggaacgggggugugugcccgagccuggagccgcugucgcagccucgaaaggccuuccacagcaacugcccgcuccuccagacgaagaugacucagccgcgcccagcacguugagucuccugggcccgaccuucccugggcuguccucuugcagcgcagaucucaaggacauuuuauccgaggccucaacaaugcagcugcuucagcagcaacagcaggaggcugugagugaaggaagcagcuccggucgcgccagagaggcaucaggcgcucccacuagcaguaaagauaacuaucuugggggaaccucuacaauauccgacaaugccaaggaacuguguaaagcgguuagcgugucgaugggccuaggugucgaggcccucgaacaucugucuccaggggagcagcuuaggggagauugcauguacgcaccucuguugggcgugcccccagcuguacggcccaccccuugugccccacucgcugagugcaagggcucccuguuagacgauucagccgggaagaguacugaagacacagcagaguauagcccguuuaaaggagguuacaccaagggccuggaaggggagucccucggauguucuggcagcgccgcugcggguucaagugggacgcuugaacugcccuccacuuugagccuauauaaaucuggcgcacuggaugaggccgcugccuaccaaucacgcgacuacuauaacuucccucucgcacuggccggaccacccccuccacccccgccuccacacccccaugcucgaaucaaguuggagaauccucuggacuacggcagugccugggcagcggcugccgcacagugcagauauggggauuuggccagccuccacggagcuggugccgcaggccccggguccggaucuccaucggcugccgcgagcuccucauggcacacccuguuuacagccgaagagggccaguuauacgguccuugugggggcggaggcgggggagguggcgggggaggcggugggggcggaggcgggggaggcggugggggaggcgaagcuggugcaguugcccccuauggcuacacuaggccaccgcaagggcuggcuggacaggagagugacuucaccgccccugaugugugguaucccggcgggauggucucucgggugccauaccccagcccuacaugcgugaaauccgaaaugggaccauggauggacucauacagcggccccuauggugauaugcgucuagagaccgcacgcgaccauguccucccuauugauuacuauuuuccgccacagaagacgugucugaucugcggggacgaggcgucuggaugccacuacggcgcccuuacuugugguuccugcaagguuuucuuuaaaagagcugccgaaggcaagcagaaauauuugugugcaaguaggaacgauugcacaauugacaaguuccggcgaaagaauugucccagcugccgccugagaaaguguuacgaggcugggaugacccucggagccaggaaacugaagaaacuuggcaaccugaaauugcaagaagagggggaggcaucuuccacuacaucaccuaccgaagagacgacccagaagcucacagugagucauaucgaaggauaugagugccagccaauauuucugaauguauuagaagccaucgagcccggcguggucugugcuggucacgauaacaaucagccugacagcuucgcggcccugcuaucgucccucaacgagcugggggaacggcaacuugugcacguugugaaaugggcaaaggcuuugccgggauuucgcaaucugcaugucgacgaucagauggccgugauucaguacucuuggaugggccucaugguauucgccauggguuggagaucuuucacuaacguuaauucaaggaugcuguacuuugcucccgacuuaguguucaacgaguaucguaugcacaaaagucggauguacucccagugcguccgaaugagacaucugucucaagaauuuggcuggcuucagaucaccccacaggaguucuuguguaugaaggcacuccugcuauuuagcauuaucccuguggaugggcugaagaaccagaaauucuuugacgaacucaggaugaauuauauaaaggagcuggaucgcauuaucgccugcaaacggaagaaccccacauccugcucaagaagguucuaccaacuuacuaaauugcuggacagcguccagccaauugcgcgcgaguuacaccaguuuaccuucgaucuccugaucaagagucauauggugucuguugacuuuccugaaaugauggcugagaucauuuccgugcaaguacccaagauacuuagcggaaaagucaagccaaucuauuuccacacacaguga

SEQ ID NO: 480 - RNA, 2763 nt, Artificial Sequence
  derived and/or modified sequence opt4 from ANDR__Homo_sapiens__EAX05380
auggaggugcagcugggccugggcagaguguaccccagaccccccagcaagaccuacagaggcgccuuccagaaccuguuccagagcgugagagaggugauccagaaccccggccccagacaccccgaggccgccagcgccgccccccccggcgccagccugcugcugcugcagcagcagcagcagcagcagcagcagcagcagcagcagcagcagcagcagcagcagcagcagcagcaggagaccagccccagacagcagcagcagcagcagggcgaggacggcagcccccaggcccacagaagaggccccaccggcuaccuggugcuggacgaggagcagcagcccagccagccccagagcgcccuggagugccaccccgagagaggcugcgugcccgagcccggcgccgccguggccgccagcaagggccugccccagcagcugcccgccccccccgacgaggacgacagcgccgcccccagcacccugagccugcugggccccaccuuccccggccugagcagcugcagcgccgaccugaaggacauccugagcgaggccagcaccaugcagcugcugcagcagcagcagcaggaggccgugagcgagggcagcagcagcggcagagccagagaggccagcggcgcccccaccagcagcaaggacaacuaccugggcggcaccagcaccaucagcgacaacgccaaggagcugugcaaggccgugagcgugagcaugggccugggcguggaggcccuggagcaccugagccccggcgagcagcugagaggcgacugcauguacgccccccugcugggcgugccccccgccgugagacccacccccugcgccccccuggccgagugcaagggcagccugcuggacgacagcgccggcaagagcaccgaggacaccgccgaguacagccccuucaagggcggcuacaccaagggccuggagggcgagagccugggcugcagcggcagcgccgccgccggcagcagcggcacccuggagcugcccagcacccugagccuguacaagagcggcgcccuggacgaggccgccgccuaccagagcagagacuacuacaacuucccccuggcccuggccggccccccccccccccccccccccccccacccccacgccagaaucaagcuggagaacccccuggacuacggcagcgccugggccgccgccgccgcccagugcagauacggcgaccuggccagccugcacggcgccggcgccgccggccccggcagcggcagccccagcgccgccgccagcagcagcuggcacacccuguucaccgccgaggagggccagcuguacggccccugcggcggcggcggcggcggcggcggcggcggcggcggcggcggcggcggcggcggcggcggcggcggcggcgaggccggcgccguggcccccuacggcuacaccagacccccccagggccuggccggccaggagagcgacuucaccgcccccgacgugugguaccccggcggcauggugagcagagugcccuaccccagccccaccugcgugaagagcgagaugggccccuggauggacagcuacagcggccccuacggcgacaugagacuggagaccgccagagaccacgugcugcccaucgacuacuacuuccccccccagaagaccugccugaucugcggcgacgaggccagcggcugccacuacggcgcccugaccugcggcagcugcaagguguucuucaagagagccgccgagggcaagcagaaguaccugugcgccagcagaaacgacugcaccaucgacaaguucagaagaaagaacugccccagcugcagacugagaaagugcuacgaggccggcaugacccugggcgccagaaagcugaagaagcugggcaaccugaagcugcaggaggagggcgaggccagcagcaccaccagccccaccgaggagaccacccagaagcugaccgugagccacaucgagggcuacgagugccagcccaucuuccugaacgugcuggaggccaucgagcccggcguggugugcgccggccacgacaacaaccagcccgacagcuucgccgcccugcugagcagccugaacgagcugggcgagagacagcuggugcacguggugaagugggccaaggcccugcccggcuucagaaaccugcacguggacgaccagauggccgugauccaguacagcuggaugggccugaugguguucgccaugggcuggagaagcuucaccaacgugaacagcagaaugcuguacuucgcccccgaccugguguucaacgaguacagaaugcacaagagcagaauguacagccagugcgugagaaugagacaccugagccaggaguucggcuggcugcagaucaccccccaggaguuccugugcaugaaggcccugcugcuguucagcaucauccccguggacggccugaagaaccagaaguucuucgacgagcugagaaugaacuacaucaaggagcuggacagaaucaucgccugcaagagaaagaaccccaccagcugcagcagaagauucuaccagcugaccaagcugcuggacagcgugcagcccaucgccagagagcugcaccaguucaccuucgaccugcugaucaagagccacauggugagcguggacuuccccgagaugauggccgagaucaucagcgugcaggugcccaagauccugagcggcaaggugaagcccaucuacuuccacacccaguga

SEQ ID NO: 481 - RNA, 2763 nt, Artificial Sequence
  derived and/or modified sequence opt5 from ANDR__Homo_sapiens__EAX05380
auggaggugcagcugggccucgggagagucuacccccggccuccgagcaagaccuaucgcggagccuuccaaaaccuguuucaguccguuagagaagugauccagaaucccggcccucggcaccccgaggcugccucugcggcuccucccggggccagccuucugcuccugcagcaacagcagcagcaacagcagcagcaacagcagcaacagcagcagcaacagcagcagcaacagcaggaaacauccccucgccagcaacagcagcagcaaggagaggacggcucuccgcaggcccauagacgggggcccacgggauaccuugugcuggaugaggaacagcaaccuagccagccccaguccgcucucgagugccacccugaacgcggcuguguccccgagccgggcgccgcuguggccgcgucuaaagggcugccucagcaacugcccgccccucccgacgaagaugacagcgcugcccccuccacccucagccugcuuggaccuacauucccgggccugucuuccugcagcgcugaucucaaggacauucugucugaggccuccaccaugcagcuucugcagcagcaacagcaggaggcgguuagcgaagggucuuccagcggcagagcccgggaggcuuccggagcccccacaucuagcaaagauaacuaucucgggggaaccuccacaaucagcgacaaugcuaaggaacuguguaaagccgugucugucuccaugggccugggcguggaggcccucgaacaucugagcccuggggagcagcuucgcggagauugcauguacgcuccccugcucggcguuccucccgcggugagaccgaccccuugugcuccccuggcugagugcaaggggucucuucuggacgauagcgccggaaaguccacggaagacaccgccgaguauucuccuuuuaaaggcggguacacaaagggacucgaaggcgagagccugggcuguuccgggagcgcugccgcgggaucuuccggcacccuggaacuccccagcacacugucucuuuauaaauccggggcucuggaugaggccgccgcuuaccaaagccgggacuacuauaacuucccucucgcccuggcuggacccccgccucccccucccccgccccacccucaugcccgcauuaaacuugagaauccccuggacuacggcuccgcgugggccgcugccgcugcccagugcagauauggggaucucgcgucucugcacggcgccggagcugccggcccugggagcggaucccccucugcugccgccagcuccagcuggcacacccuguuuacggcugaagagggccagcucuacgggccuuguggaggcgggggcggaggcgggggaggcgggggaggcgggggcggaggcgggggaggcgggggaggcggggaagcgggcgccgucgcucccuauggauacacacggccgccucaaggccuggccgggcaggagucugacuucaccgcccccgaugugugguauccuggaggcauggugucccgcguccccuacccgagcccuacaugcguuaaaucugaaauggggcccuggauggacuccuacagcggaccuuauggcgauaugagacuugagaccgcucgggaccaugugcugcccaucgauuacuauuuucccccucagaagaccugucucauuugcggcgacgaggccucugggugccacuacggagcgcugacauguggcagcugcaagguguucuuuaaaagagcugccgaagggaagcagaaauaucugugugccucccgcaacgauugcacgaucgacaaguuccggagaaagaauuguccgagcugccgccuucggaaguguuacgaggcuggaaugacccucggcgccagaaaacugaagaagcuggggaaccucaaacugcaagaagagggagaggcgucuuccacaaccagccccacagaagagaccacgcagaaacuuacagucucccauaucgaaggcuaugagugccagccuauuuuucugaaugugcucgaagcuaucgagcccggcguugugugugccgggcacgauaacaaucagccugacucuuucgccgcucugcugagcucccuuaacgagcucggagaacgccaacugguccacgugguuaagugggccaaggcucugcccggcuuucggaaucuccauguggacgaucagauggccgucauucaguacucuuggauggggcugaugguguucgcgaugggauggcgcagcuucaccaacgucaauuccagaaugcuuuacuuugccccugaccugguguucaacgaguaucggaugcacaaaucuagaauguacagccagugcguucgcaugcggcaucucucccaagaauuuggcuggcugcagaucaccccgcaggaguuccuguguaugaaggcccuucuccuguuuagcauuauccccguggaugggcugaagaaccagaaauucuuugacgaacucagaaugaauuauauuaaggagcuggaucggaucaucgccugcaaacgcaagaacccuacaucuugcuccagacgguucuaccaacuuaccaaacugcucgacagcguccagcccauugcuagagagcugcaccaguuuacauucgaucugcuuaucaagucucauaugguguccguugacuuuccugaaaugauggccgagauuaucagcgugcaaguccccaagauucucucuggaaaagugaagccgaucuauuuccacacgcaguga

SEQ ID NO: 482 - protein, 412 aa, Artificial Sequence [sequence omitted]

SEQ ID NO: 483 - RNA, 1239 nt, Artificial Sequence
  ART-4__Homo_sapiens__AAH64630
auggcuccaguggagcacguuguggcggaugcuggggcuuuccugcggcaugcggcucugcaggacaucgggaagaacauuuacaccauccgggagguggucacugagauucgggacaaggccacacgcaggcggcucgcuguccugcccuacgagcugcgguucaaggagcccuuaccggaauacgugcggcuggugacugaguuuucaaagaaaacaggagacuaccccagccucucugccacggacauccaagugcuugcacucacauaccaguuggaagcagaguuuguuggggugucucaccuaaaacaagaaccacagaagguuaaggugagcucaucgauucagcacccagaaacaccucugcacauuucugguuuccaucugcccuacaagccuaaacccccacaagaaacagaaaaaggacacucagcuugugagccugagaaccuggaauuuaguuccuucauguucuggagaaacccuuugcccaacaucgaucaugaacugcaggagcugcugauugacagaggugaggacguuccaagugaggaggaggaggaggaagaaaacggguuugaagacagaaaagaugacagcgaugacgacggggguggcuggauaacccccaguaacaucaagcagauccagcaggagcuggagcagugugacguccccgaggacgugcggguuggcugccugaccacagacuucgccaugcagaauguucugcugcagauggggcugcacgugcuggcggugaacggcaugcugauucgugaggcccggagcuacaucuugcgcugccauggcuguuucaagacaacgucugacaugagccgaguguucugcucacacugugggaacaagacccugaagaaaguguccgugaccgucagcgacgacggcacccugcacaugcacuucucccgcaaccccaaggugcugaacccccgcggccuccgguacucgcuucccacucccaaagggggcaaauacgccaucaacccccaucucaccgaggaucagcgcuucccucagcugcgacucucccaaaaggccaggcagaaaaccaacguguucgccccugacuacaucgccggggugucacccuuugucgagaaugacaucuccagccgcucagcuacccugcagguccgggacagcaccuugggagcugggcggagacgcuuaaaucccaacgcuuccagaaagaaguuugugaagaaaagguga

SEQ ID NO: 484 - RNA, 1239 nt, Artificial Sequence
  derived and/or modified sequence opt1 from ART-4__Homo_sapiens__AAH64630
auggcccccguggagcacgucguggccgacgcgggcgccuuccugcgccacgccgcccuccaggacaucgggaagaacaucuacaccauccgggagguggucaccgagauccgcgacaaggccacgcggcgccggcuggcggugcugccguacgagcuccgcuucaaggagccccugcccgaguacgugcggcuggucaccgaguucagcaagaagaccggcgacuaccccucccucagcgccaccgacauccaggugcuggcccugacguaccagcucgaggccgaguucgugggggucucccaccugaagcaggagccgcagaaggugaaggugagcuccagcauccagcaccccgagacgccccugcacaucuccggcuuccaccuccccuacaagccgaagccgccccaggagaccgagaaggggcacagcgcgugcgagcccgagaaccuggaguucuccagcuucauguucuggcgcaacccccugcccaacaucgaccacgagcuccaggagcugcugaucgaccggggcgaggacguccccuccgaggaggaggaggaggaggagaacggcuucgaggaccgcaaggacgacagcgacgacgacgggggcggguggaucacccccuccaacaucaagcagauccagcaggagcucgagcagugcgacgugccggaggacgugcgggucggcugccugaccaccgacuucgccaugcagaacgugcugcuccagauggggcugcacgugcuggccgucaacggcaugcucauccgcgaggcccggagcuacauccugcgcugccacggcugcuucaagaccaccuccgacaugagccggguguucugcucccacugcgggaacaagacgcugaagaaggugagcgucaccguguccgacgacggcacccuccacaugcacuucagccgcaaccccaaggugcugaacccccgggggcugcgcuacagccuccccaccccgaagggcggcaaguacgccaucaacccccaccugacggaggaccagcgguucccccagcugcgccucucccagaaggcgcggcagaagaccaacgucuucgcccccgacuacaucgccggggugagcccguucgucgagaacgacaucuccagccgcuccgccacccuccaggugcgcgacagcacccugggcgccgggcggcgccggcugaaccccaacgcgucccgcaagaaguucgugaagaagcgguga

SEQ ID NO: 485 - RNA, 1239 nt, Artificial Sequence
  derived and/or modified sequence opt2 from ART-4__Homo_sapiens__AAH64630
auggcccccgucgagcacgucgucgccgacgccggcgccuuccuccgccacgccgcccuccaggacaucggcaagaacaucuacaccauccgcgaggucgucaccgagauccgcgacaaggccacccgccgccgccucgccguccuccccuacgagcuccgcuucaaggagccccuccccgaguacguccgccucgucaccgaguucuccaagaagaccggcgacuaccccucccucuccgccaccgacauccagguccucgcccucaccuaccagcucgaggccgaguucgucggcgucucccaccucaagcaggagccccagaaggucaaggucuccuccuccauccagcaccccgagaccccccuccacaucuccggcuuccaccuccccuacaagcccaagcccccccaggagaccgagaagggccacuccgccugcgagcccgagaaccucgaguucuccuccuucauguucuggcgcaacccccuccccaacaucgaccacgagcuccaggagcuccucaucgaccgcggcgaggacguccccuccgaggaggaggaggaggaggagaacggcuucgaggaccgcaaggacgacuccgacgacgacggcggcggcuggaucacccccuccaacaucaagcagauccagcaggagcucgagcagugcgacguccccgaggacguccgcgucggcugccucaccaccgacuucgccaugcagaacguccuccuccagaugggccuccacguccucgccgucaacggcaugcucauccgcgaggcccgcuccuacauccuccgcugccacggcugcuucaagaccaccuccgacaugucccgcgucuucugcucccacugcggcaacaagacccucaagaaggucuccgucaccgucuccgacgacggcacccuccacaugcacuucucccgcaaccccaagguccucaacccccgcggccuccgcuacucccuccccacccccaagggcggcaaguacgccaucaacccccaccucaccgaggaccagcgcuucccccagcuccgccucucccagaaggcccgccagaagaccaacgucuucgcccccgacuacaucgccggcgucucccccuucgucgagaacgacaucuccucccgcuccgccacccuccagguccgcgacuccacccucggcgccggccgccgccgccucaaccccaacgccucccgcaagaaguucgucaagaagcgcuga

SEQ ID NO: 486 - RNA, 1239 nt, Artificial Sequence
  derived and/or modified sequence opt3 from ART-4__Homo_sapiens__AAH64630
auggcccccguggagcacgucguugcugacgcaggcgccuuccugagacaugcggcucuccaggauaucgggaagaacauuuacaccauaagggaagugguaacagagauccgggacaaagccacucgccgacgucuugcagugcugccuuaugaauugagauuuaaggagccauuaccggaauacgucaggcuggugacggaguucagcaaaaagaccggagauuaucccucccuaucugccacagacauucaaguucucgcucugacuuaccagcuugaggcagaauuugugggugucucacaccugaaacaggagccucagaaggugaagguaaguagcuccauccaacauccagaaacccccuugcacauuucuggcuuccaucucccuuauaaaccaaagcccccucaggagacagagaaagggcacucggccugcgaaccagagaaucuggaauuuagcucauucauguuuuggcggaacccgcugcccaauaucgaucacgagcuccaggaauuacugauagaccgcggagaggauguuccuagugaggaagaggaagaggaagagaacggcuucgaggacagaaaggaugacuccgaugacgauggugggggauggaucaccccaucuaauauuaaacagauccaacaggaacuugagcagugugacgugcccgaagacgucagggugggcugcuugacuacagauuuugcuaugcagaacgugcugcuacaaaugggccuccauguccuggccguuaaugggaugcuuauucgggaggcgcgcagcuacauccugcgaugucacggaugcuucaagaccacguccgacaugucaagaguguuuuguagucauugcgguaacaagacuuugaaaaagguaagcgugaccgucucugaugacggcacacuccacaugcacuucuccaggaauccuaaagugcugaacccacggggguuacguuauucacugcccacuccgaagggaggcaaauacgcaauaaauccucaucucaccgaagaucagcgcuuuccccagcuuagacugagccaaaaggccaggcagaaaacaaacguuuucgcuccagacuacauugccggugugaguccuuucgucgagaaugauaucucuucccggagcgcaaccuugcagguacgagacucgacgcuaggggcuggacgcagaaggcugaaccccaaugccucucggaagaaguuugugaaaaagcgcuga

SEQ ID NO: 487 - RNA, 1239 nt, Artificial Sequence
  derived and/or modified sequence opt4 from ART-4__Homo_sapiens__AAH64630
auggcccccguggagcacgugguggccgacgccggcgccuuccugagacacgccgcccugcaggacaucggcaagaacaucuacaccaucagagagguggugaccgagaucagagacaaggccaccagaagaagacuggccgugcugcccuacgagcugagauucaaggagccccugcccgaguacgugagacuggugaccgaguucagcaagaagaccggcgacuaccccagccugagcgccaccgacauccaggugcuggcccugaccuaccagcuggaggccgaguucgugggcgugagccaccugaagcaggagccccagaaggugaaggugagcagcagcauccagcaccccgagaccccccugcacaucagcggcuuccaccugcccuacaagcccaagcccccccaggagaccgagaagggccacagcgccugcgagcccgagaaccuggaguucagcagcuucauguucuggagaaacccccugcccaacaucgaccacgagcugcaggagcugcugaucgacagaggcgaggacgugcccagcgaggaggaggaggaggaggagaacggcuucgaggacagaaaggacgacagcgacgacgacggcggcggcuggaucacccccagcaacaucaagcagauccagcaggagcuggagcagugcgacgugcccgaggacgugagagugggcugccugaccaccgacuucgccaugcagaacgugcugcugcagaugggccugcacgugcuggccgugaacggcaugcugaucagagaggccagaagcuacauccugagaugccacggcugcuucaagaccaccagcgacaugagcagaguguucugcagccacugcggcaacaagacccugaagaaggugagcgugaccgugagcgacgacggcacccugcacaugcacuucagcagaaaccccaaggugcugaaccccagaggccugagauacagccugcccacccccaagggcggcaaguacgccaucaacccccaccugaccgaggaccagagauucccccagcugagacugagccagaaggccagacagaagaccaacguguucgcccccgacuacaucgccggcgugagccccuucguggagaacgacaucagcagcagaagcgccacccugcaggugagagacagcacccugggcgccggcagaagaagacugaaccccaacgccagcagaaagaaguucgugaagaagagauga

SEQ ID NO: 488 - RNA, 1239 nt, Artificial Sequence
  derived and/or modified sequence opt5 from ART-4__Homo_sapiens__AAH64630
auggcccccguggagcacgucguugcugacgccggcgcguuccugagacaugcugcccuccaggauaucgggaagaacauuuacaccauccgggaaguggugacagagauucgcgacaaagccacgagacggcgccuggcuguccuuccuuaugaacugagauuuaaggagccgcuccccgaauacgugcggcugguuaccgaguucagcaaaaagacaggagauuauccuucccuuucugccaccgacauccaagugcuggcucucacauaccagcuggaggccgaauuugucggcgugagccaccugaaacaggagccccagaagguuaagguguccucuagcauucaacauccugaaacaccccuccacaucuccggguuccaucugccuuauaaaccgaagcccccucaggagaccgagaaaggacacucugcgugcgaacccgagaaucuugaauuuagcuccuucauguuuuggcgcaacccucugcccaauaucgaucacgagcuccaggaacugcuuauugacagaggcgaggaugucccgagcgaggaagaggaagaggaagagaacggguucgaggaccggaaggaugacucugaugacgauggaggcggcuggaucaccccuuccaauauuaaacagauccaacaggaacuggagcagugugacgugcccgaagacgugcgcgucgggugccucacgaccgauuuugccaugcagaacguucugcugcaaaugggacuccaugugcuggcugugaauggcaugcuuauuagagaggcccggagcuacauccugcgcugucacgggugcuucaagacaaccucugacauguccagagucuuuuguagccauugcggaaacaagacacucaaaaaggugucuguuaccguguccgaugacggcacgcugcacaugcacuucagccggaauccuaaaguccuuaacccccgcgggcugagauauucccuccccacaccuaagggaggcaaauacgcuauuaauccgcaucugaccgaagaucagcgguuuccccagcugagacucucucaaaaggcccgccagaaaacaaacguguucgcgccugacuacaucgccggcguuagccccuucguggagaaugauaucuccagccggucugcuacccugcaggucagagacuccacccuuggggccggacgccggagacugaacccuaaugcuagccgcaagaaguuugugaaaaagcgguga

SEQ ID NO: 489 - protein, 327 aa, Artificial Sequence
  ARTC1/m__Homo_sapiens__P52961
MQMPAMMSLLLVSVGLMEALQAQSHPITRRDLFSQEIQLDMALASFDDQYAGCAAAMTAALPDLNHTEFQANQVYADSWTLASSQWQERQARWPEWSLSPTRPSPPPLGFRDEHGVALLAYTANSPLHKEFNAAVREAGRSRAHYLHHFSFKTLHFLLTEALQLLGSGQRPPRCHQVFRGVHGLRFRPAGPRATVRLGGFASASLKHVAAQQFGEDTFFGIWTCLGAPIKGYSFFPGEEEVLIPPFETFQVINASRLAQGPARIYLRALGKHSTYNCEYIKDKKCKSGPCHLDNSAMGQSPLSAVWSLLLLLWFLVVRAFPDGPGLL

SEQ ID NO: 490 - RNA, 984 nt, Artificial Sequence
  ARTC1/m__Homo_sapiens__AAH69102
augcagaugccugcuaugaugucucugcuucuugugucugugggccucauggaagcacuucaggcccagagccaccccaucacacgacgagaccucuucucucaagagauucagcuggacauggcccuggccuccuuugaugaccaguacgcuggcugugcugcugccaugacagcugcucucccggaucucaaccacacggaguuccaggccaaccagguguaugcagacagcuggacacuggcaagcagccaauggcaggagcgucaggccagguggccagaguggagucucagccccacccguccauccccgccaccccugggcuuccgcgaugagcaugggguggcccuccuggccuacacagccaacagcccccugcacaaggaguucaaugcagccgugcgugaggcgggccgcucccgggcccacuaccuccaccacuucuccuucaagacacuccauuuccugcugacugaggcccugcagcuccugggcagcggccagcguccaccccggugccaccagguguuccgaggugugcacggccugcgcuuccggccagcagggccccgggccaccgugaggcuggggggcuuugcuucugccucccugaagcauguugcagcccagcaguuuggugaggacaccuucuucggcaucuggaccugccuuggggccccuaucaagggcuacuccuucuucccuggagaggaagaggugcugaucccccccuuugagaccuuccaagugaucaaugccagcagacuggcccagggccccgcccgcaucuaccuccgagcccugggcaagcacagcaccuacaacugcgaguacaucaaagacaagaagugcaagucugggccuugccaucuggauaauucagccaugggucagagcccccucucugcagucuggucuuugcugcugcugcucugguuccucguggugagggccuuuccagaugguccaggccuccuuuga

SEQ ID NO: 491 - RNA, 984 nt, Artificial Sequence
  derived and/or modified sequence opt1 from ARTC1/m__Homo_sapiens__AAH69102
augcagaugcccgccaugaugagccugcuccugguguccgucggccugauggaggcccuccaggcgcagagccaccccaucacccgccgggaccuguucucccaggagauccagcuggacauggcccucgccagcuucgacgaccaguacgccgggugcgccgcggccaugaccgccgcccugcccgaccugaaccacacggaguuccaggcgaaccagguguacgccgacuccuggacccucgccagcucccaguggcaggagcgccaggcccgguggcccgaguggagccugucccccacccgcccguccccgccgccccugggcuuccgggacgagcacgggguggcccuccuggcguacaccgccaacagcccccugcacaaggaguucaacgccgccguccgcgaggccggccggagccgcgcgcacuaccuccaccacuucuccuucaagacgcugcacuuccugcucaccgaggcccugcagcugcucgggagcggccagcggccgccccgcugccaccagguguuccggggcgugcacgggcugcgcuuccggcccgccggcccccgcgccaccguccggcucgggggcuucgccuccgcgagccugaagcacguggccgcccagcaguucggggaggacaccuucuucggcaucuggacgugccugggcgcccccaucaagggguacuccuucuuccccggcgaggaggaggugcugaucccgcccuucgagaccuuccaggucaucaacgccagccgccucgcgcaggggcccgcccggaucuaccugcgcgcccugggcaagcacuccaccuacaacugcgaguacaucaaggacaagaagugcaagagcggccccugccaccucgacaacagcgccauggggcaguccccgcugagcgcgguguggucccugcuccugcugcucugguuccuggugguccgggccuuccccgacggccccgggcugcucuga

SEQ ID NO: 492 - RNA, 984 nt, Artificial Sequence
  derived and/or modified sequence opt2 from ARTC1/m__Homo_sapiens__AAH69102
augcagaugcccgccaugaugucccuccuccucgucuccgucggccucauggaggcccuccaggcccagucccaccccaucacccgccgcgaccucuucucccaggagauccagcucgacauggcccucgccuccuucgacgaccaguacgccggcugcgccgccgccaugaccgccgcccuccccgaccucaaccacaccgaguuccaggccaaccaggucuacgccgacuccuggacccucgccuccucccaguggcaggagcgccaggcccgcuggcccgaguggucccucucccccacccgccccuccccccccccccucggcuuccgcgacgagcacggcgucgcccuccucgccuacaccgccaacuccccccuccacaaggaguucaacgccgccguccgcgaggccggccgcucccgcgcccacuaccuccaccacuucuccuucaagacccuccacuuccuccucaccgaggcccuccagcuccucggcuccggccagcgccccccccgcugccaccaggucuuccgcggcguccacggccuccgcuuccgccccgccggcccccgcgccaccguccgccucggcggcuucgccuccgccucccucaagcacgucgccgcccagcaguucggcgaggacaccuucuucggcaucuggaccugccucggcgcccccaucaagggcuacuccuucuuccccggcgaggaggagguccucaucccccccuucgagaccuuccaggucaucaacgccucccgccucgcccagggccccgcccgcaucuaccuccgcgcccucggcaagcacuccaccuacaacugcgaguacaucaaggacaagaagugcaaguccggccccugccaccucgacaacuccgccaugggccaguccccccucuccgccgucuggucccuccuccuccuccucugguuccucgucguccgcgccuuccccgacggccccggccuccucuga

SEQ ID NO: 493 - RNA, 984 nt, Artificial Sequence
  derived and/or modified sequence opt3 from ARTC1/m__Homo_sapiens__AAH69102
augcagaugcccgccaugaugagccugcuccuuguguccgucggccugauggaggcuuugcaagcacagucucacccuaucaccagaagggacuuauucucacaggaaauucagcuggauauggcccuagcgaguuuugacgaucaauacgcugggugcgccgcagccaugacagcugcacucccagaccugaaccauacugaguuccaggccaaucagguuuaugcugauagcuggacgcuugccuccucucaguggcaagaacggcaggcgcgcuggccggaguggucgcugucacccacccgaccuagcccacccccuuugggauuucgugacgaacacgguguggcacuccuggccuacacagcuaacaguccacugcauaaggaguucaaugccgcaguaagagaggcuggcaggucccgggcccacuaucuccaucacuuuucuuucaaaacuuuacacuuucugcuuaccgaagcguugcagcugcuagggagcggacagagacccccucgcugucaucaaguguucaggggcguccacggucuccgguuucgcccagccgggccgcgagcaacagugagacugggaggcuucgcuuccgccucacuuaagcauguugcugcccagcaguuuggcgaggauaccuucuuugggauauggacuugccugggagcacccaucaaagguuacaguuucuucccuggcgaagaggagguguugauuccacccuuugaaacauuccaagucaucaacgccagcaggcucgcucaggggccugcgcggauuuaucugcgugcauuaggaaagcacucuaccuacaauugugaguauaucaaagacaagaagugcaaauccggcccaugucaccuggauaacucagccaugggucagagcccccucagugcuguguggucucuucuguugcuacugugguuucucguaguucgcgccuucccggacgggccuggacugcuuuga

SEQ ID NO: 494 - RNA, 984 nt, Artificial Sequence
  derived and/or modified sequence opt4 from ARTC1/m__Homo_sapiens__AAH69102
augcagaugcccgccaugaugagccugcugcuggugagcgugggccugauggaggcccugcaggcccagagccaccccaucaccagaagagaccuguucagccaggagauccagcuggacauggcccuggccagcuucgacgaccaguacgccggcugcgccgccgccaugaccgccgcccugcccgaccugaaccacaccgaguuccaggccaaccagguguacgccgacagcuggacccuggccagcagccaguggcaggagagacaggccagauggcccgaguggagccugagccccaccagacccagcccccccccccugggcuucagagacgagcacggcguggcccugcuggccuacaccgccaacagcccccugcacaaggaguucaacgccgccgugagagaggccggcagaagcagagcccacuaccugcaccacuucagcuucaagacccugcacuuccugcugaccgaggcccugcagcugcugggcagcggccagagaccccccagaugccaccagguguucagaggcgugcacggccugagauucagacccgccggccccagagccaccgugagacugggcggcuucgccagcgccagccugaagcacguggccgcccagcaguucggcgaggacaccuucuucggcaucuggaccugccugggcgcccccaucaagggcuacagcuucuuccccggcgaggaggaggugcugaucccccccuucgagaccuuccaggugaucaacgccagcagacuggcccagggccccgccagaaucuaccugagagcccugggcaagcacagcaccuacaacugcgaguacaucaaggacaagaagugcaagagcggccccugccaccuggacaacagcgccaugggccagagcccccugagcgccguguggagccugcugcugcugcugugguuccugguggugagagccuuccccgacggccccggccugcuguga

SEQ ID NO: 495 - RNA, 984 nt, Artificial Sequence
  derived and/or modified sequence opt5 from ARTC1/m__Homo_sapiens__AAH69102
augcagaugcccgccaugaugagccugcuccugguguccgucggccuuauggaggcucugcaagcccagucucacccuaucaccagacgggaccucuucagccaggaaauucagcuggauauggcgcuugcuuccuuugacgaucaauacgccgggugcgccgcugccaugacagcugcccugccggaccucaaccauacggaguuccaggcgaaucagguuuaugccgauucuuggacccuggcuagcucccaguggcaagaacgccaggccagauggcccgaguggucucugagcccuacacggcccuccccucccccucucggauuucgcgacgaacacggcguggcucugcuugccuacaccgcgaacagcccgcugcauaaggaguucaaugccgcugugagagaggccgggcggucucgcgcucacuaucuccaucacuuuuccuucaaaacacugcacuuucuucugaccgaagcccuccagcugcugggaagcggccagagacccccucggugucaucaagucuuccgcggggugcacggacucagauuucggcccgccggcccucgcgcuacaguuagacugggcggguucgcgucugccucccuuaagcauguggcugcccagcaguuuggagaggauaccuucuuuggcaucuggacgugccugggggcccccauuaaaggauacagcuucuucccgggcgaagaggagguccucaucccucccuuugaaaccuuccaagugauuaacgcuucucggcuggcccaggggccugcgcgcaucuaucuuagagcucugggaaagcacuccacauacaauugugaguauaucaaagacaagaagugcaaaagcggccccugucaccucgauaacuccgccaugggccagucuccccugagcgccguuuggucccugcuccugcuucugugguuucucgugguccgggcuuucccugacgggccgggacugcuuuga

SEQ ID NO: 496 - protein, 344 aa, Artificial Sequence
  AURKB__Homo_sapiens__Q96GD4
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 497 - RNA, 1035 nt, Artificial Sequence
  AURKB__Homo_sapiens__AAH09751
auggcccagaaggagaacuccuaccccuggcccuacggccgacagacggcuccaucuggccugagcacccugccccagcgaguccuccggaaagagccugucaccccaucugcacuuguccucaugagccgcuccaauguccagcccacagcugccccuggccagaaggugauggagaauagcagugggacacccgacaucuuaacgcggcacuucacaauugaugacuuugagauugggcguccucugggcaaaggcaaguuuggaaacguguacuuggcucgggagaagaaaagccauuucaucguggcgcucaagguccucuucaagucccagauagagaaggagggcguggagcaucagcugcgcagagagaucgaaauccaggcccaccugcaccaucccaacauccugcgucucuacaacuauuuuuaugaccggaggaggaucuacuugauucuagaguaugccccccgcggggagcucuacaaggagcugcagaagagcugcacauuugacgagcagcgaacagccacgaucauggaggaguuggcagaugcucuaauguacugccaugggaagaaggugauucacagagacauaaagccagaaaaucugcucuuagggcucaagggagagcugaagauugcugacuucggcuggucugugcaugcgcccucccugaggaggaagacaauguguggcacccuggacuaccugcccccagagaugauugaggggcgcaugcacaaugagaagguggaucuguggugcauuggagugcuuugcuaugagcugcugguggggaacccacccuuugagagugcaucacacaacgagaccuaucgccgcaucgucaagguggaccuaaaguuccccgcuuccgugcccaugggagcccaggaccucaucuccaaacugcucaggcauaaccccucggaacggcugccccuggcccaggucucagcccacccuuggguccgggccaacucucggagggugcugccucccucugcccuucaaucugucgccuga

SEQ ID NO: 498 - RNA, 1035 nt, Artificial Sequence
  derived and/or modified sequence opt1 from AURKB__Homo_sapiens__AAH09751
auggcccagaaggagaacagcuaccccuggcccuacggccgccagaccgcccccuccgggcugagcacccucccccagcgggugcugcgcaaggagcccgucacgccguccgcgcuggugcucaugagccgguccaacgugcagcccaccgccgcccccggccagaaggucauggagaacagcuccgggacccccgacauccugacccgccacuucacgaucgacgacuucgagaucggccggccgcuggggaagggcaaguucggcaacguguaccucgcccgcgagaagaagucccacuucaucguggcccugaagguccuguucaagagccagaucgagaaggaggggguggagcaccagcuccggcgcgagaucgagauccaggcgcaccuccaccaccccaacauccugcggcuguacaacuacuucuacgaccgccggcgcaucuaccugauccuggaguacgcgccccggggcgagcucuacaaggagcugcagaaguccugcaccuucgacgagcagcgcaccgccaccaucauggaggagcuggccgacgcccucauguacugccacgggaagaaggugauccaccgggacaucaagcccgagaaccugcugcucggccugaagggggagcugaagaucgccgacuucggcuggagcguccacgccccgagccuccgccggaagacgaugugcggcacccuggacuaccugccgcccgagaugaucgaggggcgcaugcacaacgagaagguggaccucuggugcaucggcgugcugugcuacgagcugcucgucgggaacccgcccuucgaguccgccagccacaacgagaccuaccggcgcaucgugaagguggaccugaaguuccccgccuccguccccaugggcgcgcaggaccugaucagcaagcuccugcggcacaaccccuccgagcgccugccccucgcccaggugagcgcccaccccugggugcgcgccaacucccggcgcguccugccgcccagcgcccugcagagcguggcguga

SEQ ID NO: 499 - RNA, 1035 nt, Artificial Sequence
  derived and/or modified sequence opt2 from AURKB__Homo_sapiens__AAH09751
auggcccagaaggagaacuccuaccccuggcccuacggccgccagaccgcccccuccggccucuccacccucccccagcgcguccuccgcaaggagcccgucacccccuccgcccucguccucaugucccgcuccaacguccagcccaccgccgcccccggccagaaggucauggagaacuccuccggcacccccgacauccucacccgccacuucaccaucgacgacuucgagaucggccgcccccucggcaagggcaaguucggcaacgucuaccucgcccgcgagaagaagucccacuucaucgucgcccucaagguccucuucaagucccagaucgagaaggagggcgucgagcaccagcuccgccgcgagaucgagauccaggcccaccuccaccaccccaacauccuccgccucuacaacuacuucuacgaccgccgccgcaucuaccucauccucgaguacgccccccgcggcgagcucuacaaggagcuccagaaguccugcaccuucgacgagcagcgcaccgccaccaucauggaggagcucgccgacgcccucauguacugccacggcaagaaggucauccaccgcgacaucaagcccgagaaccuccuccucggccucaagggcgagcucaagaucgccgacuucggcugguccguccacgcccccucccuccgccgcaagaccaugugcggcacccucgacuaccucccccccgagaugaucgagggccgcaugcacaacgagaaggucgaccucuggugcaucggcguccucugcuacgagcuccucgucggcaacccccccuucgaguccgccucccacaacgagaccuaccgccgcaucgucaaggucgaccucaaguuccccgccuccguccccaugggcgcccaggaccucaucuccaagcuccuccgccacaaccccuccgagcgccucccccucgcccaggucuccgcccaccccuggguccgcgccaacucccgccgcguccucccccccuccgcccuccaguccgucgccuga

SEQ ID NO: 500 - RNA, 1035 nt, Artificial Sequence
  derived and/or modified sequence opt3 from AURKB__Homo_sapiens__AAH09751
auggcccagaaggagaacagcuaccccuggccuuauggcagacaaaccgcuccauccgggcugucuacacucccgcagagggugcuucggaaagaacccgucacuccuucagcacugguuuugaugagucgcagcaaugugcagccaacggccgcgcccggacagaagguaauggagaacuccucugguaccccugacaucuuaacacgacacuucacuauugaugacuuugaaauaggccguccacuggggaaaggaaaguucggcaauguguaccuagcuagagagaaaaagucgcauuuuaucgucgcccucaaggugcuguucaaaucacaaauugaaaaggaggguguugagcaccagcuuaggcgggaaaucgagauucaggcacaucugcaccaucccaacaucuugcgccucuauaauuacuuuuaugauagaaggcggauauaccugauccuggaauaugccccucgcggggagcucuacaaagaguuacagaaaagcugcaccuucgacgaacaacgaacagcuaccauuauggaggaacuggcagaugcccuuauguacugucacggaaagaaggugauccacagagacauuaagccagagaacuugcugcuaggccucaaaggcgaacugaagaucgcugauuuuggguggaguguccaugccccgucccuuaggcggaaaacuaugugcggaacacuggacuauuugcccccugagaugauagagggucguaugcacaaugaaaagguggaucucugguguauuggcguacugugcuacgaguuacugguugggaacccacccuucgaaucugcgagccauaaugagaccuaucgcagaaucgugaaagucgaccucaaguuuccugcauccgugccaaugggagcccaggaucuuauuucaaaacuguugaggcacaaccccagugaacggcuaccgcuggcucaggugagcgcccacccuuggguccgagcaaauucucgcagaguucugcccccauccgcucuccagucaguggccuga

SEQ ID NO: 501 - RNA, 1035 nt, Artificial Sequence
  derived and/or modified sequence opt4 from AURKB__Homo_sapiens__AAH09751
auggcccagaaggagaacagcuaccccuggcccuacggcagacagaccgcccccagcggccugagcacccugccccagagagugcugagaaaggagcccgugacccccagcgcccuggugcugaugagcagaagcaacgugcagcccaccgccgcccccggccagaaggugauggagaacagcagcggcacccccgacauccugaccagacacuucaccaucgacgacuucgagaucggcagaccccugggcaagggcaaguucggcaacguguaccuggccagagagaagaagagccacuucaucguggcccugaaggugcuguucaagagccagaucgagaaggagggcguggagcaccagcugagaagagagaucgagauccaggcccaccugcaccaccccaacauccugagacuguacaacuacuucuacgacagaagaagaaucuaccugauccuggaguacgcccccagaggcgagcuguacaaggagcugcagaagagcugcaccuucgacgagcagagaaccgccaccaucauggaggagcuggccgacgcccugauguacugccacggcaagaaggugauccacagagacaucaagcccgagaaccugcugcugggccugaagggcgagcugaagaucgccgacuucggcuggagcgugcacgcccccagccugagaagaaagaccaugugcggcacccuggacuaccugccccccgagaugaucgagggcagaaugcacaacgagaagguggaccuguggugcaucggcgugcugugcuacgagcugcuggugggcaacccccccuucgagagcgccagccacaacgagaccuacagaagaaucgugaagguggaccugaaguuccccgccagcgugcccaugggcgcccaggaccugaucagcaagcugcugagacacaaccccagcgagagacugccccuggcccaggugagcgcccaccccugggugagagccaacagcagaagagugcugccccccagcgcccugcagagcguggccuga

SEQ ID NO: 502 - RNA, 1035 nt, Artificial Sequence
  derived and/or modified sequence opt5 from AURKB__Homo_sapiens__AAH09751
auggcccagaaggagaacagcuaccccuggccuuauggcagacaaaccgcuccguccgggcugucuacacucccccagcgggugcugcgcaaagaaccugucacgcccagcgcccuuguucugauguccagaucuaaugugcagccuaccgcggcucccggacagaaggugauggagaacagcuccggcacaccugacauccucacccggcacuucacaauugaugacuuugaaaucgggcgcccgcugggaaaaggcaaguucgggaaugucuaccuugccagagagaaaaagucucauuuuauuguggcccugaagguucucuucaaaagccaaaucgaaaaggagggaguggagcaccagcugcggcgcgaaauugagauccaggcucaucugcaccaucccaacauccucagacuguauaauuacuuuuaugaucggcgcagaauuuaccuuauccuggaauaugccccucggggcgagcucuacaaagagcugcagaaguccugcaccuucgacgaacaacgcacagcuaccauuauggaggaacuugccgaugcgcugauguacugucacggcaaaaaggucauccacagagacauuaagcccgagaaccuccugcuggggcucaaaggagaacugaagaucgccgauuuuggcuggagcgugcaugcuccuucucuucggcgcaaaacgaugugcgggacccuggacuaucugcccccggagaugauugagggaagaaugcacaaugaaaagguugaucucugguguaucggcgugcuuugcuacgagcugcucgucgggaacccucccuucgaauccgccagccauaaugagacauaucggagaaucgugaaaguggaccugaaguuuccugcuucuguccccaugggagcccaggaucugauuuccaaacuccugcgccacaaccccagcgaacggcuuccucuggcgcagguuucugcccacccgugggugagagcuaauucccgccgggugcugcccccuagcgcccuccaguccgucgcuuga

SEQ ID NO: 503 - protein, 119 aa, Artificial Sequence
  B2MG__Homo_sapiens__P61769
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 504 - RNA, 360 nt, Artificial Sequence
  B2MG__Homo_sapiens__AAD48083
augucucgcuccguggccuuagcugugcucgcgcuacucucucuuucuggccuggaggcuauccagcguacuccaaagauucagguuuacucacgucauccagcagagaauggaaagucaaauuuccugaauugcuaugugucuggguuucauccauccgacauugaaguugacuuacugaagaauggagagagaauugaaaaaguggagcauucagacuugucuuucagcaaggacuggucuuucuaucucuuguacuacacugaauucacccccacugaaaaagaugaguaugccugccgugugaaccaugugacuuugucacagcccaagauaguuaagugggaucgagacauguaa

SEQ ID NO: 505 - RNA, 360 nt, Artificial Sequence
  derived and/or modified sequence opt1 from B2MG__Homo_sapiens__AAD48083
augagccgcuccguggcccuggccguccucgcgcugcugagccucuccggccuggaggccauccagcggacccccaagauccagguguacagccgccacccggccgagaacgggaaguccaacuuccugaacugcuacgugagcggcuuccaccccuccgacaucgaggucgaccuccugaagaacggggagcggaucgagaagguggagcacagcgaccuguccuucagcaaggacugguccuucuaccuccuguacuacaccgaguucacgcccaccgagaaggacgaguacgccugccgcgugaaccacgucacccugagccagcccaagaucgugaagugggaccgggacauguga

SEQ ID NO: 506 - RNA, 360 nt, Artificial Sequence
  derived and/or modified sequence opt2 from B2MG__Homo_sapiens__AAD48083
augucccgcuccgucgcccucgccguccucgcccuccucucccucuccggccucgaggccauccagcgcacccccaagauccaggucuacucccgccaccccgccgagaacggcaaguccaacuuccucaacugcuacgucuccggcuuccaccccuccgacaucgaggucgaccuccucaagaacggcgagcgcaucgagaaggucgagcacuccgaccucuccuucuccaaggacugguccuucuaccuccucuacuacaccgaguucacccccaccgagaaggacgaguacgccugccgcgucaaccacgucacccucucccagcccaagaucgucaagugggaccgcgacauguga

SEQ ID NO: 507 - RNA, 360 nt, Artificial Sequence
  derived and/or modified sequence opt3 from B2MG__Homo_sapiens__AAD48083
augagcagauccguggcccuggcuguccucgcacuucugucuuugucaggcuuagaggccauccagaggacccccaagauucaaguuuacagucggcacccugcggaaaacgggaaaagcaauuuccugaacugcuauguguccggauuucauccaucugacauagagguagaucuacucaagaauggugaacgcaucgagaaaguggaacacucggaccugucauucagcaaggauuggaguuuuuaccuucuguauuacacagaguucacuccgacggagaaagacgaauaugcuugucgagucaaccaugugaccuugucccagcccaagauuguuaagugggaucgugacauguga

SEQ ID NO: 508 - RNA, 360 nt, Artificial Sequence
  derived and/or modified sequence opt4 from B2MG__Homo_sapiens__AAD48083
augagcagaagcguggcccuggccgugcuggcccugcugagccugagcggccuggaggccauccagagaacccccaagauccagguguacagcagacaccccgccgagaacggcaagagcaacuuccugaacugcuacgugagcggcuuccaccccagcgacaucgagguggaccugcugaagaacggcgagagaaucgagaagguggagcacagcgaccugagcuucagcaaggacuggagcuucuaccugcuguacuacaccgaguucacccccaccgagaaggacgaguacgccugcagagugaaccacgugacccugagccagcccaagaucgugaagugggacagagacauguga

SEQ ID NO: 509 - RNA, 360 nt, Artificial Sequence
  derived and/or modified sequence opt5 from B2MG__Homo_sapiens__AAD48083
augagcagauccguggcccuggcuguccucgcccugcuuucucugagcggccucgaggcgauccagcggacccccaagauucaaguuuacucccgccacccugcugaaaacgggaaaucuaauuuccugaacugcuaugugagcggauuucauccguccgacaucgagguggaucuucugaagaauggcgaaagaauugagaaagucgaacacucugaccucagcuucuccaaggauuggagcuuuuaccugcuguauuacacagaguucacgcccaccgagaaagacgaauaugccugucgggugaaccauguuacacucucucagccuaagaucgugaagugggaucgcgacauguga

SEQ ID NO: 510 - protein, 378 aa, Artificial Sequence
  B3GN5__Homo_sapiens__Q9BYG0
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 511 - RNA, 1137 nt, Artificial Sequence
  B3GN5__Homo_sapiens__AAH28058
augagaauguugguuaguggcagaagagucaaaaaauggcaguuaauuauucaguuauuugcuacuuguuuuuuagcgagccucauguuuuuuugggaaccaaucgauaaucacauugugagccauaugaagucauauucuuacagauaccucauaaauagcuaugacuuugugaaugauacccugucucuuaagcacaccucagcggggccucgcuaccaauacuugauuaaccacaaggaaaagugucaagcucaagacguccuccuuuuacuguuuguaaaaacugcuccugaaaacuaugaucgacguuccggaauuagaaggacguggggcaaugaaaauuauguucggucucagcugaaugccaacaucaaaacucuguuugccuuaggaacuccuaauccacuggagggagaagaacuacaaagaaaacuggcuugggaagaucaaagguacaaugauauaauucagcaagacuuuguugauucuuucuacaaucuuacucugaaauuacuuaugcaguucaguugggcaaauaccuauuguccacaugccaaauuucuuaugacugcugaugaugacauauuuauucacaugccaaaucugauugaguaccuucaaaguuuagaacaaauugguguucaagacuuuuggauuggucguguucaucguggugccccucccauuagagauaaaagcagcaaauacuacguguccuaugaaauguaccaguggccagcuuacccugacuacacagccggagcugccuauguaaucuccggugauguagcugccaaagucuaugaggcaucacagacacuaaauucaagucuuuacauagacgauguguucaugggccucugugccaauaaaauagggauaguaccgcaggaccauguguuuuuuucuggagaggguaaaacuccuuaucaucccugcaucuaugaaaaaaugaugacaucucauggacacuuagaagaucuccaggaccuuuggaagaaugcuacagauccuaaaguaaaaaccauuuccaaagguuuuuuuggucaaauauacugcagauuaaugaagauaauucuccuuuguaaaauuagcuauguggacacauacccuuguagggcugcguuuaucuaa

SEQ ID NO: 512 - RNA, 1137 nt, Artificial Sequence
  derived and/or modified sequence opt1 from B3GN5__Homo_sapiens__AAH28058
augcgcaugcuggugagcggccggcgcgucaagaaguggcagcucaucauccagcuguucgcgaccugcuuccuggccucccucauguucuucugggagcccaucgacaaccacaucgugagccacaugaaguccuacagcuaccgguaccugaucaacuccuacgacuucgugaacgacacccugagccucaagcacacguccgccgggccgcgcuaccaguaccugaucaaccacaaggagaagugccaggcccaggacguccugcuccugcuguucgugaagaccgcccccgagaacuacgaccggcgcagcggcauccggcgcaccugggggaacgagaacuacgugcggucccagcucaacgccaacaucaagacccuguucgcccugggcacgcccaacccccucgagggggaggagcugcagcgcaagcuggcgugggaggaccagcgguacaacgacaucauccagcaggacuucgucgacagcuucuacaaccucacccugaagcugcucaugcaguucuccugggccaacaccuacugcccgcacgccaaguuccugaugaccgccgacgacgacaucuucauccacaugcccaaccugaucgaguaccuccagagccuggagcagaucggcgugcaggacuucuggaucggccgcgugcaccgcggggcgccgcccauccgggacaaguccagcaaguacuacgucuccuacgagauguaccaguggcccgccuaccccgacuacacggccggcgccgccuacgugaucagcggggacguggcggccaaggucuacgaggccucccagacccugaacagcucccucuacaucgacgacguguucaugggccugugcgccaacaagaucgggaucgugccccaggaccacgucuucuucagcggcgagggcaagacccccuaccacccgugcaucuacgagaagaugaugaccagccacgggcaccuggaggaccuccaggaccuguggaagaacgccacggaccccaaggugaagaccaucuccaagggcuucuucgggcagaucuacugccggcugaugaagaucauccuccugugcaagaucagcuacguggacaccuaccccugccgcgcggccuucaucuga

SEQ ID NO: 513 - RNA, 1137 nt, Artificial Sequence
  derived and/or modified sequence opt2 from B3GN5__Homo_sapiens__AAH28058
augcgcaugcucgucuccggccgccgcgucaagaaguggcagcucaucauccagcucuucgccaccugcuuccucgccucccucauguucuucugggagcccaucgacaaccacaucgucucccacaugaaguccuacuccuaccgcuaccucaucaacuccuacgacuucgucaacgacacccucucccucaagcacaccuccgccggcccccgcuaccaguaccucaucaaccacaaggagaagugccaggcccaggacguccuccuccuccucuucgucaagaccgcccccgagaacuacgaccgccgcuccggcauccgccgcaccuggggcaacgagaacuacguccgcucccagcucaacgccaacaucaagacccucuucgcccucggcacccccaacccccucgagggcgaggagcuccagcgcaagcucgccugggaggaccagcgcuacaacgacaucauccagcaggacuucgucgacuccuucuacaaccucacccucaagcuccucaugcaguucuccugggccaacaccuacugcccccacgccaaguuccucaugaccgccgacgacgacaucuucauccacaugcccaaccucaucgaguaccuccagucccucgagcagaucggcguccaggacuucuggaucggccgcguccaccgcggcgccccccccauccgcgacaaguccuccaaguacuacgucuccuacgagauguaccaguggcccgccuaccccgacuacaccgccggcgccgccuacgucaucuccggcgacgucgccgccaaggucuacgaggccucccagacccucaacuccucccucuacaucgacgacgucuucaugggccucugcgccaacaagaucggcaucgucccccaggaccacgucuucuucuccggcgagggcaagacccccuaccaccccugcaucuacgagaagaugaugaccucccacggccaccucgaggaccuccaggaccucuggaagaacgccaccgaccccaaggucaagaccaucuccaagggcuucuucggccagaucuacugccgccucaugaagaucauccuccucugcaagaucuccuacgucgacaccuaccccugccgcgccgccuucaucuga

SEQ ID NO: 514 - RNA, 1137 nt, Artificial Sequence
  derived and/or modified sequence opt3 from B3GN5__Homo_sapiens__AAH28058
augagaaugcuggugagcggcaggcgggucaagaaauggcagcucaucauucaacuuuucgcuaccugcuuucuggccuccuugauguucuuuugggagcccauagacaaccacaucguuucucauaugaagucauacaguuaucgcuacuuaauuaauagcuaugauuucgugaacgacacacugucccuaaaacacacuucugcagggccucgauaccaguaucucaucaaucauaaggaaaaaugucaggcccaggauguacugcuucuguuguuugugaagacggcgccagagaacuacgaccguagaucgggaauuaggcggaccugggguaaugaaaacuauguccgcucacaacucaaugcuaacaucaagacacuguucgcccugggcacuccgaauccccucgagggggaagaguuacagagaaaacuggcaugggaggaucagagguacaacgacauaauccagcaagauuuuguggacagcuucuacaaucuuaccuugaagcugcuaaugcaguuuaguugggccaacacauauugcccucacgcuaaauuccucaugaccgcagaugacgauauuuuuauccauaugccaaaucugauugaauaccuucagucccuggagcagaucggaguucaagacuucuggauaggccgggugcaccgcggugcucccccuauucgagauaagucuagcaaauauuacgucuccuaugaaauguaccaguggccagccuaucccgacuacacugccggggcggcauacgugaucucaggagacguagccgcuaagguuuaugaggccagucagacauugaacagcucucucuacauugaugacguguuuaugggccugugugcaaauaagaucggcaucgucccucaagaucacguguucuucuccggggagggaaaaaccccauaucauccgugcauuuacgaaaagaugaugacgucacacggucauuuagaggaccugcaggaucucuggaaaaacgcuacugaccccaaggugaaaaccauaagcaagggcuuuuucgggcagaucuauuguagacuuaugaaaauuauccuguugugcaagauaaguuacgucgauacauauccuuguagggccgcguuuauuuga

SEQ ID NO: 515 - RNA, 1137 nt, Artificial Sequence
  derived and/or modified sequence opt4 from B3GN5__Homo_sapiens__AAH28058
augagaaugcuggugagcggcagaagagugaagaaguggcagcugaucauccagcuguucgccaccugcuuccuggccagccugauguucuucugggagcccaucgacaaccacaucgugagccacaugaagagcuacagcuacagauaccugaucaacagcuacgacuucgugaacgacacccugagccugaagcacaccagcgccggccccagauaccaguaccugaucaaccacaaggagaagugccaggcccaggacgugcugcugcugcuguucgugaagaccgcccccgagaacuacgacagaagaagcggcaucagaagaaccuggggcaacgagaacuacgugagaagccagcugaacgccaacaucaagacccuguucgcccugggcacccccaacccccuggagggcgaggagcugcagagaaagcuggccugggaggaccagagauacaacgacaucauccagcaggacuucguggacagcuucuacaaccugacccugaagcugcugaugcaguucagcugggccaacaccuacugcccccacgccaaguuccugaugaccgccgacgacgacaucuucauccacaugcccaaccugaucgaguaccugcagagccuggagcagaucggcgugcaggacuucuggaucggcagagugcacagaggcgccccccccaucagagacaagagcagcaaguacuacgugagcuacgagauguaccaguggcccgccuaccccgacuacaccgccggcgccgccuacgugaucagcggcgacguggccgccaagguguacgaggccagccagacccugaacagcagccuguacaucgacgacguguucaugggccugugcgccaacaagaucggcaucgugccccaggaccacguguucuucagcggcgagggcaagacccccuaccaccccugcaucuacgagaagaugaugaccagccacggccaccuggaggaccugcaggaccuguggaagaacgccaccgaccccaaggugaagaccaucagcaagggcuucuucggccagaucuacugcagacugaugaagaucauccugcugugcaagaucagcuacguggacaccuaccccugcagagccgccuucaucuga

SEQ ID NO: 516 - RNA, 1137 nt, Artificial Sequence
  derived and/or modified sequence opt5 from B3GN5__Homo_sapiens__AAH28058
augagaaugcuggugagcggccggcgcgucaagaaauggcagcucaucauucaacuguucgcuaccugcuuucuugccucccugauguucuuuugggagcccaucgacaaccacauuguuucucauaugaaaagcuacuccuauagauaccucaucaauucuuaugauuucgugaacgacacacugagccuuaagcacacguccgccgggccucgguaccaguaucugauuaaucauaaggaaaaaugucaggcgcaggaugugcuccugcugcucuuugucaagaccgcuccggagaacuacgaccgcagaucuggaauccggcgcacauggggcaaugaaaacuaugugagaagccaacugaaugccaacaucaagacccuuuucgcccuggggacacccaauccucucgagggagaggaacugcagcggaaacuugcuugggaggaucagcgcuacaacgacauuauccagcaagauuuuguugacuccuucuacaaucugacccucaagcugcugaugcaguuuagcugggccaacacauauugcccccacgcuaaauuccucaugaccgccgaugacgauauuuuuauccauaugccuaaucugauugaauaccuucagucucuggagcagaucggcgugcaagacuucuggauugggagaguccaccggggagcgcccccuauccgcgauaaguccagcaaauauuacgugucuuaugaaauguaccaguggccggccuaucccgacuacacggcuggcgccgcuuacguuaucuccggcgacguggccgcgaaggucuaugaggccagccagacccucaacucuucccuguacauugaugacguguuuauggggcuuugugcuaauaagaucggaauugugccucaagaucacgucuucuucagcggcgaggggaaaacacccuaucauccuugcaucuacgaaaagaugaugaccucccacggacaucuggaggaccuccaggaucuguggaaaaacgccacagaccccaagguuaaaaccauuucuaagggcuuuuucgggcagaucuauuguagacugaugaaaaucauucuccugugcaagaucagcuacguggauacguauccgugucgggcugccuuuauuuga

SEQ ID NO: 517 - protein, 533 aa, Artificial Sequence
  B4GN1__Homo_sapiens__Q00973
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 518 - RNA, 1602 nt, Artificial Sequence
  B4GN1__Homo_sapiens__AAA35516
auguggcugggccgccgggcccugugcgcucugguccuucugcucgccugcgccucgcuggggcuccuguacgcgagcacccgggacgcgcccggccuccggcuaccucuugcgccgugggcgcccccgcaaagcccccgcaggcccgagcugccagaucuugcuccugagccccgcuacgcacacaucccggucaggaucaaggagcaaguaguggggcugcuggcuuggaacaacugcaguugugaguccaguggggggggccucccccuccccuuccagaaacaaguccgagcuauugaccucaccaaggccuuugacccugcagagcugagggcugccucugccacaagagagcaggaguuccaggccuuucugucgaggagccaguccccagcugaccagcugcucauagccccugccaacuccccgcuccaguacccccuacaggguguggaaguucagccccucaggagcaucuuggugccagggcugagccuucaggcagcuucuggucaggagguauaccaggugaaccugacugccucccuaggcaccugggacguggcaggggaagugacuggaguuacucucacuggagagggucaggcagaucucacccuugucagcccagggcuggaccaacucaacaggcaacuacaacuggucacuuacagcagccgaagcuaccagaccaacacagcagacacaguccgguucuccaccgagggacaugaggcugcuuucacuauccgcauaagacacccgcccaacccucggcuguacccaccugggucucuaccccagggagcccaguacaacaucagcgcucuagucacgauugccaccaagaccuuccuccguuaugaucggcuacgggcucucaucaccaguauccgccgcuucuacccaacgguuaccguggucaucgcugacgacagcgacaagccagagcgcguuaguggccccuacguggaacacuaucucaugcccuucggcaagggcugguucgcaggccggaaccuggccgugucucaaguaaccaccaaguacgugcuguggguggacgacgacuucgucuucacggcgcggacgcggcuggagaggcuuguggacgugcuggagcggacgccgcuggaccugguggggggcgcggugcgcgagaucuccggcuuugccaccacuuaucggcagcugcugagcguggagcccggcgccccaggccucgggaacugccuccggcaaaggcgcggcuuccaccacgagcucgucggcuucccaggcugcguggucaccgacggcgugguuaacuucuuccuggcgcggacugacaaggugcgcgaggucgguuucgacccccgccucagccgcguggcucaucuggaauucuucuuggaugggcuugguucccuucggguuggcuccugcuccgacgucgugguggaucaugcauccaaacugaagcugccuuggacaucaagggaugccggagcagagacuuacgcccgguaccguuacccaggaucacuggacgagagccagauggccaaacaccggcugcucuucuucaaacaccggcugcagugcaugaccucccaguga

SEQ ID NO: 519 - RNA, 1602 nt, Artificial Sequence
  derived and/or modified sequence opt1 from B4GN1__Homo_sapiens__AAA35516
auguggcugggccgccgggcccucugcgcccuggugcugcuccuggcgugcgccagccuggggcuccuguacgccuccacccgcgacgcccccggccugcggcucccgcuggcccccugggcgccgccccagagcccccgccggcccgagcugcccgaccucgcccccgagccgcgcuacgcccacauccccguccggaucaaggagcaggucguggggcugcuggccuggaacaacugcuccugcgagagcuccggcgggggccucccccugcccuuccagaagcagguccgcgcgaucgaccugaccaaggccuucgacccggccgagcuccgggccgccagcgcgacgcgcgagcaggaguuccaggccuuccugucccggagccagucccccgccgaccagcugcucaucgcccccgccaacagcccccugcaguacccgcugcagggcguggaggugcagccccuccgcuccauccuggugcccgggcugagccuccaggcggccuccggccaggagguguaccaggugaaccugaccgccagccuggggaccugggacgucgccggcgaggugaccggggugacgcucaccggcgagggccaggccgaccugacccuggucucccccgggcucgaccagcugaaccggcagcugcagcucgugaccuacagcucccgcagcuaccagacgaacaccgcggacaccgugcgguucuccaccgagggccacgaggccgccuucacgauccgcauccggcacccgcccaacccccgccuguacccgcccgggagccugccccagggcgcccaguacaacaucagcgcccucgucaccaucgcgaccaagaccuuccugcgguacgaccgccugcgggcccucaucacguccauccgccgcuucuaccccaccgugaccguggucaucgccgacgacagcgacaagcccgagcggguguccggcccguacguggagcacuaccugaugcccuucgggaagggcugguucgccgggcgcaaccuggcggucagccaggugaccacgaaguacgugcucugggucgacgacgacuucguguucaccgcccggacccgccuggagcggcuggucgacgugcucgagcgcacgccccuggaccuggugggcggggccguccgggagaucuccggcuucgccaccaccuaccgccagcugcucagcguggagccgggcgcccccgggcugggcaacugccugcggcagcgccggggguuccaccacgagcucgugggcuuccccgggugcgucgugaccgacggcguggucaacuucuuccuggcgcgcaccgacaaggugcgggaggugggcuucgacccccgccugucccgggucgcccaccucgaguucuuccuggacgggcugggcagccuccgcgugggguccugcagcgacguggucguggaccacgccuccaagcugaagcugccguggacgagccgggacgccggcgccgagaccuacgcgcgcuaccgguaccccgggucccucgacgagagccagauggccaagcaccgccugcuguucuucaagcaccgccuccagugcaugaccucccaguga

SEQ ID NO: 520 - RNA, 1602 nt, Artificial Sequence
  derived and/or modified sequence opt2 from B4GN1__Homo_sapiens__AAA35516
auguggcucggccgccgcgcccucugcgcccucguccuccuccucgccugcgccucccucggccuccucuacgccuccacccgcgacgcccccggccuccgccucccccucgcccccugggcccccccccaguccccccgccgccccgagcuccccgaccucgcccccgagccccgcuacgcccacauccccguccgcaucaaggagcaggucgucggccuccucgccuggaacaacugcuccugcgaguccuccggcggcggccucccccuccccuuccagaagcagguccgcgccaucgaccucaccaaggccuucgaccccgccgagcuccgcgccgccuccgccacccgcgagcaggaguuccaggccuuccucucccgcucccagucccccgccgaccagcuccucaucgcccccgccaacuccccccuccaguacccccuccagggcgucgagguccagccccuccgcuccauccucguccccggccucucccuccaggccgccuccggccaggaggucuaccaggucaaccucaccgccucccucggcaccugggacgucgccggcgaggucaccggcgucacccucaccggcgagggccaggccgaccucacccucgucucccccggccucgaccagcucaaccgccagcuccagcucgucaccuacuccucccgcuccuaccagaccaacaccgccgacaccguccgcuucuccaccgagggccacgaggccgccuucaccauccgcauccgccacccccccaacccccgccucuacccccccggcucccucccccagggcgcccaguacaacaucuccgcccucgucaccaucgccaccaagaccuuccuccgcuacgaccgccuccgcgcccucaucaccuccauccgccgcuucuaccccaccgucaccgucgucaucgccgacgacuccgacaagcccgagcgcgucuccggccccuacgucgagcacuaccucaugcccuucggcaagggcugguucgccggccgcaaccucgccgucucccaggucaccaccaaguacguccucugggucgacgacgacuucgucuucaccgcccgcacccgccucgagcgccucgucgacguccucgagcgcaccccccucgaccucgucggcggcgccguccgcgagaucuccggcuucgccaccaccuaccgccagcuccucuccgucgagcccggcgcccccggccucggcaacugccuccgccagcgccgcggcuuccaccacgagcucgucggcuuccccggcugcgucgucaccgacggcgucgucaacuucuuccucgcccgcaccgacaagguccgcgaggucggcuucgacccccgccucucccgcgucgcccaccucgaguucuuccucgacggccucggcucccuccgcgucggcuccugcuccgacgucgucgucgaccacgccuccaagcucaagcuccccuggaccucccgcgacgccggcgccgagaccuacgcccgcuaccgcuaccccggcucccucgacgagucccagauggccaagcaccgccuccucuucuucaagcaccgccuccagugcaugaccucccaguga

SEQ ID NO: 521 - RNA, 1602 nt, Artificial Sequence
  derived and/or modified sequence opt3 from B4GN1__Homo_sapiens__AAA35516
auguggcugggcagaagggcccucugcgcucuugugcuguuguuagcaugugccagccuggggcuacucuacgcguccacccgggacgcucccggacugcgccuuccucuggccccaugggcaccgccccagucuccucgacguccagaguugcccgaucucgccccugaaccaagauaugcucacauccccgucaggauuaaggagcaaguugugggucugcuggcauggaacaauugcucaugugaaaguagcggcgggggacucccuuuaccauuccagaaacagguacgggccauagaccugacaaaggcuuuugauccggccgagcuucgcgcggcauccgccacuagagaacaggaguuccaagcauuuuugucuaggucgcagucacccgccgaccagcugcuaaucgcuccugcuaacagcccacuccaguacccccugcaaggcguggagguccagccucuucggaguauucuggugccagguuugucccuccaggccgcgucugggcaggaaguuuaucaagugaaucugacggccagcuuaggaaccugggaugucgcaggcgaggugacaggcguaacucugaccggggaaggacaggcugaccucacacuuguuucccccggucuggaucaguugaaccgccaacuacagcuggugaccuacucaagucgaagcuaucagacuaauacagccgacaccgucagauucucuacggagggccaugaggcugccuuuacuaucaggauucggcacccgccuaacccccgucucuacccaccugggucccugccccagggagcacaauauaauaucucagcccuugugaccauagcuacaaaaacuuuccugcgcuacgauagauugagggcgcucaucaccagcauucggcgauuuuacccaacagugaccgucguuaucgcagacgauagugacaagcccgaacgcgugucuggcccuuauguagagcauuaccugaugccauucgguaaagggugguuugccggaagaaacuuagcugugucccaggucacgacuaaguaugugcuguggguugaugacgacuucguguuuacagccaggacccggcuagaacgccucgucgaugugcuggagagaacuccgcuugacuugguaggcggcgcaguuagggaaauuagcggguucgccacaaccuaccgucagcugcucucgguggagcccggagcuccuggucugggcaauugccuucggcagcgaagaggguuucaccaugagcuggucggauucccaggcuguguggucacggauggugugguuaacuucuuuuuggccaggaccgacaaggugcgcgaaguaggguucgauccccggcucucuagagucgcacaccuggaguuuuucuuagacggccugggaucccuaagggugggcucaugcagugauguuguggucgaccacgcgagcaaacucaagcugccuuggacaucccgcgaugcuggggccgaaacuuaugcacgauaccgguauccaggaucucuugacgagagccaaauggccaaacaucguuugcuguuuuucaagcacagacuccaguguaugaccucacaguga

SEQ ID NO: 522 - RNA, 1602 nt, Artificial Sequence
  derived and/or modified sequence opt4 from B4GN1__Homo_sapiens__AAA35516
auguggcugggcagaagagcccugugcgcccuggugcugcugcuggccugcgccagccugggccugcuguacgccagcaccagagacgcccccggccugagacugccccuggcccccugggcccccccccagagccccagaagacccgagcugcccgaccuggcccccgagcccagauacgcccacauccccgugagaaucaaggagcagguggugggccugcuggccuggaacaacugcagcugcgagagcagcggcggcggccugccccugcccuuccagaagcaggugagagccaucgaccugaccaaggccuucgaccccgccgagcugagagccgccagcgccaccagagagcaggaguuccaggccuuccugagcagaagccagagccccgccgaccagcugcugaucgcccccgccaacagcccccugcaguacccccugcagggcguggaggugcagccccugagaagcauccuggugcccggccugagccugcaggccgccagcggccaggagguguaccaggugaaccugaccgccagccugggcaccugggacguggccggcgaggugaccggcgugacccugaccggcgagggccaggccgaccugacccuggugagccccggccuggaccagcugaacagacagcugcagcuggugaccuacagcagcagaagcuaccagaccaacaccgccgacaccgugagauucagcaccgagggccacgaggccgccuucaccaucagaaucagacacccccccaaccccagacuguacccccccggcagccugccccagggcgcccaguacaacaucagcgcccuggugaccaucgccaccaagaccuuccugagauacgacagacugagagcccugaucaccagcaucagaagauucuaccccaccgugaccguggugaucgccgacgacagcgacaagcccgagagagugagcggccccuacguggagcacuaccugaugcccuucggcaagggcugguucgccggcagaaaccuggccgugagccaggugaccaccaaguacgugcuguggguggacgacgacuucguguucaccgccagaaccagacuggagagacugguggacgugcuggagagaaccccccuggaccuggugggcggcgccgugagagagaucagcggcuucgccaccaccuacagacagcugcugagcguggagcccggcgcccccggccugggcaacugccugagacagagaagaggcuuccaccacgagcuggugggcuuccccggcugcguggugaccgacggcguggugaacuucuuccuggccagaaccgacaaggugagagaggugggcuucgaccccagacugagcagaguggcccaccuggaguucuuccuggacggccugggcagccugagagugggcagcugcagcgacguggugguggaccacgccagcaagcugaagcugcccuggaccagcagagacgccggcgccgagaccuacgccagauacagauaccccggcagccuggacgagagccagauggccaagcacagacugcuguucuucaagcacagacugcagugcaugaccagccaguga

SEQ ID NO: 523 - RNA, 1602 nt, Artificial Sequence
  derived and/or modified sequence opt5 from B4GN1__Homo_sapiens__AAA35516
auguggcugggcagacgggcccucugcgcucuggugcuucugcucgccugugcgagccuggggcuucuguacgcuuccacccgcgacgcccccggacucagacugccucuggccccgugggcucccccucagucuccccggcgcccugagcuccccgaucuggccccugaaccgagauaugcucacauccccguccggauuaaggagcaaguugugggccuucuggccuggaacaauugcagcugugaauccucugggggaggccucccucugcccuuccagaaacaggugcgcgcgaucgaccuuacaaaggccuuugauccugcugagcugagagccgcuagcgccacgcgggaacaggaguuccaagcguuucucucccgcucucagagccccgccgaccagcugcugauugcuccggccaacuccccucuccaguacccccugcaaggggucgaggugcagccucuuagaagcauccugguucccggacucucucugcaggcugccuccggccaggaaguguaucaagucaaucuuaccgccagccugggcacaugggauguggcuggggagguuaccggagugacacucaccggcgaagggcaggcggaccugacacuggucucucccggacucgaucagcugaaccggcaacuucagcuggugaccuacuccagccgcucuuaucagacgaauaccgccgacacagugagauucuccaccgagggccaugaggcugccuuuacaauucggauccgccacccuccgaaccccagacucuacccucccgggagccugccucagggagcccaauauaauaucuccgcucuugucaccauugccacgaaaacauuccugcgguacgauagacuccgcgcgcugaucaccucuauucggagauuuuaccccacaguuaccguggugaucgcugacgauagcgacaagccggaacgcgucuccggcccuuauguggagcauuaccugaugcccuucggcaaagggugguuugccggacggaaccucgccguuagccaggugaccacaaaguauguccuguggguggaugacgacuucguuuuuacggcuagaacccgccuugaacggcugguggauguccucgagagaacaccucuggaccuggugggcggggccguccgcgaaauuucuggauucgcuaccacauaccggcagcuucucuccguggagcccggcgccccugggcugggaaauugccugagacagcgccggggcuuucaccaugagcucguuggcuuccccggguguguggucaccgauggagugguuaacuucuuucuggcgagaacggacaaggugcgggaagucggcuucgauccgcgccuuagcagaguggcccaccuggaguuuuuccucgacgggcugggaucucugcgggugggcagcugcuccgauguugucguggaccacgcuucuaaacuuaagcucccuuggacaagcagagaugccggggcugaaaccuaugcccgcuaccgguaucccggcucccuggacgagagccaaauggcgaaacauagacugcucuuuuucaagcaccgccugcaguguaugaccucucaguga

SEQ ID NO: 524 - protein, 282 aa, Artificial Sequence
  B7H4__Homo_sapiens__Q7Z7D3
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 525 - RNA, 849 nt, Artificial Sequence
  B7H4__Homo_sapiens__AAH74729
auggcuucccuggggcagauccucuucuggagcauaauuagcaucaucauuauucuggcuggagcaauugcacucaucauuggcuuugguauuucagggagacacuccaucacagucacuacugucgccucagcugggaacauuggggaggauggaauccugagcugcacuuuugaaccugacaucaaacuuucugauaucgugauacaauggcugaaggaagguguuuuaggcuugguccaugaguucaaagaaggcaaagaugagcugucggagcaggaugaaauguucagaggccggacagcaguguuugcugaucaagugauaguuggcaaugccucuuugcggcugaaaaacgugcaacucacagaugcuggcaccuacaaauguuauaucaucacuucuaaaggcaaggggaaugcuaaccuugaguauaaaacuggagccuucagcaugccggaagugaauguggacuauaaugccagcucagagaccuugcggugugaggcuccccgaugguucccccagcccacaguggucugggcaucccaaguugaccagggagccaacuucucggaagucuccaauaccagcuuugagcugaacucugagaaugugaccaugaagguugugucugugcucuacaauguuacgaucaacaacacauacuccuguaugauugaaaaugacauugccaaagcaacaggggauaucaaagugacagaaucggagaucaaaaggcggagucaccuacagcugcuaaacucaaaggcuucucugugugucucuucuuucuuugccaucagcugggcacuucugccucucagcccuuaccugaugcuaaaauaa

SEQ ID NO: 526 - RNA, 849 nt, Artificial Sequence
  derived and/or modified sequence opt1 from B7H4__Homo_sapiens__AAH74729
auggccagccugggccagauccucuucugguccaucaucagcaucaucaucauccuggccggggcgaucgcccugaucaucggcuucgggaucuccggccgccacagcaucaccgugaccacggucgccuccgccgggaacaucggcgaggacggcauccucagcugcaccuucgagcccgacaucaagcuguccgacaucgugauccaguggcugaaggagggggugcucggccugguccacgaguucaaggaggggaaggacgagcugagcgagcaggacgagauguuccggggccgcaccgccguguucgcggaccaggugaucgucgggaacgccucccuccggcugaagaacgugcagcugaccgacgccggcacguacaagugcuacaucaucaccagcaagggcaaggggaacgccaaccucgaguacaagaccggcgcguucuccaugccggaggugaacgucgacuacaacgccagcuccgagacccugcgcugcgaggcgccccggugguucccccagcccacgguggugugggccagccaggucgaccagggggccaacuucuccgaggugagcaacaccuccuucgagcugaacagcgagaacgugaccaugaaggucguguccgugcucuacaacgucaccaucaacaacacguacagcugcaugaucgagaacgacaucgccaaggccaccggcgacaucaaggugaccgagagcgagaucaagcgccggucccaccuccagcugcugaacagcaaggccucccugugcgugagcuccuucuucgccaucagcugggcccugcucccgcugucccccuaccugaugcucaaguga

SEQ ID NO: 527 - RNA, 849 nt, Artificial Sequence
  derived and/or modified sequence opt2 from B7H4__Homo_sapiens__AAH74729
auggccucccucggccagauccucuucugguccaucaucuccaucaucaucauccucgccggcgccaucgcccucaucaucggcuucggcaucuccggccgccacuccaucaccgucaccaccgucgccuccgccggcaacaucggcgaggacggcauccucuccugcaccuucgagcccgacaucaagcucuccgacaucgucauccaguggcucaaggagggcguccucggccucguccacgaguucaaggagggcaaggacgagcucuccgagcaggacgagauguuccgcggccgcaccgccgucuucgccgaccaggucaucgucggcaacgccucccuccgccucaagaacguccagcucaccgacgccggcaccuacaagugcuacaucaucaccuccaagggcaagggcaacgccaaccucgaguacaagaccggcgccuucuccaugcccgaggucaacgucgacuacaacgccuccuccgagacccuccgcugcgaggccccccgcugguucccccagcccaccgucgucugggccucccaggucgaccagggcgccaacuucuccgaggucuccaacaccuccuucgagcucaacuccgagaacgucaccaugaaggucgucuccguccucuacaacgucaccaucaacaacaccuacuccugcaugaucgagaacgacaucgccaaggccaccggcgacaucaaggucaccgaguccgagaucaagcgccgcucccaccuccagcuccucaacuccaaggccucccucugcgucuccuccuucuucgccaucuccugggcccuccucccccucucccccuaccucaugcucaaguga

SEQ ID NO: 528 - RNA, 849 nt, Artificial Sequence
  derived and/or modified sequence opt3 from B7H4__Homo_sapiens__AAH74729
auggccagccugggccagauccucuucugguccauuauaucuaucauuaucauucuugcuggggcaaucgcccugauaaucggauuugguauuucaggcagacacaguaucaccgugacaacugucgcgagcgcugggaacauuggagaggacggcaucuuguccugcacguucgaacccgauauaaaguuaucugacauuguuauccaauggcugaaagagggugugcuagggcucguacaugaauuuaaggagggaaaagaugaacugucggagcaggacgagauguucaggggccggaccgccguguuugcagaucaggucauugugggcaaugccucacuucgccugaagaacguucaguugacagacgcugggacuuacaaauguuauaucaucaccagcaagggaaaggguaaugcaaaccucgaauacaaaacaggcgccuucaguaugccugaggugaaugucgauuauaacgcuuccucugaaacccugcgaugcgaggccccacguugguuuccgcaacccacugugguaugggcgagccagguugaccagggggcaaauuucuccgaggugucaaacacaaguuuugaacugaauagcgagaacgucaccaugaagguggugucuguccucuacaauguuacgauuaacaauacuuauuccuguaugauagaaaacgauaucgccaaagcuaccggagacauuaaggugacagagucagaaaucaaaagaaggagccacuuacagcugcuuaauaguaaggccucuuugugcguauccagcuucuuugcaauaucgugggcucugcuaccucucucuccauaccugaugcuuaaguga

SEQ ID NO: 529 - RNA, 849 nt, Artificial Sequence
  derived and/or modified sequence opt4 from B7H4__Homo_sapiens__AAH74729
auggccagccugggccagauccuguucuggagcaucaucagcaucaucaucauccuggccggcgccaucgcccugaucaucggcuucggcaucagcggcagacacagcaucaccgugaccaccguggccagcgccggcaacaucggcgaggacggcauccugagcugcaccuucgagcccgacaucaagcugagcgacaucgugauccaguggcugaaggagggcgugcugggccuggugcacgaguucaaggagggcaaggacgagcugagcgagcaggacgagauguucagaggcagaaccgccguguucgccgaccaggugaucgugggcaacgccagccugagacugaagaacgugcagcugaccgacgccggcaccuacaagugcuacaucaucaccagcaagggcaagggcaacgccaaccuggaguacaagaccggcgccuucagcaugcccgaggugaacguggacuacaacgccagcagcgagacccugagaugcgaggcccccagaugguucccccagcccaccguggugugggccagccagguggaccagggcgccaacuucagcgaggugagcaacaccagcuucgagcugaacagcgagaacgugaccaugaagguggugagcgugcuguacaacgugaccaucaacaacaccuacagcugcaugaucgagaacgacaucgccaaggccaccggcgacaucaaggugaccgagagcgagaucaagagaagaagccaccugcagcugcugaacagcaaggccagccugugcgugagcagcuucuucgccaucagcugggcccugcugccccugagccccuaccugaugcugaaguga

SEQ ID NO: 530 - RNA, 849 nt, Artificial Sequence
  derived and/or modified sequence opt5 from B7H4__Homo_sapiens__AAH74729
auggccagccugggccagauccucuucugguccauuaucucuauuaucauuauccuggcuggggccaucgcgcuuauuaucggauuuggcauuagcgggagacacuccaucaccgugacaacggucgcuucugccggaaacauuggcgaggacgggauccugagcugcaccuucgaacccgauauuaagcucuccgacaucguuauccaauggcugaaagagggagugcuuggccuggugcacgaauuuaaggagggcaaagaugaacucucugagcaggacgagauguuccgggggcgcacagccgucuuugcugaucaggugauuguuggaaaugccagccugagacugaagaacgugcagcucaccgacgcuggcacauacaaauguuauaucauuaccuccaaggggaagggaaaugccaaccuggaauacaaaacaggcgcguucagcaugccugaggucaauguggauuauaacgccucuuccgaaacccuucggugcgaggcuccgcgcugguuuccccaaccuacgguugugugggccagccaggucgaccagggggcuaauuucucugagguguccaacaccagcuuugaacucaauucugagaacgugacaaugaaggucguuuccgugcuguacaaugugaccaucaacaauacauauagcuguaugauugaaaacgauaucgccaaagcgaccggagacaucaaggucacggaguccgaaauuaaaagacggucucaucugcagcuucugaauagcaaggccucccucugcgugagcucuuucuuugcuaucuccugggcccugcugccccucagcccuuaccugaugcuuaaguga

SEQ ID NO: 531 - protein, 43 aa, Artificial Sequence
  BAGE-1__Homo_sapiens__Q13072
MAARAVFLALSAQLLQARLMKEESPVVSWRLEPEDGTALCFIF

SEQ ID NO: 532 - RNA, 132 nt, Artificial Sequence
  BAGE-1__Homo_sapiens__AAC50123
auggcggccagagcgguuuuucuggcauugucugcccagcugcuccaagccaggcugaugaaggaggaguccccuguggugagcuggagguuggagccugaagacggcacagcucugugcuucaucuucuga

SEQ ID NO: 533 - RNA, 132 nt, Artificial Sequence
  derived and/or modified sequence opt1 from BAGE-1__Homo_sapiens__AAC50123
auggccgcccgcgcgguguuccuggcccucagcgcccagcugcugcaggcccggcucaugaaggaggagucccccgucgugagcuggcgccuggagccggaggacggcaccgcccugugcuucaucuucuga

SEQ ID NO: 534 - RNA, 132 nt, Artificial Sequence
  derived and/or modified sequence opt2 from BAGE-1__Homo_sapiens__AAC50123
auggccgcccgcgccgucuuccucgcccucuccgcccagcuccuccaggcccgccucaugaaggaggagucccccgucgucuccuggcgccucgagcccgaggacggcaccgcccucugcuucaucuucuga

SEQ ID NO: 535 - RNA, 132 nt, Artificial Sequence
  derived and/or modified sequence opt3 from BAGE-1__Homo_sapiens__AAC50123
auggccgcuagagcaguguuccuggcccucagcgcgcagcuucugcaagcuagguugaugaaggaggaaucccccgucguuucuuggcgguuagagccugaagacggcaccgcccugugcuuuaucuucuga

SEQ ID NO: 536 - RNA, 132 nt, Artificial Sequence
  derived and/or modified sequence opt4 from BAGE-1__Homo_sapiens__AAC50123
auggccgccagagccguguuccuggcccugagcgcccagcugcugcaggccagacugaugaaggaggagagccccguggugagcuggagacuggagcccgaggacggcaccgcccugugcuucaucuucuga

SEQ ID NO: 537 - RNA, 132 nt, Artificial Sequence
  derived and/or modified sequence opt5 from BAGE-1__Homo_sapiens__AAC50123
auggccgcuagagccguguuccuggcgcucagcgcucagcugcuucaagcccggcugaugaaggaggaaucccccgucguuucuuggcgccucgagccugaagacggcaccgcccugugcuuuaucuucuga

SEQ ID NO: 538 - protein, 385 aa, Artificial Sequence
  BASI__Homo_sapiens__P35613
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 539 - RNA, 1158 nt, Artificial Sequence
  BASI__Homo_sapiens__AAN40694
auggcggcugcgcuguucgugcugcugggauucgcgcugcugggcacccacggagccuccggggcugccggcuucguccaggcgccgcugucccagcagagguggguggggggcaguguggagcugcacugcgaggccgugggcagcccggugcccgagauccaguggugguuugaagggcagggucccaacgacaccugcucccagcucugggacggcgcccggcuggaccgcguccacauccacgccaccuaccaccagcacgcggccagcaccaucuccaucgacacgcucguggaggaggacacgggcacuuacgagugccgggccagcaacgacccggaucgcaaccaccugacccgggcgcccagggucaaguggguccgcgcccaggcagucgugcuaguccuggaacccggcacagucuucacuaccguagaagaccuuggcuccaagauacuccucaccugcuccuugaaugacagcgccacagaggucacagggcaccgcuggcugaaggggggcguggugcugaaggaggacgcgcugcccggccagaaaacggaguucaagguggacuccgacgaccaguggggagaguacuccugcgucuuccuccccgagcccaugggcacggccaacauccagcuccacgggccucccagagugaaggccgugaagucgucagaacacaucaacgagggggagacggccaugcuggucugcaagucagaguccgugccaccugucacugacugggccugguacaagaucacugacucugaggacaaggcccucaugaacggcuccgagagcagguucuucgugaguuccucgcagggccggucagagcuacacauugagaaccugaacauggaggccgaccccggccaguaccggugcaacggcaccagcuccaagggcuccgaccaggccaucaucacgcuccgcgugcgcagccaccuggccgcccucuggcccuuccugggcaucguggcugaggugcuggugcuggucaccaucaucuucaucuacgagaagcgccggaagcccgaggacguccuggaugaugacgacgccggcucugcaccccugaagagcagcgggcagcaccagaaugacaaaggcaagaacguccgccagaggaacucuuccuga

SEQ ID NO: 540 - RNA, 1158 nt, Artificial Sequence
  derived and/or modified sequence opt1 from BASI__Homo_sapiens__AAN40694
auggccgccgcccuguucgugcugcugggcuucgcccugcucgggacccacggcgccagcggggccgccggcuucguccaggcgccccugucccagcagcgcugggucgggggcagcguggagcugcacugcgaggccgugggcuccccggugcccgagauccaguggugguucgaggggcagggccccaacgacacgugcagccagcucugggacggggcccggcuggaccgcgugcacauccacgccaccuaccaccagcacgcggccuccaccaucagcaucgacacccuggucgaggaggacaccggcacguacgagugccgggccuccaacgaccccgaccgcaaccaccucacccgggccccgcgcgugaagugggugcgggcccaggcggucgugcuggugcuggagcccgggaccgucuucaccacgguggaggaccucggcagcaagauccugcugaccugcucccucaacgacagcgccaccgaggugaccggccaccgcuggcugaagggcggggucgugcugaaggaggacgcccuccccgggcagaagacggaguucaagguggacuccgacgaccaguggggcgaguacagcugcgucuuccugcccgagccgaugggcaccgccaacauccagcugcacgggccgccccgggugaaggccgugaaguccagcgagcacaucaacgagggcgagaccgcgaugcucgucugcaaguccgagagcgugccgcccgugaccgacugggccugguacaagaucacggacuccgaggacaaggcccugaugaacgggagcgagucccgcuucuucgucagcagcucccagggccggagcgagcugcacaucgagaaccucaacauggaggccgaccccgggcaguaccgcugcaacggcaccuccagcaagggcuccgaccaggccaucaucacccugcgggugcgcagccaccuggcggcccucuggcccuuccuggggaucgucgccgaggugcuggugcucgucaccaucaucuucaucuacgagaagcggcgcaagcccgaggacgugcuggacgacgacgacgccggcuccgcgccccucaagagcuccgggcagcaccagaacgacaagggcaagaacgugcggcagcgcaacagcuccuga

SEQ ID NO: 541 - RNA, 1158 nt, Artificial Sequence
  derived and/or modified sequence opt2 from BASI__Homo_sapiens__AAN40694
auggccgccgcccucuucguccuccucggcuucgcccuccucggcacccacggcgccuccggcgccgccggcuucguccaggccccccucucccagcagcgcugggucggcggcuccgucgagcuccacugcgaggccgucggcucccccguccccgagauccaguggugguucgagggccagggccccaacgacaccugcucccagcucugggacggcgcccgccucgaccgcguccacauccacgccaccuaccaccagcacgccgccuccaccaucuccaucgacacccucgucgaggaggacaccggcaccuacgagugccgcgccuccaacgaccccgaccgcaaccaccucacccgcgccccccgcgucaaguggguccgcgcccaggccgucguccucguccucgagcccggcaccgucuucaccaccgucgaggaccucggcuccaagauccuccucaccugcucccucaacgacuccgccaccgaggucaccggccaccgcuggcucaagggcggcgucguccucaaggaggacgcccuccccggccagaagaccgaguucaaggucgacuccgacgaccaguggggcgaguacuccugcgucuuccuccccgagcccaugggcaccgccaacauccagcuccacggccccccccgcgucaaggccgucaaguccuccgagcacaucaacgagggcgagaccgccaugcucgucugcaaguccgaguccgucccccccgucaccgacugggccugguacaagaucaccgacuccgaggacaaggcccucaugaacggcuccgagucccgcuucuucgucuccuccucccagggccgcuccgagcuccacaucgagaaccucaacauggaggccgaccccggccaguaccgcugcaacggcaccuccuccaagggcuccgaccaggccaucaucacccuccgcguccgcucccaccucgccgcccucuggcccuuccucggcaucgucgccgagguccucguccucgucaccaucaucuucaucuacgagaagcgccgcaagcccgaggacguccucgacgacgacgacgccggcuccgccccccucaaguccuccggccagcaccagaacgacaagggcaagaacguccgccagcgcaacuccuccuga

SEQ ID NO: 542 - RNA, 1158 nt, Artificial Sequence
  derived and/or modified sequence opt3 from BASI__Homo_sapiens__AAN40694
auggccgccgcacuguucgugcuccuuggcuuugcccuguuggggacccacggagcgagcggugcugccggcuucguccaggcacccuuaucccaacagagauggguugggggaucuguggagcugcauugcgaagccguaggcucaccugugccagagauccaguggugguuugaaggucaggggccgaacgacacauguagucaacuaugggauggagcuaggcucgaccggguccacauucaugcaacuuaccaccagcaugccgcuagcacgauauccaucgauacccugguggaggaagacacaggcacuuaugagugccgcgccucuaaugaucccgaccgaaaccaccuuacccgugcgccuagaguuaagugggugagggcacaggccgucgugcugguauuggagccaggcacaguuuucaccacuguggaagaucucgggucgaaaauucugcugacauguucacucaaugacagcgcuaccgaggucacgggacaccggugguuaaaggguggcguggugcugaaagaagaugcccuucccgggcagaagacugaguuuaaagucgacagugaugaccaauggggagaguacuccugcguuuucuugccugaaccaaugggcaccgcaaacauccagcugcauggucccccucgcgugaaggcuguaaagucuagcgagcacauuaaugaaggggagacagccaugcuaguguguaaauccgaaucagucccaccggugacugauugggcgugguauaagaucaccgacagugaggacaaagcccucaugaacggaagcgagucuagauuuuucguuuccucaagccagggcaggagugaacugcauauagagaaucuuaacauggaagcagaucccggccaguaccggugcaaugggacaucuuccaagggaagcgaccaagcuaucauuacccugcgcgugcgaucgcacuuggccgcucucuggccuuuucuggguaucgucgccgagguguuaguacugguuacgauuaucuucauauaugagaaaagaaggaagccagaagaugugcucgacgaugacgaugcaggcucugcuccccuuaaguccucagggcagcaccagaacgacaaaggaaagaauguccggcaacguaacaguagcuga

SEQ ID NO: 543 - RNA, 1158 nt, Artificial Sequence
  derived and/or modified sequence opt4 from BASI__Homo_sapiens__AAN40694
auggccgccgcccuguucgugcugcugggcuucgcccugcugggcacccacggcgccagcggcgccgccggcuucgugcaggccccccugagccagcagagaugggugggcggcagcguggagcugcacugcgaggccgugggcagccccgugcccgagauccaguggugguucgagggccagggccccaacgacaccugcagccagcugugggacggcgccagacuggacagagugcacauccacgccaccuaccaccagcacgccgccagcaccaucagcaucgacacccugguggaggaggacaccggcaccuacgagugcagagccagcaacgaccccgacagaaaccaccugaccagagcccccagagugaagugggugagagcccaggccguggugcuggugcuggagcccggcaccguguucaccaccguggaggaccugggcagcaagauccugcugaccugcagccugaacgacagcgccaccgaggugaccggccacagauggcugaagggcggcguggugcugaaggaggacgcccugcccggccagaagaccgaguucaagguggacagcgacgaccaguggggcgaguacagcugcguguuccugcccgagcccaugggcaccgccaacauccagcugcacggcccccccagagugaaggccgugaagagcagcgagcacaucaacgagggcgagaccgccaugcuggugugcaagagcgagagcgugccccccgugaccgacugggccugguacaagaucaccgacagcgaggacaaggcccugaugaacggcagcgagagcagauucuucgugagcagcagccagggcagaagcgagcugcacaucgagaaccugaacauggaggccgaccccggccaguacagaugcaacggcaccagcagcaagggcagcgaccaggccaucaucacccugagagugagaagccaccuggccgcccuguggcccuuccugggcaucguggccgaggugcuggugcuggugaccaucaucuucaucuacgagaagagaagaaagcccgaggacgugcuggacgacgacgacgccggcagcgccccccugaagagcagcggccagcaccagaacgacaagggcaagaacgugagacagagaaacagcagcuga

SEQ ID NO: 544 - RNA, 1158 nt, Artificial Sequence
  derived and/or modified sequence opt5 from BASI__Homo_sapiens__AAN40694
auggccgcugcccuguucgugcuccugggcuuugcgcuucuggggacccacggagcuagcggcgccgccggguucguccaggcuccccucucccaacagagauggguuggaggcucuguggagcugcauugcgaagccguggggagcccugucccggagauccaguggugguuugaaggacagggccccaacgacacauguucccaacuuugggauggcgcucggcuggaccgcgugcacauucaugccacguaccaccagcaugcggccucuaccaucagcauugauacacucguugaggaagacaccgggacauaugagugcagagcuuccaaugauccugaccggaaccaccugacccgcgcccccagagugaaguggguccgggcucaggccgugguucuggugcucgagccuggaacagucuucaccacgguggaagaucugggcucuaaaauccuucugaccuguagccucaaugacuccgcgacagaggugaccgggcaccgcuggcugaagggaggcgucguucuuaaagaagaugcccugcccgggcagaagacagaguuuaaaguggacagcgaugaccaauggggagaguacucuugcguguuccucccugaaccgaugggcaccgcuaacauucagcugcaugggcccccuagagucaaggccgugaaguccagcgagcacaucaaugaaggcgagacggcuaugcugguuuguaaaucugaauccgugcccccugucacagauugggccugguauaagaucaccgacagcgaggacaaagcccucaugaacggaucugagucccgguuuuucgugagcuccucucagggccgcagcgaacugcauauugagaaucuuaacauggaagcugaucccgggcaguacagaugcaauggaacauccagcaagggcucugaccaagcgaucauuacccugcggguucgcucccaccucgccgcucuguggccguuucuugggaucguggccgagguccuggugcucgucaccauuaucuucauuuaugagaaaagacggaagccugaagaugugcuggacgaugacgaugccggaagcgcuccccugaagucuagcggccagcaccagaacgacaaaggcaagaauguucgccaaagaaacuccucuuga

SEQ ID NO: 545 - protein, 239 aa, Artificial Sequence [sequence omitted]

SEQ ID NO: 546 - RNA, 720 nt, Artificial Sequence
  BCL-2__Homo_sapiens__ABX60202
auggcgcacgcugggagaacgggguacgauaaccgggagauagugaugaaguacauccauuauaagcugucgcagaggggcuacgagugggaugcgggagaugugggcgccgcgcccccgggggccgcccccgcaccgggcaucuucuccucccagcccgggcacacgccccauccagccgcaucccgggacccggucgccaggaccucgccgcugcagaccccggcugcccccggcgccgccgcggggccugcgcucagcccggugccaccugugguccaccugacccuccgccaggccggcgacgacuucucccgccgcuaccgccgcgacuucgccgagauguccagccagcugcaccugacgcccuucaccgcgcggggacgcuuugccacggugguggaggagcucuucagggacggggugaacugggggaggauuguggccuucuuugaguucgguggggucauguguguggagagcgucaaccgggagaugucgccccugguggacaacaucgcccuguggaugacugaguaccugaaccggcaccugcacaccuggauccaggauaacggaggcugggaugccuuuguggaacuguacggccccagcaugcggccucuguuugauuucuccuggcugucucugaagacucugcucaguuuggcccuggugggagcuugcaucacccugggugccuaucugagccacaaguga

SEQ ID NO: 547 - RNA, 720 nt, Artificial Sequence
  derived and/or modified sequence opt1 from BCL-2__Homo_sapiens__ABX60202
auggcccacgccggccgcaccggguacgacaaccgggagaucgugaugaaguacauccacuacaagcugagccagcgcggcuacgagugggacgcgggggacgucggcgccgcgcccccgggggccgcccccgcccccggcaucuucuccagccagcccggccacaccccgcaccccgccgccucccgggaccccguggcccgcacgagcccccuccagaccccggcggcccccggggccgccgccggccccgcgcugucccccgugccgcccgucgugcaccugacccuccggcaggccggggacgacuucagccgccgguaccgccgggacuucgccgagauguccagccagcugcaccugacccccuucacggcccgcggccgguucgccaccguggucgaggagcuguuccgcgacggggugaacuggggccggaucguggcguucuucgaguucggcggggucaugugcguggaguccgugaaccgcgagaugagcccccuggucgacaacaucgcccuguggaugaccgaguaccucaaccggcaccuccacaccuggauccaggacaacggcgggugggacgccuucguggagcuguacggcccguccaugcgcccccucuucgacuucagcuggcugucccugaagacgcuccugagccuggcccucgugggcgccugcaucacccugggggcguaccugucccacaaguga

SEQ ID NO: 548 - RNA, 720 nt, Artificial Sequence
  derived and/or modified sequence opt2 from BCL-2__Homo_sapiens__ABX60202
auggcccacgccggccgcaccggcuacgacaaccgcgagaucgucaugaaguacauccacuacaagcucucccagcgcggcuacgagugggacgccggcgacgucggcgccgccccccccggcgccgcccccgcccccggcaucuucuccucccagcccggccacaccccccaccccgccgccucccgcgaccccgucgcccgcaccuccccccuccagacccccgccgcccccggcgccgccgccggccccgcccucucccccgucccccccgucguccaccucacccuccgccaggccggcgacgacuucucccgccgcuaccgccgcgacuucgccgagauguccucccagcuccaccucacccccuucaccgcccgcggccgcuucgccaccgucgucgaggagcucuuccgcgacggcgucaacuggggccgcaucgucgccuucuucgaguucggcggcgucaugugcgucgaguccgucaaccgcgagauguccccccucgucgacaacaucgcccucuggaugaccgaguaccucaaccgccaccuccacaccuggauccaggacaacggcggcugggacgccuucgucgagcucuacggccccuccaugcgcccccucuucgacuucuccuggcucucccucaagacccuccucucccucgcccucgucggcgccugcaucacccucggcgccuaccucucccacaaguga

SEQ ID NO: 549 - RNA, 720 nt, Artificial Sequence
  derived and/or modified sequence opt3 from BCL-2__Homo_sapiens__ABX60202
auggcccacgcuggcagaaccggguacgacaacagggagaucgugaugaaguauauucauuacaaacugagccagcggggauaugaaugggaugccggugacgucggcgcagcgcccccuggggcugccccagcaccgggaauauucuccucucaacccggccacacaccucauccagccgcuucacgcgaucccguugcacgaacgaguccucuccagacuccagccgcucccggugccgcggcagggccugcccuuagcccagugccgcccguagugcaccugaccuugcgucaggcuggagacgauuuuuccagaagguaccggcgcgacuucgccgagaugucuucgcaguuacaucugacaccuuuuacugcaagaggcagguucgcuaccgucguggaagaacuauuucgggauggcguuaauugggggcgcaucguggccuucuuugaguucggaggugucaugugcguggagucaguaaaccgagagaugagcccacucguugacaauauugcgcuguggaugacagaauaucuuaacagacaucugcacaccuggauccaagauaauggcgggugggacgccuuuguggaguuguacggacccaguaugaggccucucuucgauuuuuccuggcugucucugaagacucucuuaagccuggcacuugucggcgcuuguauuacauugggugccuaucugucccacaaauga

SEQ ID NO: 550 - RNA, 720 nt, Artificial Sequence
  derived and/or modified sequence opt4 from BCL-2__Homo_sapiens__ABX60202
auggcccacgccggcagaaccggcuacgacaacagagagaucgugaugaaguacauccacuacaagcugagccagagaggcuacgagugggacgccggcgacgugggcgccgccccccccggcgccgcccccgcccccggcaucuucagcagccagcccggccacaccccccaccccgccgccagcagagaccccguggccagaaccagcccccugcagacccccgccgcccccggcgccgccgccggccccgcccugagccccgugccccccguggugcaccugacccugagacaggccggcgacgacuucagcagaagauacagaagagacuucgccgagaugagcagccagcugcaccugacccccuucaccgccagaggcagauucgccaccgugguggaggagcuguucagagacggcgugaacuggggcagaaucguggccuucuucgaguucggcggcgugaugugcguggagagcgugaacagagagaugagcccccugguggacaacaucgcccuguggaugaccgaguaccugaacagacaccugcacaccuggauccaggacaacggcggcugggacgccuucguggagcuguacggccccagcaugagaccccuguucgacuucagcuggcugagccugaagacccugcugagccuggcccuggugggcgccugcaucacccugggcgccuaccugagccacaaguga

SEQ ID NO: 551 - RNA, 720 nt, Artificial Sequence
  derived and/or modified sequence opt5 from BCL-2__Homo_sapiens__ABX60202
auggcccacgcuggcagaaccggguacgacaaccgggagaucgugaugaaguauauucauuacaaacugagccagcgcggauaugaaugggaugccggcgacgucggggcggcucccccuggagccgccccggcucccggcaucuucuccucucaaccugggcacacaccccauccugccgcuagcagagaucccguugcccggacguccccucuccagaccccggcggcccccggagcugccgcuggcccugcccugucucccgugccucccgugguccaccuuacacugcgccaggcgggcgacgauuuuagcagacgguaccgcagagacuucgccgagauguccucucagcuccaucugaccccguuuacagcucgggggcgcuucgccaccgugguugaagaacuuuuuagagauggagugaauuggggccggauugucgcuuucuuugaguucgggggagugaugugcguugagagcgugaaccgcgagauguccccucuggucgacaauaucgcccucuggaugacagaauaucugaacagacaucugcacaccuggauucaagauaauggcgggugggacgccuuuguggagcucuacggacccagcaugcggccucuguucgauuuuucuuggcuuucccugaagacgcuccugagccuugcucuggugggcgcguguaucacccucggcgccuaucugucucacaaauga

SEQ ID NO: 552 - protein, 429 aa, Artificial Sequence [sequence omitted]

SEQ ID NO: 553 - RNA, 1290 nt, Artificial Sequence
  bcr/abl__Homo_sapiens__ABX82700
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagaugguggauga

SEQ ID NO: 554 - RNA, 1290 nt, Artificial Sequence
  derived and/or modified sequence opt1 from bcr/abl__Homo_sapiens__ABX82700
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcggcuga

SEQ ID NO: 555 - RNA, 1290 nt, Artificial Sequence
  derived and/or modified sequence opt2 from bcr/abl__Homo_sapiens__ABX82700
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcggcuga

SEQ ID NO: 556 - RNA, 1290 nt, Artificial Sequence
  derived and/or modified sequence opt3 from bcr/abl__Homo_sapiens__ABX82700
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguggcuga

SEQ ID NO: 557 - RNA, 1290 nt, Artificial Sequence
  derived and/or modified sequence opt4 from bcr/abl__Homo_sapiens__ABX82700
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcggcuga

SEQ ID NO: 558 - RNA, 1290 nt, Artificial Sequence
  derived and/or modified sequence opt5 from bcr/abl__Homo_sapiens__ABX82700
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaggcuga

SEQ ID NO: 559 - protein, 554 aa, Artificial Sequence [sequence omitted]

SEQ ID NO: 560 - RNA, 1665 nt, Artificial Sequence
  bcr/abl__Homo_sapiens__ABX82703
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagauggcucguucggaacaccaccuggauacggcugcgcugcagaccgggcagaggagcagcgccggcaccaagaugggcugcccuacauugaugacucgcccuccucaucgccccaccucagcagcaagggcaggggcagccgggaugcgcuggucucgggagcccuggaguccacuaaagcgagugagcuggacuuggaaaagggcuuggagaugagaaaauggguccugucgggaauccuggcuagcgaggagacuuaccugagccaccuggaggcacugcugcugcccaugaagccuuugaaagccgcugccaccaccucucagccggugcugacgagucagcagaucgagaccaucuucuucaaagugccugaucuccucuga

SEQ ID NO: 561 - RNA, 1665 nt, Artificial Sequence
  derived and/or modified sequence opt1 from bcr/abl__Homo_sapiens__ABX82703
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagcuucggcaccccgcccggguacggcugcgccgcggaccgggccgaggagcagcgccgccaccaggacgggcugcccuacaucgacgacucccccagcuccagcccccaccuguccagcaagggccggggcucccgcgacgcccucgucagcggggcccuggaguccaccaaggccagcgagcuggaccucgagaagggccuggagaugcggaagugggugcugagcgggauccucgcguccgaggagaccuaccugagccaccuggaggcccuccugcugcccaugaagccccucaaggccgccgccacgaccucccagccggugcugaccagccagcagaucgagaccaucuucuucaagguccccgaccugcucuga

SEQ ID NO: 562 - RNA, 1665 nt, Artificial Sequence
  derived and/or modified sequence opt2 from bcr/abl__Homo_sapiens__ABX82703
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcuccuucggcaccccccccggcuacggcugcgccgccgaccgcgccgaggagcagcgccgccaccaggacggccuccccuacaucgacgacucccccuccuccuccccccaccucuccuccaagggccgcggcucccgcgacgcccucgucuccggcgcccucgaguccaccaaggccuccgagcucgaccucgagaagggccucgagaugcgcaaguggguccucuccggcauccucgccuccgaggagaccuaccucucccaccucgaggcccuccuccuccccaugaagccccucaaggccgccgccaccaccucccagcccguccucaccucccagcagaucgagaccaucuucuucaagguccccgaccuccucuga

SEQ ID NO: 563 - RNA, 1665 nt, Artificial Sequence
  derived and/or modified sequence opt3 from bcr/abl__Homo_sapiens__ABX82703
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuuggcacaccacccggguacggaugcgccgcugaccgggccgaggaacagcguagacaucaggacggcuuaccuuauaucgaugacucucccagcuccucaccacaccugagcucuaaggguagggggucccgcgaugcacuuguuaguggcgccuuggagagcaccaaggcuucugaacuggaccuagagaaaggacucgaaaugcggaaaugggugcuguccggcauucuugccucagaggaaacguaccugagucauuuggaggcacuccuguuaccuaugaagccccugaaggcggcugccacuaccagccaaccaguacucacaucgcagcagaucgagacuauuuucuucaaagugccggaucuucuguga

SEQ ID NO: 564 - RNA, 1665 nt, Artificial Sequence
  derived and/or modified sequence opt4 from bcr/abl__Homo_sapiens__ABX82703
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagcuucggcaccccccccggcuacggcugcgccgccgacagagccgaggagcagagaagacaccaggacggccugcccuacaucgacgacagccccagcagcagcccccaccugagcagcaagggcagaggcagcagagacgcccuggugagcggcgcccuggagagcaccaaggccagcgagcuggaccuggagaagggccuggagaugagaaagugggugcugagcggcauccuggccagcgaggagaccuaccugagccaccuggaggcccugcugcugcccaugaagccccugaaggccgccgccaccaccagccagcccgugcugaccagccagcagaucgagaccaucuucuucaaggugcccgaccugcuguga

SEQ ID NO: 565 - RNA, 1665 nt, Artificial Sequence
  derived and/or modified sequence opt5 from bcr/abl__Homo_sapiens__ABX82703
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucuuuuggcacacccccuggguacggaugcgccgccgaccgggcugaggaacagagacgccaucaggacggccugcccuauaucgaugacuccccuagcucuagcccccaccuuuccucuaaggggagaggaagccgggaugcccugguguccggcgcucucgagagcaccaaagccucugaacuggaccuggagaaggggcucgaaaugcgcaaauggguccuguccggcauucuugcgagcgaggaaaccuaccugucccaucucgaggcccugcuucugccuaugaagccccucaaggcugccgcuacaaccucucaaccggugcugacgagccagcagaucgagacaauuuucuucaaaguuccugaucugcucuga

SEQ ID NO: 566 - protein, 514 aa, Artificial Sequence [sequence omitted]

SEQ ID NO: 567 - RNA, 1545 nt, Artificial Sequence
  bcr/abl__Homo_sapiens__ABX82704
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagauggcucguucggaacaccaccuggauacggcugcgcugcagaccgggcagaggagcagcgccggcaccaagaugggcugcccuacauugaugacucgcccuccucaucgccccaccucagcagcaagggcaggggcagccgggaugcgcuggucucgggagcccuggaguccacuaaagcgagugagcuggacuuggaaaagggcuuggagaugagaaaauggguccugucgggaauccuggcuagcgaggagauaacacucuaa

SEQ ID NO: 568 - RNA, 1545 nt, Artificial Sequence
  derived and/or modified sequence opt1 from bcr/abl__Homo_sapiens__ABX82704
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagcuucggcaccccgcccggguacggcugcgccgcggaccgggccgaggagcagcgccgccaccaggacgggcugcccuacaucgacgacucccccagcuccagcccccaccuguccagcaagggccggggcucccgcgacgcccucgucagcggggcccuggaguccaccaaggccagcgagcuggaccucgagaagggccuggagaugcggaagugggugcugagcgggauccucgcguccgaggagaucacccuguga

SEQ ID NO: 569 - RNA, 1545 nt, Artificial Sequence
  derived and/or modified sequence opt2 from bcr/abl__Homo_sapiens__ABX82704
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcuccuucggcaccccccccggcuacggcugcgccgccgaccgcgccgaggagcagcgccgccaccaggacggccuccccuacaucgacgacucccccuccuccuccccccaccucuccuccaagggccgcggcucccgcgacgcccucgucuccggcgcccucgaguccaccaaggccuccgagcucgaccucgagaagggccucgagaugcgcaaguggguccucuccggcauccucgccuccgaggagaucacccucuga

SEQ ID NO: 570 - RNA, 1545 nt, Artificial Sequence
  derived and/or modified sequence opt3 from bcr/abl__Homo_sapiens__ABX82704
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuuggcacaccacccggguacggaugcgccgcugaccgggccgaggaacagcguagacaucaggacggcuuaccuuauaucgaugacucucccagcuccucaccacaccugagcucuaaggguagggggucccgcgaugcacuuguuaguggcgccuuggagagcaccaaggcuucugaacuggaccuagagaaaggacucgaaaugcggaaaugggugcuguccggcauucuugccucagaggaaaucacgcuguga

SEQ ID NO: 571 - RNA, 1545 nt, Artificial Sequence
  derived and/or modified sequence opt4 from bcr/abl__Homo_sapiens__ABX82704
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagcuucggcaccccccccggcuacggcugcgccgccgacagagccgaggagcagagaagacaccaggacggccugcccuacaucgacgacagccccagcagcagcccccaccugagcagcaagggcagaggcagcagagacgcccuggugagcggcgcccuggagagcaccaaggccagcgagcuggaccuggagaagggccuggagaugagaaagugggugcugagcggcauccuggccagcgaggagaucacccuguga

SEQ ID NO: 572 - RNA, 1545 nt, Artificial Sequence
  derived and/or modified sequence opt5 from bcr/abl__Homo_sapiens__ABX82704
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucuuuuggcacacccccuggguacggaugcgccgccgaccgggcugaggaacagagacgccaucaggacggccugcccuauaucgaugacuccccuagcucuagcccccaccuuuccucuaaggggagaggaagccgggaugcccugguguccggcgcucucgagagcaccaaagccucugaacuggaccuggagaaggggcucgaaaugcgcaaauggguccuguccggcauucuugcgagcgaggaaaucacccuguga

SEQ ID NO: 573 - protein, 441 aa, Artificial Sequence
  bcr/abl__Homo_sapiens__A9UEZ9
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSLELQGKPSRWTQ

SEQ ID NO: 574 - RNA, 1326 nt, Artificial Sequence
  bcr/abl__Homo_sapiens__ABX82705
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagauggcucguuggaacuccaaggaaaaccuucucgcuggacccaguga

SEQ ID NO: 575 - RNA, 1326 nt, Artificial Sequence
  derived and/or modified sequence opt1 from bcr/abl__Homo_sapiens__ABX82705
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagccuggagcugcagggcaagcccucccgguggacccaguga

SEQ ID NO: 576 - RNA, 1326 nt, Artificial Sequence
  derived and/or modified sequence opt2 from bcr/abl__Homo_sapiens__ABX82705
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcucccucgagcuccagggcaagcccucccgcuggacccaguga

SEQ ID NO: 577 - RNA, 1326 nt, Artificial Sequence
  derived and/or modified sequence opt3 from bcr/abl__Homo_sapiens__ABX82705
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuagaacugcagggcaagccaucucgguggacacaguga

SEQ ID NO: 578 - RNA, 1326 nt, Artificial Sequence
  derived and/or modified sequence opt4 from bcr/abl__Homo_sapiens__ABX82705
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagccuggagcugcagggcaagcccagcagauggacccaguga

SEQ ID NO: 579 - RNA, 1326 nt, Artificial Sequence
  derived and/or modified sequence opt5 from bcr/abl__Homo_sapiens__ABX82705
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucucuggaacuucagggcaagcccucccgguggacccaguga

SEQ ID NO: 580 - protein, 524 aa, Artificial Sequence
  bcr/abl__Homo_sapiens__A9UF00
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWDPVKMTPTFSLHCMILWPVEITL

SEQ ID NO: 581 - RNA, 1575 nt, Artificial Sequence
  bcr/abl__Homo_sapiens__ABX82706
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagauggcucguucggaacaccaccuggauacggcugcgcugcagaccgggcagaggagcagcgccggcaccaagaugggcugcccuacauugaugacucgcccuccucaucgccccaccucagcagcaagggcaggggcagccgggaugcgcuggucucgggagcccuggaguccacuaaagcgagugagcuggacuuggaaaagggcuuggagaugagaaaaugggacccagugaaaaugaccccaaccuuuucguugcacuguaugauuuuguggccaguggagauaacacucuaa

SEQ ID NO: 582 - RNA, 1575 nt, Artificial Sequence
  derived and/or modified sequence opt1 from bcr/abl__Homo_sapiens__ABX82706
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagcuucggcaccccgcccggguacggcugcgccgcggaccgggccgaggagcagcgccgccaccaggacgggcugcccuacaucgacgacucccccagcuccagcccccaccuguccagcaagggccggggcucccgcgacgcccucgucagcggggcccuggaguccaccaaggccagcgagcuggaccucgagaagggccuggagaugcggaagugggaccccgugaagaugacccccacguucagccugcacugcaugauccucuggccgguggagaucacccuguga

SEQ ID NO: 583 - RNA, 1575 nt, Artificial Sequence
  derived and/or modified sequence opt2 from bcr/abl__Homo_sapiens__ABX82706
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcuccuucggcaccccccccggcuacggcugcgccgccgaccgcgccgaggagcagcgccgccaccaggacggccuccccuacaucgacgacucccccuccuccuccccccaccucuccuccaagggccgcggcucccgcgacgcccucgucuccggcgcccucgaguccaccaaggccuccgagcucgaccucgagaagggccucgagaugcgcaagugggaccccgucaagaugacccccaccuucucccuccacugcaugauccucuggcccgucgagaucacccucuga

SEQ ID NO: 584 - RNA, 1575 nt, Artificial Sequence
  derived and/or modified sequence opt3 from bcr/abl__Homo_sapiens__ABX82706
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuuggcacaccacccggguacggaugcgccgcugaccgggccgaggaacagcguagacaucaggacggcuuaccuuauaucgaugacucucccagcuccucaccacaccugagcucuaaggguagggggucccgcgaugcacuuguuaguggcgccuuggagagcaccaaggcuucugaacuggaccuagagaaaggacucgaaaugcggaaaugggauccugugaagaugacgcccacuuucucccugcauuguaugauucuuuggccaguagagaucacccuguga

SEQ ID NO: 585 - RNA, 1575 nt, Artificial Sequence
  derived and/or modified sequence opt4 from bcr/abl__Homo_sapiens__ABX82706
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagcuucggcaccccccccggcuacggcugcgccgccgacagagccgaggagcagagaagacaccaggacggccugcccuacaucgacgacagccccagcagcagcccccaccugagcagcaagggcagaggcagcagagacgcccuggugagcggcgcccuggagagcaccaaggccagcgagcuggaccuggagaagggccuggagaugagaaagugggaccccgugaagaugacccccaccuucagccugcacugcaugauccuguggcccguggagaucacccuguga

SEQ ID NO: 586 - RNA, 1575 nt, Artificial Sequence
  derived and/or modified sequence opt5 from bcr/abl__Homo_sapiens__ABX82706
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucuuuuggcacacccccuggguacggaugcgccgccgaccgggcugaggaacagagacgccaucaggacggccugcccuauaucgaugacuccccuagcucuagcccccaccuuuccucuaaggggagaggaagccgggaugcccugguguccggcgcucucgagagcaccaaagccucugaacuggaccuggagaaggggcucgaaaugcgcaaaugggauccugucaagaugacccccacauucucccugcauuguaugauucuuuggccgguggagaucacccuguga

SEQ ID NO: 587 - protein, 465 aa, Artificial Sequence
  bcr/abl__Homo_sapiens__A9UF01
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGEHPGAAEEVFQKLLPDIRGAADADQLVCETPDCPQHSADHQ

SEQ ID NO: 588 - RNA, 1398 nt, Artificial Sequence
  bcr/abl__Homo_sapiens__ABX82707
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagaacauccgggagcagcagaagaaguguuucagaagcuucucccugacauccguggagcugcagaugcugaccaacucgugugugaaacuccagacuguccacagcauuccgcugaccaucaauaa

SEQ ID NO: 589 - RNA, 1398 nt, Artificial Sequence
  derived and/or modified sequence opt1 from bcr/abl__Homo_sapiens__ABX82707
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggagcaccccggcgccgccgaggaggucuuccagaagcugcugcccgacauccggggcgcggccgacgccgaccagcucgugugcgagacccccgacugcccgcagcacagcgccgaccaccaguga

SEQ ID NO: 590 - RNA, 1398 nt, Artificial Sequence
  derived and/or modified sequence opt2 from bcr/abl__Homo_sapiens__ABX82707
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgagcaccccggcgccgccgaggaggucuuccagaagcuccuccccgacauccgcggcgccgccgacgccgaccagcucgucugcgagacccccgacugcccccagcacuccgccgaccaccaguga

SEQ ID NO: 591 - RNA, 1398 nt, Artificial Sequence
  derived and/or modified sequence opt3 from bcr/abl__Homo_sapiens__ABX82707
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagaacauccaggugcagccgaggagguuuuucagaaguuacugcccgacauccggggcgcugccgaugcagaccagcuugugugcgaaacaccugacuguccccaacacagugccgaucaucaguga

SEQ ID NO: 592 - RNA, 1398 nt, Artificial Sequence
  derived and/or modified sequence opt4 from bcr/abl__Homo_sapiens__ABX82707
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgagcaccccggcgccgccgaggagguguuccagaagcugcugcccgacaucagaggcgccgccgacgccgaccagcuggugugcgagacccccgacugcccccagcacagcgccgaccaccaguga

SEQ ID NO: 593 - RNA, 1398 nt, Artificial Sequence
  derived and/or modified sequence opt5 from bcr/abl__Homo_sapiens__ABX82707
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgaacaucccggagcugccgaggagguguuucagaagcugcuuccugacauccggggcgccgcugaugccgaccagcuggucugcgaaacccccgacuguccucaacacucugcugaucaucaguga

SEQ ID NO: 594 - protein, 458 aa, Artificial Sequence
  bcr/abl__Homo_sapiens__A9UF03
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYCCLCLPAWPSGCTAATARVTRS

SEQ ID NO: 595 - RNA, 1377 nt, Artificial Sequence
  bcr/abl__Homo_sapiens__ABX82709
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagauggcucguucggaacaccaccuggauacugcugcuuaugucucccagcauggccuucagggugcacagccgcaacggcaagaguuacacguuccuga

SEQ ID NO: 596 - RNA, 1377 nt, Artificial Sequence
  derived and/or modified sequence opt1 from bcr/abl__Homo_sapiens__ABX82709
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagcuucggcaccccgcccggguacugcugccugugccugcccgccuggcccuccggcugcaccgcggccaccgcccgggucacgcgcagcuga

SEQ ID NO: 597 - RNA, 1377 nt, Artificial Sequence
  derived and/or modified sequence opt2 from bcr/abl__Homo_sapiens__ABX82709
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcuccuucggcaccccccccggcuacugcugccucugccuccccgccuggcccuccggcugcaccgccgccaccgcccgcgucacccgcuccuga

SEQ ID NO: 598 - RNA, 1377 nt, Artificial Sequence
  derived and/or modified sequence opt3 from bcr/abl__Homo_sapiens__ABX82709
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuuggcacaccacccggguacugcuguuuaugccugccugccuggcccucuggauguaccgcugccacggcacggguuacucguagcuga

SEQ ID NO: 599 - RNA, 1377 nt, Artificial Sequence
  derived and/or modified sequence opt4 from bcr/abl__Homo_sapiens__ABX82709
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagcuucggcaccccccccggcuacugcugccugugccugcccgccuggcccagcggcugcaccgccgccaccgccagagugaccagaagcuga

SEQ ID NO: 600 - RNA, 1377 nt, Artificial Sequence
  derived and/or modified sequence opt5 from bcr/abl__Homo_sapiens__ABX82709
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucuuuuggcacacccccuggguacugcugucugugccuucccgccuggccuuccggauguaccgccgcuaccgcccgggugacaagaagcuga

SEQ ID NO: 601 - protein, 454 aa, Artificial Sequence
  bcr/abl__Homo_sapiens__A9UF04
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAAGRPPHLTELPVQHQ

SEQ ID NO: 602 - RNA, 1365 nt, Artificial Sequence
  bcr/abl__Homo_sapiens__ABX82710
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagauggcucguucggaacaccaccuggauacggcugcgcugcaggacgcccuccgcaucucacagaacuuccuguccagcaucaauga

SEQ ID NO: 603 - RNA, 1365 nt, Artificial Sequence
  derived and/or modified sequence opt1 from bcr/abl__Homo_sapiens__ABX82710
augguggaccccgucggcuucgccgaggccuggaaggcgcaguuccccgacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagcuucggcaccccgcccggguacggcugcgccgcggggcggccgccccaccugaccgagcugcccguccagcaccaguga

SEQ ID NO: 604 - RNA, 1365 nt, Artificial Sequence
  derived and/or modified sequence opt2 from bcr/abl__Homo_sapiens__ABX82710
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcuccuucggcaccccccccggcuacggcugcgccgccggccgccccccccaccucaccgagcuccccguccagcaccaguga

SEQ ID NO: 605 - RNA, 1365 nt, Artificial Sequence
  derived and/or modified sequence opt3 from bcr/abl__Homo_sapiens__ABX82710
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuuggcacaccacccggguacggaugcgccgcuggccggccuccccauuuaaccgaacugccaguucagcaccaguga

SEQ ID NO: 606 - RNA, 1365 nt, Artificial Sequence
  derived and/or modified sequence opt4 from bcr/abl__Homo_sapiens__ABX82710
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagcuucggcaccccccccggcuacggcugcgccgccggcagacccccccaccugaccgagcugcccgugcagcaccaguga

SEQ ID NO: 607 - RNA, 1365 nt, Artificial Sequence
  derived and/or modified sequence opt5 from bcr/abl__Homo_sapiens__ABX82710
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucuuuuggcacacccccuggguacggaugcgccgccggccggcccccucaucugaccgaacuucccgugcagcaccaguga

SEQ ID NO: 608 - protein, 467 aa, Artificial Sequence
  bcr/abl__Homo_sapiens__A9UF05
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAVLKTEVPHQGVRRARLSLEALGEDPSFLFPASDGPRHSSTW

SEQ ID NO: 609 - RNA, 1404 nt, Artificial Sequence
  bcr/abl__Homo_sapiens__ABX82711
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcaguucugaagacugaagucccacaucaagguguccgcagggccaggcugucucuggaggcucuaggggaggauccuuccuuucuguucccagcaucugauggcccacggcauuccucgaccugguga

SEQ ID NO: 610 - RNA, 1404 nt, Artificial Sequence
  derived and/or modified sequence opt1 from bcr/abl__Homo_sapiens__ABX82711
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccguccugaagaccgaggugccccaccagggcgugcggcgcgcccgccugagccucgaggcgcugggcgaggaccccuccuuccuguuccccgccagcgacgggccgcggcacuccagcaccugguga

SEQ ID NO: 611 - RNA, 1404 nt, Artificial Sequence
  derived and/or modified sequence opt2 from bcr/abl__Homo_sapiens__ABX82711
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccguccucaagaccgaggucccccaccagggcguccgccgcgcccgccucucccucgaggcccucggcgaggaccccuccuuccucuuccccgccuccgacggcccccgccacuccuccaccugguga

SEQ ID NO: 612 - RNA, 1404 nt, Artificial Sequence
  derived and/or modified sequence opt3 from bcr/abl__Homo_sapiens__ABX82711
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcaguuuuaaagacagaagugccacaucaggguguacggcgugccagacugagucuugaggcuuugggcgaggaucccucuuuucuguucccugccagcgacgggcccaggcacuccucaaccugguga

SEQ ID NO: 613 - RNA, 1404 nt, Artificial Sequence
  derived and/or modified sequence opt4 from bcr/abl__Homo_sapiens__ABX82711
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgugcugaagaccgaggugccccaccagggcgugagaagagccagacugagccuggaggcccugggcgaggaccccagcuuccuguuccccgccagcgacggccccagacacagcagcaccugguga

SEQ ID NO: 614 - RNA, 1404 nt, Artificial Sequence
  derived and/or modified sequence opt5 from bcr/abl__Homo_sapiens__ABX82711
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugugcugaagaccgaagucccccaucagggagugcggagagcccgccuuucucuggaggcccucggcgaggauccuuccuuucuguuccccgcuagcgacgggccuagacacucuuccacaugguga

SEQ ID NO: 615 - protein, 513 aa, Artificial Sequence
  bcr/abl__Homo_sapiens__A9UF06
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDPVKMTPTFSLHCMILWPVEITL

SEQ ID NO: 616 - RNA, 1542 nt, Artificial Sequence
  bcr/abl__Homo_sapiens__ABX82712
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccaucgugggcguccgcaagaccgggcagaucuggcccaacgauggcgagggcgccuuccauggagacgcagauggcucguucggaacaccaccuggauacggcugcgcugcagaccgggcagaggagcagcgccggcaccaagaugggcugcccuacauugaugacucgcccuccucaucgccccaccucagcagcaagggcaggggcagccgggaugcgcuggucucgggagcccuggaguccacuaaagcgagugagcuggacccagugaaaaugaccccaaccuuuucguugcacuguaugauuuuguggccaguggagauaacacucuaa

SEQ ID NO: 617 - RNA, 1542 nt, Artificial Sequence
  derived and/or modified sequence opt1 from bcr/abl__Homo_sapiens__ABX82712
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagcuucggcaccccgcccggguacggcugcgccgcggaccgggccgaggagcagcgccgccaccaggacgggcugcccuacaucgacgacucccccagcuccagcccccaccuguccagcaagggccggggcucccgcgacgcccucgucagcggggcccuggaguccaccaaggccagcgagcuggaccccgugaagaugacccccacguucagccuccacugcaugauccuguggccgguggagaucacccuguga

SEQ ID NO: 618 - RNA, 1542 nt, Artificial Sequence
  derived and/or modified sequence opt2 from bcr/abl__Homo_sapiens__ABX82712
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcuccuucggcaccccccccggcuacggcugcgccgccgaccgcgccgaggagcagcgccgccaccaggacggccuccccuacaucgacgacucccccuccuccuccccccaccucuccuccaagggccgcggcucccgcgacgcccucgucuccggcgcccucgaguccaccaaggccuccgagcucgaccccgucaagaugacccccaccuucucccuccacugcaugauccucuggcccgucgagaucacccucuga

SEQ ID NO: 619 - RNA, 1542 nt, Artificial Sequence
  derived and/or modified sequence opt3 from bcr/abl__Homo_sapiens__ABX82712
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuuggcacaccacccggguacggaugcgccgcugaccgggccgaggaacagcguagacaucaggacggcuuaccuuauaucgaugacucucccagcuccucaccacaccugagcucuaaggguagggggucccgcgaugcacuuguuaguggcgccuuggagagcaccaaggcuucugaacuggacccugugaaaaugacgcccacuuucucccuacauuguaugauucucuggccaguagagaucacccuguga

SEQ ID NO: 620 - RNA, 1542 nt, Artificial Sequence
  derived and/or modified sequence opt4 from bcr/abl__Homo_sapiens__ABX82712
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccaucgugggcgugagaaagaccggccagaucuggcccaacgacggcgagggcgccuuccacggcgacgccgacggcagcuucggcaccccccccggcuacggcugcgccgccgacagagccgaggagcagagaagacaccaggacggccugcccuacaucgacgacagccccagcagcagcccccaccugagcagcaagggcagaggcagcagagacgcccuggugagcggcgcccuggagagcaccaaggccagcgagcuggaccccgugaagaugacccccaccuucagccugcacugcaugauccuguggcccguggagaucacccuguga

SEQ ID NO: 621 - RNA, 1542 nt, Artificial Sequence
  derived and/or modified sequence opt5 from bcr/abl__Homo_sapiens__ABX82712
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucuuuuggcacacccccuggguacggaugcgccgccgaccgggcugaggaacagagacgccaucaggacggccugcccuauaucgaugacuccccuagcucuagcccccaccuuuccucuaaggggagaggaagccgggaugcccugguguccggcgcucucgagagcaccaaagccucugaacuggacccugucaagaugacccccacauucucccugcauuguaugauucucuggccgguggagaucacccuguga

SEQ ID NO: 622 - protein, 406 aa, Artificial Sequence [sequence omitted]

SEQ ID NO: 623 - RNA, 1221 nt, Artificial Sequence
  bcr/abl__Homo_sapiens__ABX82714
augguggacccggugggcuucgcggaggcguggaaggcgcaguucccggacucagagcccccgcgcauggagcugcgcucagugggcgacaucgagcaggagcuggagcgcugcaaggccuccauucggcgccuggagcaggaggugaaccaggagcgcuuccgcaugaucuaccugcagacguugcuggccaaggaaaagaagagcuaugaccggcagcgauggggcuuccggcgcgcggcgcaggcccccgacggcgccuccgagccccgagcguccgcgucgcgcccgcagccagcgcccgccgacggagccgacccgccgcccgccgaggagcccgaggcccggcccgacggcgaggguucuccggguaaggccaggcccgggaccgcccgcaggcccggggcagccgcgucgggggaacgggacgaccggggaccccccgccagcguggcggcgcucagguccaacuucgagcggauccgcaagggccauggccagcccggggcggacgccgagaagcccuucuacgugaacgucgaguuucaccacgagcgcggccuggugaaggucaacgacaaagaggugucggaccgcaucagcucccugggcagccaggccaugcagauggagcgcaaaaagucccagcacggcgcgggcucgagcgugggggaugcauccaggcccccuuaccggggacgcuccucggagagcagcugcggcgucgacggcgacuacgaggacgccgaguugaacccccgcuuccugaaggacaaccugaucgacgccaauggcgguagcaggcccccuuggccgccccuggaguaccagcccuaccagagcaucuacgucgggggcaugauggaaggggagggcaagggcccgcuccugcgcagccagagcaccucugagcaggagaagcgccuuaccuggccccgcagguccuacuccccccggaguuuugaggauugcggaggcggcuauaccccggacugcagcuccaaugagaaccucaccuccagcgaggaggacuucuccucuggccaguccagccgcguguccccaagccccaccaccuaccgcauguuccgggacaaaagccgcucucccucgcagaacucgcaacaguccuucgacagcagcaguccccccacgccgcagugccauaagcggcaccggcacugcccgguugucguguccgaggccaccagcggccaguag

SEQ ID NO: 624 - RNA, 1221 nt, Artificial Sequence
  derived and/or modified sequence opt1 from bcr/abl__Homo_sapiens__ABX82714
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccaccagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccagcgggcaguga

SEQ ID NO: 625 - RNA, 1221 nt, Artificial Sequence
  derived and/or modified sequence opt2 from bcr/abl__Homo_sapiens__ABX82714
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccuccggccaguga

SEQ ID NO: 626 - RNA, 1221 nt, Artificial Sequence
  derived and/or modified sequence opt3 from bcr/abl__Homo_sapiens__ABX82714
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaguggccaguga

SEQ ID NO: 627 - RNA, 1221 nt, Artificial Sequence
  derived and/or modified sequence opt4 from bcr/abl__Homo_sapiens__ABX82714
augguggaccccgugggcuucgccgaggccuggaaggcccaguuccccgacagcgagccccccagaauggagcugagaagcgugggcgacaucgagcaggagcuggagagaugcaaggccagcaucagaagacuggagcaggaggugaaccaggagagauucagaaugaucuaccugcagacccugcuggccaaggagaagaagagcuacgacagacagagauggggcuucagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcguggccgcccugagaagcaacuucgagagaaucagaaagggccacggccagcccggcgccgacgccgagaagcccuucuacgugaacguggaguuccaccacgagagaggccuggugaaggugaacgacaaggaggugagcgacagaaucagcagccugggcagccaggccaugcagauggagagaaagaagagccagcacggcgccggcagcagcgugggcgacgccagcagaccccccuacagaggcagaagcagcgagagcagcugcggcguggacggcgacuacgaggacgccgagcugaaccccagauuccugaaggacaaccugaucgacgccaacggcggcagcagaccccccuggcccccccuggaguaccagcccuaccagagcaucuacgugggcggcaugauggagggcgagggcaagggcccccugcugagaagccagagcaccagcgagcaggagaagagacugaccuggcccagaagaagcuacagccccagaagcuucgaggacugcggcggcggcuacacccccgacugcagcagcaacgagaaccugaccagcagcgaggaggacuucagcagcggccagagcagcagagugagccccagccccaccaccuacagaauguucagagacaagagcagaagccccagccagaacagccagcagagcuucgacagcagcagcccccccaccccccagugccacaagagacacagacacugccccgugguggugagcgaggccaccagcggccaguga

SEQ ID NO: 628 - RNA, 1221 nt, Artificial Sequence
  derived and/or modified sequence opt5 from bcr/abl__Homo_sapiens__ABX82714
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccucugggcaguga

SEQ ID NO: 629 - protein, 781 aa, Artificial Sequence
  beta-catenin/m__Homo_sapiens__P35222
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 630 - RNA, 2346 nt, Artificial Sequence
  beta-catenin/m__Homo_sapiens__AAH58926
auggcuacucaagcugauuugauggaguuggacauggccauggaaccagacagaaaagcggcuguuagucacuggcagcaacagucuuaccuggacucuggaauccauucuggugccacuaccacagcuccuucucugagugguaaaggcaauccugaggaagaggauguggauaccucccaaguccuguaugagugggaacagggauuuucucaguccuucacucaagaacaaguagcugauauugauggacaguaugcaaugacucgagcucagaggguacgagcugcuauguucccugagacauuagaugagggcaugcagaucccaucuacacaguuugaugcugcucaucccacuaauguccagcguuuggcugaaccaucacagaugcugaaacaugcaguuguaaacuugauuaacuaucaagaugaugcagaacuugccacacgugcaaucccugaacugacaaaacugcuaaaugacgaggaccagguggugguuaauaaggcugcaguuaugguccaucagcuuucuaaaaaggaagcuuccagacacgcuaucaugcguucuccucagauggugucugcuauuguacguaccaugcagaauacaaaugauguagaaacagcucguuguaccgcugggaccuugcauaaccuuucccaucaucgugagggcuuacuggccaucuuuaagucuggaggcauuccugcccuggugaaaaugcuugguucaccaguggauucuguguuguuuuaugccauuacaacucuccacaaccuuuuauuacaucaagaaggagcuaaaauggcagugcguuuagcuggugggcugcagaaaaugguugccuugcucaacaaaacaaauguuaaauucuuggcuauuacgacagacugccuucaaauuuuagcuuauggcaaccaagaaagcaagcucaucauacuggcuagugguggaccccaagcuuuaguaaauauaaugaggaccuauacuuacgaaaaacuacuguggaccacaagcagagugcugaaggugcuaucugucugcucuaguaauaagccggcuauuguagaagcugguggaaugcaagcuuuaggacuucaccugacagauccaagucaacgucuuguucagaacugucuuuggacucucaggaaucuuucagaugcugcaacuaaacaggaagggauggaaggucuccuugggacucuuguucagcuucuggguucagaugauauaaauguggucaccugugcagcuggaauucuuucuaaccucacuugcaauaauuauaagaacaagaugauggucugccaagugggugguauagaggcucuugugcguacuguccuucgggcuggugacagggaagacaucacugagccugccaucugugcucuucgucaucugaccagccgacaccaagaagcagagauggcccagaaugcaguucgccuucacuauggacuaccaguugugguuaagcucuuacacccaccaucccacuggccucugauaaaggcuacuguuggauugauucgaaaucuugcccuuugucccgcaaaucaugcaccuuugcgugagcagggugccauuccacgacuaguucaguugcuuguucgugcacaucaggauacccagcgccguacguccaugggugggacacagcagcaauuuguggaggggguccgcauggaagaaauaguugaagguuguaccggagcccuucacauccuagcucgggauguucacaaccgaauuguuaucagaggacuaaauaccauuccauuguuugugcagcugcuuuauucucccauugaaaacauccaaagaguagcugcagggguccucugugaacuugcucaggacaaggaagcugcagaagcuauugaagcugagggagccacagcuccucugacagaguuacuucacucuaggaaugaagguguggcgacauaugcagcugcuguuuuguuccgaaugucugaggacaagccacaagauuacaagaaacggcuuucaguugagcugaccagcucucucuucagaacagagccaauggcuuggaaugagacugcugaucuuggacuugauauuggugcccagggagaaccccuuggauaucgccaggaugauccuagcuaucguucuuuucacucugguggauauggccaggaugccuuggguauggaccccaugauggaacaugagauggguggccaccacccuggugcugacuauccaguugaugggcugccagaucuggggcaugcccaggaccucauggaugggcugccuccaggugacagcaaucagcuggccugguuugauacugaccuguaa

SEQ ID NO: 631 - RNA, 2346 nt, Artificial Sequence
  derived and/or modified sequence opt1 from beta-catenin/m__Homo_sapiens__AAH58926
auggccacccaggccgaccugauggagcucgacauggcgauggagcccgaccgcaaggccgccgugagccacuggcagcagcaguccuaccuggacagcggcauccacuccggggccaccacgaccgcccccagccuguccggcaaggggaaccccgaggaggaggacgucgacaccagccaggugcucuacgagugggagcagggcuucucccagagcuucacccaggagcaggucgcggacaucgacgggcaguacgccaugacgcgggcccagcgcgugcgggccgcgauguuccccgagacccuggacgagggcaugcagauccccuccacccaguucgacgccgcccacccgaccaacgugcagcgccuggccgagcccagccagaugcucaagcacgccguggucaaccugaucaacuaccaggacgacgcggagcuggccacgcgggccauccccgagcucaccaagcugcugaacgacgaggaccaggugguggucaacaaggccgccgugauggugcaccagcucuccaagaaggaggcgagccgccacgccaucaugcggagcccccagauggucuccgccaucgugcgcaccaugcagaacaccaacgacguggagacggcccggugcaccgccggcacccugcacaaccugucccaccaccgcgaggggcuccuggcgaucuucaagagcggcgggaucccggcccuggucaagaugcucggcucccccguggacagcgugcuguucuacgccaucaccacgcugcacaaccuccugcugcaccaggagggggccaagauggccguccggcucgcgggcggccugcagaagaugguggcccugcucaacaagaccaacgugaaguuccuggccaucaccaccgacugccugcagauccucgccuacgggaaccaggaguccaagcugaucauccuggcgagcggcgggccccaggcccucgucaacaucaugcgcacguacaccuacgagaagcugcuguggaccaccagccgggugcucaaggugcuguccgucugcagcuccaacaagcccgccaucguggaggccggcggcaugcaggcccuggggcuccaccugacggacccgagccagcgccugguccagaacugccucuggacccugcggaaccuguccgacgcggccaccaagcaggagggcauggaggggcuccugggcacccuggugcagcuccuggggagcgacgacaucaacguggucacgugcgccgccggcauccuguccaaccugaccugcaacaacuacaagaacaagaugauggugugccaggugggcgggaucgaggcccucguccgcaccgugcugcgggcgggcgaccgcgaggacaucaccgagcccgccaucugcgcccugcggcaccucacgagccgccaccaggaggccgagauggcccagaacgcggugcggcugcacuacgggcugcccgucguggugaagcuccugcacccgcccucccacuggccccugaucaaggccaccgucggccucauccgcaaccuggcccugugccccgccaaccacgcgccccuccgcgagcagggggccaucccgcggcuggugcagcugcucgugcgcgcccaccaggacacccagcggcgcaccagcaugggcggcacgcagcagcaguucgucgagggggugcggauggaggagaucguggagggcugcaccggggcccugcacauccuggcccgcgacguccacaaccggaucgugauccgcggccucaacaccaucccccuguucgugcagcugcucuacucccccaucgagaacauccagcgggucgcggccggggugcugugcgagcuggcccaggacaaggaggccgccgaggcgaucgaggccgagggcgccaccgcgccccucaccgagcugcugcacagccgcaacgagggcguggccacguacgccgccgccguccucuuccggauguccgaggacaagccgcaggacuacaagaagcgccugagcguggagcugaccuccagccucuuccggaccgagcccauggccuggaacgagaccgcggaccuggggcuggacaucggcgcccagggggagccccucggcuaccgccaggacgaccccuccuaccggagcuuccacuccggcggguacggccaggacgcccuggggauggacccgaugauggagcacgagaugggcgggcaccaccccggcgccgacuaccccguggacggccugccggaccucgggcacgcccaggaccugauggacggccugccgcccggggacagcaaccagcucgcgugguucgacacggaccuguga

SEQ ID NO: 632 - RNA, 2346 nt, Artificial Sequence
  derived and/or modified sequence opt2 from beta-catenin/m__Homo_sapiens__AAH58926
auggccacccaggccgaccucauggagcucgacauggccauggagcccgaccgcaaggccgccgucucccacuggcagcagcaguccuaccucgacuccggcauccacuccggcgccaccaccaccgcccccucccucuccggcaagggcaaccccgaggaggaggacgucgacaccucccagguccucuacgagugggagcagggcuucucccaguccuucacccaggagcaggucgccgacaucgacggccaguacgccaugacccgcgcccagcgcguccgcgccgccauguuccccgagacccucgacgagggcaugcagauccccuccacccaguucgacgccgcccaccccaccaacguccagcgccucgccgagcccucccagaugcucaagcacgccgucgucaaccucaucaacuaccaggacgacgccgagcucgccacccgcgccauccccgagcucaccaagcuccucaacgacgaggaccaggucgucgucaacaaggccgccgucaugguccaccagcucuccaagaaggaggccucccgccacgccaucaugcgcuccccccagauggucuccgccaucguccgcaccaugcagaacaccaacgacgucgagaccgcccgcugcaccgccggcacccuccacaaccucucccaccaccgcgagggccuccucgccaucuucaaguccggcggcauccccgcccucgucaagaugcucggcucccccgucgacuccguccucuucuacgccaucaccacccuccacaaccuccuccuccaccaggagggcgccaagauggccguccgccucgccggcggccuccagaagauggucgcccuccucaacaagaccaacgucaaguuccucgccaucaccaccgacugccuccagauccucgccuacggcaaccaggaguccaagcucaucauccucgccuccggcggcccccaggcccucgucaacaucaugcgcaccuacaccuacgagaagcuccucuggaccaccucccgcguccucaagguccucuccgucugcuccuccaacaagcccgccaucgucgaggccggcggcaugcaggcccucggccuccaccucaccgaccccucccagcgccucguccagaacugccucuggacccuccgcaaccucuccgacgccgccaccaagcaggagggcauggagggccuccucggcacccucguccagcuccucggcuccgacgacaucaacgucgucaccugcgccgccggcauccucuccaaccucaccugcaacaacuacaagaacaagaugauggucugccaggucggcggcaucgaggcccucguccgcaccguccuccgcgccggcgaccgcgaggacaucaccgagcccgccaucugcgcccuccgccaccucaccucccgccaccaggaggccgagauggcccagaacgccguccgccuccacuacggccuccccgucgucgucaagcuccuccacccccccucccacuggccccucaucaaggccaccgucggccucauccgcaaccucgcccucugccccgccaaccacgccccccuccgcgagcagggcgccaucccccgccucguccagcuccucguccgcgcccaccaggacacccagcgccgcaccuccaugggcggcacccagcagcaguucgucgagggcguccgcauggaggagaucgucgagggcugcaccggcgcccuccacauccucgcccgcgacguccacaaccgcaucgucauccgcggccucaacaccaucccccucuucguccagcuccucuacucccccaucgagaacauccagcgcgucgccgccggcguccucugcgagcucgcccaggacaaggaggccgccgaggccaucgaggccgagggcgccaccgccccccucaccgagcuccuccacucccgcaacgagggcgucgccaccuacgccgccgccguccucuuccgcauguccgaggacaagccccaggacuacaagaagcgccucuccgucgagcucaccuccucccucuuccgcaccgagcccauggccuggaacgagaccgccgaccucggccucgacaucggcgcccagggcgagccccucggcuaccgccaggacgaccccuccuaccgcuccuuccacuccggcggcuacggccaggacgcccucggcauggaccccaugauggagcacgagaugggcggccaccaccccggcgccgacuaccccgucgacggccuccccgaccucggccacgcccaggaccucauggacggccucccccccggcgacuccaaccagcucgccugguucgacaccgaccucuga

SEQ ID NO: 633 - RNA, 2346 nt, Artificial Sequence
  derived and/or modified sequence opt3 from beta-catenin/m__Homo_sapiens__AAH58926
auggccacccaggcugaccugauggagcucgauauggcaauggaacccgacagaaaggccgcggugagccacuggcaacagcaguccuaccuugauucuggcauccauucaggggcuacaacuacggccccuagucugagcggaaaagguaacccagaggaagaggacgucgauaccucccagguuuuguaugaaugggagcaaggcuucucucagucguuuacacaggaacagguggcagacauugaugggcaauacgccaugacuagggcucagcggguacgcgcagccauguucccggagaccuuagacgagggaaugcagauacccucaacacaguuugaugcugcccacccuaccaaugugcaacgacuggcggaaccaagccagaugcuaaagcaugcagucgugaaccucaucaauuaucaggacgaugccgagcuggcuacucgugccauucccgagcuuacaaaacuguugaacgacgaagaucaaguuguggucaauaaggcagcugugaugguacaccagcucaguaaaaaggaggccuccagacaugcgaucaugaggucuccucagaugguuagcgccauugugcggaccaugcagaacacgaaugacgucgaaacugcacgcugcaccgcuggcacacugcacaaccugucccaccauagagagggucucuuagccaucuucaagucagggggaauaccagcucuggugaaaaugcuuggcagucccguggacagcgucuuguuuuacgccaucacuacccugcacaaucuacuccugcaucaagaaggcgcaaagauggccguuaggcuugcugggggacugcagaaaaugguggcguugcucaacaagacaaauguaaaauuccuggcaauuaccacggauuguuuacagauccuggccuaugguaaccaggagucuaagcucauuauccuugcuuccggcgggccucaagcccuggugaauauaaugcggacuuacacauaugagaaguugcuauggaccacuucacgcguccugaaagugcucagcguuugcaguucuaacaagccagcaauuguggaagccggaggcaugcaggcucugggucuucaccugacagacccgucccagcgauugguccagaauugucucuggacccugagaaacuuaagcgaugccgcaacgaaacaagaggggauggaaggacugcuaggcacccucgugcagcugcuuggcucggacgauaucaacguaguuacaugcgcggcugggauuuugucuaaucugacuuguaacaauuacaagaacaaaaugauggugugccaggucggagguaucgaggcccucgugaggaccguccugcgggcaggcgaccgugaagauaucacagagcccgccauuugugcucuuagacaccugacuuccagacaucaggaggccgaaauggcacaaaaugcugugagguugcacuacgggcucccuguugugguaaagcuguuacauccacccucacacuggccucugauaaaagccaccgucggacuaauccggaaccucgcgcugugcccagccaaucaugcuccccuucgagagcagggcgcaauuccgcgcuuggugcagcugcucguuagagcccaccaagacacacagaggcggaccaguaugggugggacucagcagcaauuuguggaaggcguccgcauggaggaaaucguggagggauguacgggcgcucugcacauauuagccagagauguacauaacaggauugugauccgugggcugaauacaaucccucuuuucguucaguugcucuauagccccauugagaacauccagcgggucgcagcgggagugcugugcgaacuagcccaggacaaggaggcugccgaagcaauugaggcugagggugccaccgcaccacugacugaacuccugcacucccgaaaugagggcguggccaccuacgcugcggccguccuuuuuagaaugucugaagauaagccucaagacuauaaaaagagguugagcguugagcugacaucaaguuuauuccgcaccgaacccauggcauggaacgagacugcugaccucgggcuggauauaggagcccagggcgagccacuugguuaccggcaggacgaucccuccuaucgcagcuuucauucugggggcuacggacaggacgcccugggcauggauccuaugauggaacacgagaugggagggcaccauccaggugcugacuauccgguggauggcuugcccgaccucgggcacgcacaagaucugauggacggacuaccuccaggcgauucaaaucagcuggccugguucgacacagaucucuga

SEQ ID NO: 634 - RNA, 2346 nt, Artificial Sequence
  derived and/or modified sequence opt4 from beta-catenin/m__Homo_sapiens__AAH58926
auggccacccaggccgaccugauggagcuggacauggccauggagcccgacagaaaggccgccgugagccacuggcagcagcagagcuaccuggacagcggcauccacagcggcgccaccaccaccgcccccagccugagcggcaagggcaaccccgaggaggaggacguggacaccagccaggugcuguacgagugggagcagggcuucagccagagcuucacccaggagcagguggccgacaucgacggccaguacgccaugaccagagcccagagagugagagccgccauguuccccgagacccuggacgagggcaugcagauccccagcacccaguucgacgccgcccaccccaccaacgugcagagacuggccgagcccagccagaugcugaagcacgccguggugaaccugaucaacuaccaggacgacgccgagcuggccaccagagccauccccgagcugaccaagcugcugaacgacgaggaccaggugguggugaacaaggccgccgugauggugcaccagcugagcaagaaggaggccagcagacacgccaucaugagaagcccccagauggugagcgccaucgugagaaccaugcagaacaccaacgacguggagaccgccagaugcaccgccggcacccugcacaaccugagccaccacagagagggccugcuggccaucuucaagagcggcggcauccccgcccuggugaagaugcugggcagccccguggacagcgugcuguucuacgccaucaccacccugcacaaccugcugcugcaccaggagggcgccaagauggccgugagacuggccggcggccugcagaagaugguggcccugcugaacaagaccaacgugaaguuccuggccaucaccaccgacugccugcagauccuggccuacggcaaccaggagagcaagcugaucauccuggccagcggcggcccccaggcccuggugaacaucaugagaaccuacaccuacgagaagcugcuguggaccaccagcagagugcugaaggugcugagcgugugcagcagcaacaagcccgccaucguggaggccggcggcaugcaggcccugggccugcaccugaccgaccccagccagagacuggugcagaacugccuguggacccugagaaaccugagcgacgccgccaccaagcaggagggcauggagggccugcugggcacccuggugcagcugcugggcagcgacgacaucaacguggugaccugcgccgccggcauccugagcaaccugaccugcaacaacuacaagaacaagaugauggugugccaggugggcggcaucgaggcccuggugagaaccgugcugagagccggcgacagagaggacaucaccgagcccgccaucugcgcccugagacaccugaccagcagacaccaggaggccgagauggcccagaacgccgugagacugcacuacggccugcccgugguggugaagcugcugcacccccccagccacuggccccugaucaaggccaccgugggccugaucagaaaccuggcccugugccccgccaaccacgccccccugagagagcagggcgccauccccagacuggugcagcugcuggugagagcccaccaggacacccagagaagaaccagcaugggcggcacccagcagcaguucguggagggcgugagaauggaggagaucguggagggcugcaccggcgcccugcacauccuggccagagacgugcacaacagaaucgugaucagaggccugaacaccaucccccuguucgugcagcugcuguacagccccaucgagaacauccagagaguggccgccggcgugcugugcgagcuggcccaggacaaggaggccgccgaggccaucgaggccgagggcgccaccgccccccugaccgagcugcugcacagcagaaacgagggcguggccaccuacgccgccgccgugcuguucagaaugagcgaggacaagccccaggacuacaagaagagacugagcguggagcugaccagcagccuguucagaaccgagcccauggccuggaacgagaccgccgaccugggccuggacaucggcgcccagggcgagccccugggcuacagacaggacgaccccagcuacagaagcuuccacagcggcggcuacggccaggacgcccugggcauggaccccaugauggagcacgagaugggcggccaccaccccggcgccgacuaccccguggacggccugcccgaccugggccacgcccaggaccugauggacggccugccccccggcgacagcaaccagcuggccugguucgacaccgaccuguga

SEQ ID NO: 635 - RNA, 2346 nt, Artificial Sequence
  derived and/or modified sequence opt5 from beta-catenin/m__Homo_sapiens__AAH58926
auggccacccaggcugaccugauggagcucgauauggccauggaacccgacagaaaggcggcugugagccacuggcaacagcaguccuaccuggauucuggcauccauagcggggccacaacgaccgccccuucccuuucuggaaaaggcaacccggaggaagaggacgucgauacaagccagguucuguaugaaugggagcaaggguucucccagucuuuuacccaggaacagguggcugacauugauggacaauacgccaugacacgggcucagcgcgugagagccgcgauguuccccgagacccucgacgagggcaugcagaucccuagcacacaguuugaugccgcucaccccaccaauguccaacggcuggccgaaccuucccagaugcuuaagcaugcugugguuaaccugauuaauuaucaggacgaugccgagcucgcgacgcgcgccauccccgagcugaccaaacugcucaacgacgaagaucaaguggucgugaauaaggcugccguuauggugcaccagcugagcaaaaaggaggcuucuagacaugccauuaugcgguccccucagauggucagcgccaucgugcgcacaaugcagaacaccaaugacguggaaacagcuagaugcaccgcggggacgcuucacaaccugucucaccaucgggagggacuccuggccaucuucaaguccggcggcauuccggcucuugucaaaaugcuggggagccccguugacucugugcucuuuuacgccaucacaacccugcacaaucugcuccugcaucaagaaggagccaagauggcugugcgccuugccggcgggcugcagaaaauggucgcgcuccugaacaagacaaaugugaaauuccuugcuauuaccaccgauugucugcagauccucgccuauggaaaccaggaguccaagcugauuauccuggccagcggcgggccucaagcucucguuaauauuaugagaacauacacguaugagaagcugcuuuggaccacaucccgggugcugaaaguccucucugugugcagcuccaacaagcccgccaucguugaagcuggaggcaugcaggcccugggccuucaccugaccgacccuagccagcgccucgugcagaauugucuguggacacugagaaaccucucugaugcggccaccaaacaagaggggauggaaggacugcuuggcacgcugguccagcuccugggguccgacgauaucaacguggucacaugcgcugccggcauucugagcaaucuuaccuguaacaauuacaagaacaaaaugauggugugccagguuggagggaucgaggcucucgugcggaccguccugcgcgccggagacagagaagauauuacagagcccgcgaucugugcccugcggcaccucaccucuagacaucaggaggcugaaauggcccaaaaugcugugcgccugcacuacggccuuccgguuguggucaagcugcuccauccucccagccacuggccucugauuaaagccacagugggccugauccggaaccuugcccucugccccgcuaaucaugcgccccugagagagcagggggccaucccucgccuggugcagcuccugguucgggcucaccaagacacgcagagacgcaccuccaugggaggcacacagcagcaauuugucgaaggggugcggauggaggaaauuguggagggauguaccggcgcccuucacauccuggccagagauguccauaaccgcauugugauccgggggcucaauacaauuccgcuguucguucagcugcuuuauucucccaucgagaacauccagagaguggcugccggcguccucugcgaacuggcgcaggacaaggaggcugccgaagccauugaggcugagggagccaccgcgccucugacggaacuccugcacagccgcaaugagggcguggcuaccuacgccgccgcuguucuuuuucggauguccgaagauaagccccaagacuauaaaaagagacugagcguggagcucacaucuucccuguuccggaccgaaccuauggccuggaacgagacagcugaccuggggcuugauaucggagcccagggcgagccccucggguaccgccaggacgauccgagcuauagaucuuuucauuccggaggcuacgggcaggacgcgcugggcauggauccuaugauggaacacgagaugggaggccaccaucccggggccgacuauccugucgauggacugcccgaccucggccacgcucaagaucugauggacgggcuuccucccggagauagcaaucagcuggccugguucgacaccgaucucuga

SEQ ID NO: 636 - protein, 563 aa, Artificial Sequence
  beta-catenin/m__Homo_sapiens__Q8WYA6
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 637 - RNA, 1692 nt, Artificial Sequence
  beta-catenin/m__Homo_sapiens__AAI21007
auggacgugggcgaacuucugagcuaccagcccaauaggggcacaaaacguccccgggaugaugaagaggaggagcagaagaugcgucggaaacaaacugguacucgagaacgcggccgcuaucgggaagaagaaaugacugugguggaggaagcggaugaugacaaaaaaaggcugcugcagauuauugacagagauggggaagaggaagaggaagaggaggagccauuggaugaaagcucagugaagaaaaugauccucacauuugaaaagagaucauauaaaaaccaagaauugcggauuaaguuuccagacaauccagagaaguucauggaauccgagcuggaccuaaaugacaucauucaggagaugcacgugguggccaccaugccagaccuguaccaccuucugguggagcugaaugcuguacagucgcuucucggcuugcucggacacgauaauacagauguguccauagcuguggucgauuugcuucaggaauuaacagauauagacacccuccaugagagugaagagggagcagaagugcucaucgaugcucugguggaugggcaggugguagcacugcugguacagaaucuggagcgccuggaugagucugugaaagaggaggcagauggcguccacaacacucuggcuauuguggaaaacauggcugaguuccggccugagauguguacagagggugcccagcagggucuucuacaguggcuguugaagaggcugaaggcaaagaugccuuuugaugccaacaaacuguauugcagugaagugcuggccauauugcuccaggacaaugaugaaaacagggaauugcuuggggagcuggauggaaucgaugugcuucuucagcaguuauccguguuuaaaagacacaaucccagcacggcugaggagcaggagaugauggagaaucuguuugauucccucugcuccugucuaaugcuuaguuccaaucgugagcgcuuccugaagggcgagggucuucagcugaugaaucucaugcucagggaaaagaagaucucccggagcagugcccugaaagugcuggaccaugccaugauuggccccgaaggcacagacaacugccauaaguuuguugacauucuuggcuuacgaaccaucuuuccccucuuuaugaaaucucccaggaagaucaagaaagugggaaccacugagaaggaacaugaagagcaugucuguucgauccuggcuucccuccugcggaaccugagagggcagcagcggacccggcuucugaauaaauucacugaaaaugacagugagaagguugacagacuaauggaguugcauuuuaaauaucugggugcaaugcagguggcggacaagaagauugaaggggaaaaacacgacaugguccggcgaggagagaucaucgacaaugacaccgaggaggaguucuaccuccggcgccuggaugcggggcucuuuguucuccagcacaucugcuacaucauggccgagaucugcaaugccaaugucccccagauucgccagaggguucaccagauccuaaacaugcgaggaagcuccaucaaaauugucaggcauaucaucaaggaguaugcagagaacaucggggacggccggagcccggaguuccgggagaacgagcaaaagcgcauccugggcuugcuggagaacuucuag

SEQ ID NO: 638 - RNA, 1692 nt, Artificial Sequence
  derived and/or modified sequence opt1 from beta-catenin/m__Homo_sapiens__AAI21007
auggacgugggcgagcugcucagcuaccagcccaaccgcgggaccaagcggccgcgcgacgacgaggaggaggagcagaagaugcggcgcaagcagaccggcacgcgggagcgcgggcgguaccgcgaggaggagaugaccgucguggaggaggccgacgacgacaagaagcggcugcugcagaucaucgaccgcgacggcgaggaggaggaggaggaggaggagccccucgacgaguccagcgugaagaagaugauccugaccuucgagaagcgguccuacaagaaccaggagcugcgcaucaaguuccccgacaaccccgagaaguucauggagagcgagcucgaccugaacgacaucauccaggagaugcacgucguggccaccaugccggaccuguaccaccuccugguggagcugaacgcgguccagucccuccuggggcugcucggccacgacaacacggacgugagcaucgccguggucgaccugcugcaggagcucaccgacaucgacacccugcacgaguccgaggagggcgccgaggugcugaucgacgcccucguggacgggcaggucguggcccugcuggugcagaaccucgagcggcuggacgagagcgucaaggaggaggcggacggcgugcacaacacccuggccaucguggagaacauggccgaguuccgccccgagaugugcacggagggggcccagcagggccuccugcaguggcugcucaagcggcugaaggcgaagaugcccuucgacgccaacaagcuguacugcuccgagguccucgccauccugcugcaggacaacgacgagaaccgcgagcuccugggggagcuggacggcaucgacgugcuccugcagcagcugagcguguucaagcggcacaaccccuccaccgccgaggagcaggagaugauggagaaccucuucgacagccugugcuccugccugaugcucagcuccaaccgcgagcgguuccugaagggcgaggggcugcagcucaugaaccugaugcugcgcgagaagaagaucagccgguccagcgcccugaagguccucgaccacgcgaugaucggcccggaggggaccgacaacugccacaaguucguggacauccugggccugcgcaccaucuucccccucuucaugaaguccccgcgcaagaucaagaaggugggcacgaccgagaaggagcacgaggagcacgucugcagcauccuggccagccugcuccggaaccugcgcgggcagcagcggacccgccugcucaacaaguucaccgagaacgacuccgagaagguggaccggcugauggagcugcacuucaaguaccucggcgccaugcaggucgccgacaagaagaucgagggggagaagcacgacauggugcgccggggcgagaucaucgacaacgacacggaggaggaguucuaccugcgccggcuggacgccggccucuucgugcugcagcacaucugcuacaucauggcggagaucugcaacgccaacgucccccagauccgccagcgggugcaccagauccugaacaugcgcgggagcuccaucaagaucgugcggcacaucaucaaggaguacgccgagaacaucggcgacgggcgcagccccgaguuccgggagaacgagcagaagcgcauccucggccugcuggagaacuucuga

SEQ ID NO: 639 - RNA, 1692 nt, Artificial Sequence
  derived and/or modified sequence opt2 from beta-catenin/m__Homo_sapiens__AAI21007
auggacgucggcgagcuccucuccuaccagcccaaccgcggcaccaagcgcccccgcgacgacgaggaggaggagcagaagaugcgccgcaagcagaccggcacccgcgagcgcggccgcuaccgcgaggaggagaugaccgucgucgaggaggccgacgacgacaagaagcgccuccuccagaucaucgaccgcgacggcgaggaggaggaggaggaggaggagccccucgacgaguccuccgucaagaagaugauccucaccuucgagaagcgcuccuacaagaaccaggagcuccgcaucaaguuccccgacaaccccgagaaguucauggaguccgagcucgaccucaacgacaucauccaggagaugcacgucgucgccaccaugcccgaccucuaccaccuccucgucgagcucaacgccguccagucccuccucggccuccucggccacgacaacaccgacgucuccaucgccgucgucgaccuccuccaggagcucaccgacaucgacacccuccacgaguccgaggagggcgccgagguccucaucgacgcccucgucgacggccaggucgucgcccuccucguccagaaccucgagcgccucgacgaguccgucaaggaggaggccgacggcguccacaacacccucgccaucgucgagaacauggccgaguuccgccccgagaugugcaccgagggcgcccagcagggccuccuccaguggcuccucaagcgccucaaggccaagaugcccuucgacgccaacaagcucuacugcuccgagguccucgccauccuccuccaggacaacgacgagaaccgcgagcuccucggcgagcucgacggcaucgacguccuccuccagcagcucuccgucuucaagcgccacaaccccuccaccgccgaggagcaggagaugauggagaaccucuucgacucccucugcuccugccucaugcucuccuccaaccgcgagcgcuuccucaagggcgagggccuccagcucaugaaccucaugcuccgcgagaagaagaucucccgcuccuccgcccucaagguccucgaccacgccaugaucggccccgagggcaccgacaacugccacaaguucgucgacauccucggccuccgcaccaucuucccccucuucaugaaguccccccgcaagaucaagaaggucggcaccaccgagaaggagcacgaggagcacgucugcuccauccucgccucccuccuccgcaaccuccgcggccagcagcgcacccgccuccucaacaaguucaccgagaacgacuccgagaaggucgaccgccucauggagcuccacuucaaguaccucggcgccaugcaggucgccgacaagaagaucgagggcgagaagcacgacaugguccgccgcggcgagaucaucgacaacgacaccgaggaggaguucuaccuccgccgccucgacgccggccucuucguccuccagcacaucugcuacaucauggccgagaucugcaacgccaacgucccccagauccgccagcgcguccaccagauccucaacaugcgcggcuccuccaucaagaucguccgccacaucaucaaggaguacgccgagaacaucggcgacggccgcucccccgaguuccgcgagaacgagcagaagcgcauccucggccuccucgagaacuucuga

SEQ ID NO: 640 - RNA, 1692 nt, Artificial Sequence
  derived and/or modified sequence opt3 from beta-catenin/m__Homo_sapiens__AAI21007
auggacgugggcgagcugcucagcuaccagcccaacagagggaccaagaggccucgggaugacgaagaggaagaacagaaaaugcgccgaaagcaaacaggaacucgugaaagagguagguaucgggaggaggaaaugacggucguugaggaagccgaugacgauaaaaagcgccuucugcagaucauugacagagauggcgaggaggaagaggaagaggaggagccauuggacgaguccucugugaaaaagaugauauuaaccuucgaaaagaggucauacaaaaaucaggagcugcggaucaaguuuccggauaaccccgaaaaauucauggagagugaacuagaccucaaugauauuauccaagagaugcacguaguggcuacaaugccugaccuguaucaucuucuggucgaguugaacgcagugcagagccuccuggggcugcucggacacgauaauacugacguuuccauugccguggucgacuuacugcaggaacuuaccgauaucgacacauugcaugagucugaagagggcgcggaagugcugauagaugcucuaguagacggucagguuguggcccuccugguccaaaaccuugagcgccuggaugagucggugaaggaagaggcagacggggugcacaauaccuuggccaucgucgaaaacauggcugaguuucgaccagagaugugcacugaaggagcacagcagggccuccugcagugguuacugaaaagacucaaggccaagaugcccuucgaugcuaauaaacuuuacuguucagagguucuggccauuuugcuacaagacaacgaugaaaauagggagcugcucggcgaacuggacgggaucgaugugcuucugcagcaguugagcguauuuaagcggcauaacccuaguacagcggaggagcaagaaaugauggagaaucucuucgacucccugugcucuuguuuaaugcugagcuccaaccgugaacgcuuucuaaaaggagagggucuccagcugaugaaucuuauguugagagaaaagaaaauuucaaggaguagcgcacugaaggugcucgaccacgccaugaucggcccagaggggaccgauaacugccacaaauucgucgacauacugggacuucggacgauuuuuccccuguucaugaagucuccucgaaagaucaaaaaggugggcacuaccgagaaagaacaugaggaacacguuuguuccauuuuggcuucacuccugcgcaacuuaagaggucagcagaggacacggcugcuaaauaaguuuacugagaacgauagcgaaaaaguggaccgccucauggagcugcauuucaaguaucuuggggccaugcaagucgcagauaagaaaaucgagggagaaaagcacgacauggugagaaggggcgagaucauugauaaugacaccgaagaggaguuuuacuugcgucggcuggaugcuggccucuucguacugcagcacauaugcuauaucauggccgaaauuuguaacgcgaauguuccacagauccgacagagagugcaucaaauauuaaacaugagggggaguucuauuaaaaucguccgccacaucauuaaggaguacgccgaaaauaucggagacggucgguccccggaguucagagaaaacgagcagaaaaggauucugggccuuuuggagaauuuuuga

SEQ ID NO: 641 - RNA, 1692 nt, Artificial Sequence
  derived and/or modified sequence opt4 from beta-catenin/m__Homo_sapiens__AAI21007
auggacgugggcgagcugcugagcuaccagcccaacagaggcaccaagagacccagagacgacgaggaggaggagcagaagaugagaagaaagcagaccggcaccagagagagaggcagauacagagaggaggagaugaccgugguggaggaggccgacgacgacaagaagagacugcugcagaucaucgacagagacggcgaggaggaggaggaggaggaggagccccuggacgagagcagcgugaagaagaugauccugaccuucgagaagagaagcuacaagaaccaggagcugagaaucaaguuccccgacaaccccgagaaguucauggagagcgagcuggaccugaacgacaucauccaggagaugcacgugguggccaccaugcccgaccuguaccaccugcugguggagcugaacgccgugcagagccugcugggccugcugggccacgacaacaccgacgugagcaucgccgugguggaccugcugcaggagcugaccgacaucgacacccugcacgagagcgaggagggcgccgaggugcugaucgacgcccugguggacggccaggugguggcccugcuggugcagaaccuggagagacuggacgagagcgugaaggaggaggccgacggcgugcacaacacccuggccaucguggagaacauggccgaguucagacccgagaugugcaccgagggcgcccagcagggccugcugcaguggcugcugaagagacugaaggccaagaugcccuucgacgccaacaagcuguacugcagcgaggugcuggccauccugcugcaggacaacgacgagaacagagagcugcugggcgagcuggacggcaucgacgugcugcugcagcagcugagcguguucaagagacacaaccccagcaccgccgaggagcaggagaugauggagaaccuguucgacagccugugcagcugccugaugcugagcagcaacagagagagauuccugaagggcgagggccugcagcugaugaaccugaugcugagagagaagaagaucagcagaagcagcgcccugaaggugcuggaccacgccaugaucggccccgagggcaccgacaacugccacaaguucguggacauccugggccugagaaccaucuucccccuguucaugaagagccccagaaagaucaagaaggugggcaccaccgagaaggagcacgaggagcacgugugcagcauccuggccagccugcugagaaaccugagaggccagcagagaaccagacugcugaacaaguucaccgagaacgacagcgagaagguggacagacugauggagcugcacuucaaguaccugggcgccaugcagguggccgacaagaagaucgagggcgagaagcacgacauggugagaagaggcgagaucaucgacaacgacaccgaggaggaguucuaccugagaagacuggacgccggccuguucgugcugcagcacaucugcuacaucauggccgagaucugcaacgccaacgugccccagaucagacagagagugcaccagauccugaacaugagaggcagcagcaucaagaucgugagacacaucaucaaggaguacgccgagaacaucggcgacggcagaagccccgaguucagagagaacgagcagaagagaauccugggccugcuggagaacuucuga

SEQ ID NO: 642 - RNA, 1692 nt, Artificial Sequence
  derived and/or modified sequence opt5 from beta-catenin/m__Homo_sapiens__AAI21007
auggacgugggcgagcugcucagcuaccagcccaacagagggaccaagcggccucgcgaugacgaagaggaagaacagaaaaugagacggaagcaaacaggaacgcgcgaaagaggccgguaucgcgaggaggaaaugaccgucguugaggaagccgaugacgauaaaaagagacugcuucagaucauugaccgggauggggaggaggaagaggaagaggaggagccgcuggacgaguccucugugaaaaagaugauccucacauucgaaaagcgcagcuacaaaaaucaggagcugagaauuaaguuucccgauaacccugaaaaauucauggaguccgaacuugaccugaaugauaucauucaagagaugcacguggucgcuaccaugcccgaccucuaucaucugcugguggagcucaacgccguucagucucugcuuggacugcucggccacgauaauacagacgugagcaucgcggucguggaccugcuucaggaacugaccgauaucgacacacuccaugaguccgaagagggggcugaaguucugauugaugcccugguggacggacaggucguggcccuccuggugcaaaaccuugagcggcuggaugagucugucaaggaagaggcugacggcguucacaauacccucgccaucguggaaaacauggcugaguuucgcccugagaugugcacggaaggcgcccagcaggggcugcuucaguggcugcucaaaagacugaaggcgaagaugcccuucgaugccaauaaacuguacuguagcgaggugcucgcuauucugcuucaagacaacgaugaaaaucgggagcugcucggagaacuggacggcaucgauguccuucugcagcagcucuccguguuuaagcgccauaacccuagcaccgccgaggagcaagaaaugauggagaaucuguucgacucucugugcuccugucucaugcugagcucuaacagagaacgguuucuuaaaggggagggacugcagcucaugaaucugaugcugagagaaaagaaaauuucccgcagcucugcucuuaagguucucgaccacgccaugaucggcccggaggggacagauaacugccacaaauucguggacauucugggacugcggaccaucuuuccccucuucaugaaguccccuagaaagaucaaaaaggucggcacaaccgagaaagaacaugaggaacacguguguagcauucuggcgucccuucugcgcaaccuccggggccagcagagaacgcgccugcugaauaaguuuacagagaacgauucugaaaaaguugaccggcuuauggagcuccauuucaaguaucugggggccaugcaaguggcugauaagaaaaucgagggagaaaagcacgacauggucagacgcggcgagauuaucgauaaugacaccgaagaggaguuuuaccugcggagacucgaugccgggcuguucgugcuucagcacauuugcuauaucauggcugaaaucuguaacgccaaugucccccagauucgccagcgggugcaucaaauccugaacaugagaggaagcuccauuaaaaucguucggcacauuaucaaggaguacgccgaaaauaucggcgacgggcgcagcccugaguucagagaaaacgagcagaaacggauucucggacugcuggagaauuuuuga

SEQ ID NO: 643 - protein, 610 aa, Artificial Sequence
  BING-4__Homo_sapiens__O15213
METAPKPGKDVPPKKDKLQTKRKKPRRYWEEETVPTTAGASPGPPRNKKNRELRPQRPKNAYILKKSRISKKPQVPKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 644 - RNA, 1833 nt, Artificial Sequence
  BING-4__Homo_sapiens__CCDS4772.1
auggagacagcccccaagccgggcaaggaugucccgcccaagaaagacaaacuucagaccaagagaaagaaaccgcggcgauacugggaggaagagaccguuccgaccacagccggagccucuccagggccuccucguaacaagaagaaucgggagcuccguccucagagaccaaaaaaugcuuacaucuuaaagaagucucggaucucuaagaagccucaggucccgaagaaaccccgagaauggaagaacccggagucccagcgcggcuuguccgggacccaagauccauucccaggccccgcccccgucccuguggaagugguccagaaguucugucgcauugacaaaucccgaaagcuaccacauucuaaagccaaaacucgaagccgacuugagguggcugaagcugaggaagaggaaacaaguaucaaagcugcucguucugagcugcugcuugcugaagaaccuggguuucuggaaggggaggauggggaagacacagcaaagauaugccaggcugacauuguggaggcuguggacauugcaagugcagccaagcacuuugacuugaaucugcggcaguuuggacccuacagacuaaacuacucucgaacuggaagacaccuggcuuuuggagggcgccgaggucauguggcugcccuugauuggguaacaaagaagcuuaugugcgagaucaacgucauggaggcggugcgggacauccgguuucuccauucugaggcacugcuugcuguugcucagaaccgcuggcuccacaucuaugacaaucagggcauugagcuccacuguauccgccgcugugaccgaguaacacggcuugaguuccugcccuuccacuuccuccuggcuacagcuucagaaacaggguuucuaaccuaccuggaugugucaguggggaagauuguggcagcucugaaugcucgagcugggcggcucgauguuaugagucagaacccuuacaaugccgucauccaucucggacacagcaaugguacugugucuuuauggaguccagcuaugaaggagccacuggcaaagauucucugucaucguggugggguccgggcuguggcaguagauucuacaggcacguacauggccaccucuggccuagaccaccagcugaagaucuuugacuugcgagggacguaccagccucugagcacucggacccugccccauggagcagggcaccuggccuucucccagaggggacugcugguggcgggaaugggugacguugucaacaucugggcagggcagggcaaggccagcccacccucccuugaacagcccuaccucacccaccggcucucaggcccugugcauggccuucaguucugccccuuugaagaugugcuggggguggggcacacugggggcaucaccagcaugcuggucccuggggccggugagcccaacuucgauggccuggagaguaauccauacagaagccggaagcagcgccaggagugggaggugaaggcccugcuagagaagguaccugcagagcuuauuugucuggacccacgagcccuggccgagguggaugucaucucccuggagcagggaaagaaggagcagauagagaggcugggcuaugacccgcaggcuaaggcucccuuccagccaaagccaaagcagaagggccgcagcuccacggcaagccuggugaagaggaagaggaaggucauggaugaggaacacagggacaagguccggcagagccuucagcagcagcaucauaaggaggcgaaggccaagcccacgggggcccggccaucugcccuggacagauuugugcgcuga

SEQ ID NO: 645 - RNA, 1833 nt, Artificial Sequence
  derived and/or modified sequence opt1 from BING-4__Homo_sapiens__CCDS4772.1
auggagaccgcccccaagccgggcaaggacgugccgcccaagaaggacaagcugcagaccaagcgcaagaagccccggcgcuacugggaggaggagacgguccccaccaccgccggggcgagccccggcccgccccggaacaagaagaaccgcgagcuccggccccagcgccccaagaacgccuacauccugaagaagucccggaucagcaagaagccccaggugcccaagaagccgcgcgaguggaagaaccccgagucccagcgggggcugagcggcacccaggaccccuuccccgggccggcccccgugcccgucgagguggugcagaaguucugccgcaucgacaagucccggaagcucccccacagcaaggccaagacgcgcucccggcuggaggucgccgaggcggaggaggaggagaccagcaucaaggccgcccgcuccgagcugcuccuggccgaggagccgggcuuccuggagggcgaggacggggaggacaccgcgaagaucugccaggccgacaucguggaggccguggacaucgccagcgccgcgaagcacuucgaccucaaccugcggcaguucggccccuaccgccugaacuacucccggaccgggcgccaccucgccuucggcgggcggcgcggccacgucgccgcccuggacugggugacgaagaagcugaugugcgagaucaacgugauggaggccguccgggacauccgcuuccuccacagcgaggcgcugcuggccguggcccagaaccgcuggcuccacaucuacgacaaccagggcaucgagcugcacugcauccggcgcugcgaccgggugacccgccuggaguuccuccccuuccacuuccugcuggccaccgccuccgagaccggguuccucacguaccuggacgucagcgugggcaagaucguggcggcccugaacgcccgggccgggcgccucgacgucaugucccagaaccccuacaacgccgugauccaccugggccacagcaacggcaccgugucccuguggagcccggcgaugaaggagccccucgccaagauccugugccaccgcgggggcguccgggccguggccguggacuccaccgggaccuacauggcgacgagcggccuggaccaccagcucaagaucuucgaccugcgggggaccuaccagccccugagcacccgcacccucccccacggcgccggccaccuggccuucucccagcgggggcugcucgucgccggcaugggggacguggucaacaucugggccggccaggggaaggcgagcccgcccucccuggagcagcccuaccugacgcaccgccucagcggcccggugcacggccugcaguucugccccuucgaggacgugcugggggucggccacaccgggggcaucaccuccaugcucgugcccggggccggcgagcccaacuucgacggccuggagagcaacccguaccggucccgcaagcagcggcaggagugggaggugaaggcccugcucgagaagguccccgccgagcugaucugccuggacccccgcgcccuggcggagguggacgugaucagccucgagcaggggaagaaggagcagaucgagcggcugggcuacgacccccaggccaaggccccguuccagcccaagcccaagcagaaggggcgcuccagcaccgccucccuggucaagcggaagcgcaaggugauggacgaggagcaccgcgacaaggugcggcagagccuccagcagcagcaccacaaggaggccaaggcgaagcccacgggcgcccgcccguccgcccuggaccgguucguccgcuga

SEQ ID NO: 646 - RNA, 1833 nt, Artificial Sequence
  derived and/or modified sequence opt2 from BING-4__Homo_sapiens__CCDS4772.1
auggagaccgcccccaagcccggcaaggacgucccccccaagaaggacaagcuccagaccaagcgcaagaagccccgccgcuacugggaggaggagaccguccccaccaccgccggcgccucccccggccccccccgcaacaagaagaaccgcgagcuccgcccccagcgccccaagaacgccuacauccucaagaagucccgcaucuccaagaagccccagguccccaagaagccccgcgaguggaagaaccccgagucccagcgcggccucuccggcacccaggaccccuuccccggccccgcccccguccccgucgaggucguccagaaguucugccgcaucgacaagucccgcaagcucccccacuccaaggccaagacccgcucccgccucgaggucgccgaggccgaggaggaggagaccuccaucaaggccgcccgcuccgagcuccuccucgccgaggagcccggcuuccucgagggcgaggacggcgaggacaccgccaagaucugccaggccgacaucgucgaggccgucgacaucgccuccgccgccaagcacuucgaccucaaccuccgccaguucggccccuaccgccucaacuacucccgcaccggccgccaccucgccuucggcggccgccgcggccacgucgccgcccucgacugggucaccaagaagcucaugugcgagaucaacgucauggaggccguccgcgacauccgcuuccuccacuccgaggcccuccucgccgucgcccagaaccgcuggcuccacaucuacgacaaccagggcaucgagcuccacugcauccgccgcugcgaccgcgucacccgccucgaguuccuccccuuccacuuccuccucgccaccgccuccgagaccggcuuccucaccuaccucgacgucuccgucggcaagaucgucgccgcccucaacgcccgcgccggccgccucgacgucaugucccagaaccccuacaacgccgucauccaccucggccacuccaacggcaccgucucccucuggucccccgccaugaaggagccccucgccaagauccucugccaccgcggcggcguccgcgccgucgccgucgacuccaccggcaccuacauggccaccuccggccucgaccaccagcucaagaucuucgaccuccgcggcaccuaccagccccucuccacccgcacccucccccacggcgccggccaccucgccuucucccagcgcggccuccucgucgccggcaugggcgacgucgucaacaucugggccggccagggcaaggccuccccccccucccucgagcagcccuaccucacccaccgccucuccggccccguccacggccuccaguucugccccuucgaggacguccucggcgucggccacaccggcggcaucaccuccaugcucguccccggcgccggcgagcccaacuucgacggccucgaguccaaccccuaccgcucccgcaagcagcgccaggagugggaggucaaggcccuccucgagaagguccccgccgagcucaucugccucgacccccgcgcccucgccgaggucgacgucaucucccucgagcagggcaagaaggagcagaucgagcgccucggcuacgacccccaggccaaggcccccuuccagcccaagcccaagcagaagggccgcuccuccaccgccucccucgucaagcgcaagcgcaaggucauggacgaggagcaccgcgacaagguccgccagucccuccagcagcagcaccacaaggaggccaaggccaagcccaccggcgcccgccccuccgcccucgaccgcuucguccgcuga

SEQ ID NO: 647 - RNA, 1833 nt, Artificial Sequence
  derived and/or modified sequence opt3 from BING-4__Homo_sapiens__CCDS4772.1
auggagaccgcccccaagccuggcaaagacgugccaccgaagaaagauaagcugcagacaaaaagaaagaagcccaggcgguacugggaagaggaaacugucccuacgaccgcuggggcaagcccaggacccccucgcaacaaaaagaaucgagagcuccguccacaaagacccaaaaacgccuauauccuuaagaaauccaggauuucuaagaagccucagguuccgaaaaagccacgggaauggaaaaaucccgagucacagcgcggucugaguggcacacaggacccuuucccagggcccgcgccugugccaguagaggugguccaaaaguuuugcagaauagauaaaagcaggaaguugccccacuccaaagcuaagacucggucucgcuuagaaguggccgaggcagaagaggaggaaaccucgaucaaggccgcucgaucagagcugcuacucgcagaggaaccgggauuccuggaaggcgaggacggugaggauacagccaaaauuugucaggcugacaucguugaagccguggauauugcgagcgcagccaagcauuuugaccuuaaccugagacaguucgggccuuacagguugaauuauagucggaccggacgucaccucgcuuuuggcggccgcagagggcaugucgccgcacuggauugggugacuaaaaagcugaugugcgagaucaacguaauggaagcuguuagggacauacgguuccuccacuccgaggccuuacuggcgguggcccagaaucgauggcuucauaucuacgauaaccaaggaauugaauugcacuguauccgcagaugcgacagggucacacggcuggaguuucuacccuuccacuuucuccuggcaaccgcuucugagacggguuuccuuacuuaucuggaugugagcgugggcaaaauugucgccgcuuugaaugcccgcgcagggagacucgacguuaugucccagaacccauacaaugccgugauccaucugggacacucaaacggcaccguaaguuuauggagcccugcuaugaaggaaccccuggcgaagauacucugucauagggguggggugcgugcagucgccguggacucuacaggaacuuauauggcuaccuccggccuugaucaccagcugaaaauuuuugacuugcggggcacauaccagccacuaucaacccgaacgcugccccacggggccggacaucucgcauucagccaaagaggucugcuuguugccggcaugggggauguggucaauaucugggcuggacagggcaaggccaguccuccaucucuggagcagccguacuugacucacaggcucuccggucccgugcaugggcugcaauuuugcccuuucgaagacguauuaggcguuggacacacaggcgggauuaccagcaugcuggugccaggagcgggugagcccaacuucgauggccuagaaucgaauccuuaucgcucucggaaacagagacaggagugggaggucaaggcacuccuggaaaaagugccagcugagcuuaucuguuuggaccccagggcccuggcagaagucgaugugaucucccucgagcaggggaagaaggagcaaauugaacgccugggauacgacccgcaggccaaagcuccuuuucagccaaagcccaaacagaagggccgaucaaguacugccagccuuguuaaacggaagcguaaggugauggaugaggaacauagagacaaaguaaggcaaucccugcagcagcagcaccacaaggaggcaaaagcuaagccuacaggugcccgccccucugcguuggaucgguucgucagauga

SEQ ID NO: 648 - RNA, 1833 nt, Artificial Sequence
  derived and/or modified sequence opt4 from BING-4__Homo_sapiens__CCDS4772.1
auggagaccgcccccaagcccggcaaggacgugccccccaagaaggacaagcugcagaccaagagaaagaagcccagaagauacugggaggaggagaccgugcccaccaccgccggcgccagccccggcccccccagaaacaagaagaacagagagcugagaccccagagacccaagaacgccuacauccugaagaagagcagaaucagcaagaagccccaggugcccaagaagcccagagaguggaagaaccccgagagccagagaggccugagcggcacccaggaccccuuccccggccccgcccccgugcccguggagguggugcagaaguucugcagaaucgacaagagcagaaagcugccccacagcaaggccaagaccagaagcagacuggagguggccgaggccgaggaggaggagaccagcaucaaggccgccagaagcgagcugcugcuggccgaggagcccggcuuccuggagggcgaggacggcgaggacaccgccaagaucugccaggccgacaucguggaggccguggacaucgccagcgccgccaagcacuucgaccugaaccugagacaguucggccccuacagacugaacuacagcagaaccggcagacaccuggccuucggcggcagaagaggccacguggccgcccuggacugggugaccaagaagcugaugugcgagaucaacgugauggaggccgugagagacaucagauuccugcacagcgaggcccugcuggccguggcccagaacagauggcugcacaucuacgacaaccagggcaucgagcugcacugcaucagaagaugcgacagagugaccagacuggaguuccugcccuuccacuuccugcuggccaccgccagcgagaccggcuuccugaccuaccuggacgugagcgugggcaagaucguggccgcccugaacgccagagccggcagacuggacgugaugagccagaaccccuacaacgccgugauccaccugggccacagcaacggcaccgugagccuguggagccccgccaugaaggagccccuggccaagauccugugccacagaggcggcgugagagccguggccguggacagcaccggcaccuacauggccaccagcggccuggaccaccagcugaagaucuucgaccugagaggcaccuaccagccccugagcaccagaacccugccccacggcgccggccaccuggccuucagccagagaggccugcugguggccggcaugggcgacguggugaacaucugggccggccagggcaaggccagcccccccagccuggagcagcccuaccugacccacagacugagcggccccgugcacggccugcaguucugccccuucgaggacgugcugggcgugggccacaccggcggcaucaccagcaugcuggugcccggcgccggcgagcccaacuucgacggccuggagagcaaccccuacagaagcagaaagcagagacaggagugggaggugaaggcccugcuggagaaggugcccgccgagcugaucugccuggaccccagagcccuggccgagguggacgugaucagccuggagcagggcaagaaggagcagaucgagagacugggcuacgacccccaggccaaggcccccuuccagcccaagcccaagcagaagggcagaagcagcaccgccagccuggugaagagaaagagaaaggugauggacgaggagcacagagacaaggugagacagagccugcagcagcagcaccacaaggaggccaaggccaagcccaccggcgccagacccagcgcccuggacagauucgugagauga

SEQ ID NO: 649 - RNA, 1833 nt, Artificial Sequence
  derived and/or modified sequence opt5 from BING-4__Homo_sapiens__CCDS4772.1
auggagaccgcccccaagccuggcaaagacgugccgcccaagaaagauaagcugcagacaaaaagaaagaagccucggcgcuacugggaagaggaaacgguccccaccacagcuggggccagcccuggacccccuagaaacaaaaagaaucgggagcuccgcccgcaaagacccaaaaacgcguauauccugaagaaaucccggauuucuaagaagccucagguucccaaaaagccucgcgaauggaaaaaucccgagagccagagaggccuuuccgggacccaggacccguucccuggacccgcuccugugcccguggaggucgugcaaaaguuuugccggaucgauaaaucucgcaagcugccccacagcaaagccaagacaagaucccggcucgaaguugccgaggcugaagaggaggaaaccucuauuaaggccgcucgcagcgagcugcuucuggccgaggaaccuggcuuccucgaaggggaggacggagaggauacagcgaaaaucugucaggccgacauuguggaagcugucgauaucgccuccgcugccaagcauuuugaccugaaccugagacaguucggcccguaccggcucaauuauagccgcaccggcagacaccuggcguuugggggacggagaggccauguggccgcucuugauuggguuacgaaaaagcugaugugcgagaucaacgugauggaagccguccgcgacauucgguuccuccacucugaggcucugcuugccguggcccagaauagauggcugcauaucuacgauaaccaagggauugaacuccacuguauccgccggugcgacagagugacccgccuggaguuucugcccuuccacuuucuccuggcuacagcguccgagaccggauuccuuacauaucuggaugucagcguuggcaaaauuguggccgcucucaaugcccgggccgggagacuggacgugaugucucagaacccuuacaaugcugucauccaucuuggacacuccaacggcaccgugagccuguggucucccgccaugaaggaaccucucgcgaagauucugugucaucgcggcgggguucgggcuguggccgucgacuccacgggaacauauauggccaccagcggccuggaucaccagcucaaaaucuuugaccugagagggacauaccagccccuuuccacccgcacccugccgcacggagcuggccaucucgccuucucucaacgggggcugcuuguggcuggaaugggcgauguugugaauaucugggccggccaggggaaggcgagcccucccucccuggagcagccuuaccucacacacagacugagcggacccguccauggccugcaauuuugcccuuucgaagacgugcucggggucggacacacgggcgggauuaccucuaugcuggugcccggcgccggagagccgaacuucgauggccuugaauccaauccuuaucggagccgcaaacagagacaggagugggagguuaaggcucugcucgaaaaagugcccgccgagcugaucugucuggacccccgggcucuugccgaagucgaugugauuucucucgagcaggggaagaaggagcaaaucgaaagacugggauacgacccucaggcgaaagccccguuucagcccaagccuaaacagaagggccgcagcuccacagcuucucugguuaaacggaagagaaaggugauggaugaggaacaucgcgacaaagucagacaaagccuccagcagcagcaccacaaggaggccaaagcuaagcccaccggggcccggccuuccgcccuggaucgcuucgugagauga

SEQ ID NO: 650 - protein, 298 aa, Artificial Sequence
  BIRC7__Homo_sapiens__Q96CA5
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 651 - RNA, 897 nt, Artificial Sequence
  BIRC7__Homo_sapiens__AAG37878
augggaccuaaagacagugccaagugccugcaccguggaccacagccgagccacugggcagccggugauggucccacgcaggagcgcuguggaccccgcucucugggcagcccuguccuaggccuggacaccugcagagccugggaccacguggaugggcagauccugggccagcugcggccccugacagaggaggaagaggaggagggcgccggggccaccuuguccagggggccugccuuccccggcaugggcucugaggaguugcgucuggccuccuucuaugacuggccgcugacugcugaggugccacccgagcugcuggcugcugccggcuucuuccacacaggccaucaggacaaggugaggugcuucuucugcuaugggggccugcagagcuggaagcgcggggacgaccccuggacggagcaugccaagugguuccccagcugucaguuccugcuccggucaaaaggaagagacuuuguccacagugugcaggagacucacucccagcugcugggcucuugggacccgugggaagaaccggaagacgcagccccuguggcccccuccgucccugccucuggguacccugagcugcccacacccaggagagagguccagucugaaagugcccaggagccaggaggggucaguccagccgaggcccagagggcgugguggguucuugagcccccaggagccagggauguggaggcgcagcugcggcggcugcaggaggagaggacgugcaaggugugccuggaccgcgccguguccaucgucuuugugccgugcggccaccuggucugugcugagugugcccccggccugcagcugugccccaucugcagagcccccguccgcagccgcgugcgcaccuuccuguccuag

SEQ ID NO: 652 - RNA, 897 nt, Artificial Sequence
  derived and/or modified sequence opt1 from BIRC7__Homo_sapiens__AAG37878
augggccccaaggacagcgccaagugccugcaccgcgggccgcagcccucccacugggccgcgggcgacgggcccacccaggagcggugcggcccccgcagccucggguccccggugcugggccuggacacgugccgggccugggaccacgucgacggccagauccucgggcagcugcgcccccugaccgaggaggaggaggaggagggcgccggggccacccucagccggggccccgccuuccccgggaugggcuccgaggagcugcgccuggcgagcuucuacgacuggccgcucaccgccgaggugccgcccgagcugcuggccgccgcgggcuucuuccacaccgggcaccaggacaaggugcggugcuucuucugcuacggcgggcuccaguccuggaagcgcggcgacgaccccuggacggagcacgccaagugguuccccagcugccaguuccugcugcgguccaagggccgcgacuucguccacagcgugcaggagacccacucccagcuccuggggagcugggaccccugggaggagcccgaggacgccgcccccguggccccguccguccccgcgagcggcuaccccgagcugcccaccccgcggcgcgaggugcaguccgagagcgcccaggagcccgggggcgugucccccgccgaggcccagcgggccugguggguccucgagcccccgggggcgcgcgacguggaggcccagcugcggcgccugcaggaggagcggaccugcaaggugugccucgaccgcgccgucagcaucguguucgugcccugcggccaccuggucugcgccgagugcgcccccggccugcagcucugccccaucugccgggcgccggugcgcucccgggugcgcacguuccugagcuga

SEQ ID NO: 653 - RNA, 897 nt, Artificial Sequence
  derived and/or modified sequence opt2 from BIRC7__Homo_sapiens__AAG37878
augggccccaaggacuccgccaagugccuccaccgcggcccccagcccucccacugggccgccggcgacggccccacccaggagcgcugcggcccccgcucccucggcucccccguccucggccucgacaccugccgcgccugggaccacgucgacggccagauccucggccagcuccgcccccucaccgaggaggaggaggaggagggcgccggcgccacccucucccgcggccccgccuuccccggcaugggcuccgaggagcuccgccucgccuccuucuacgacuggccccucaccgccgaggucccccccgagcuccucgccgccgccggcuucuuccacaccggccaccaggacaagguccgcugcuucuucugcuacggcggccuccaguccuggaagcgcggcgacgaccccuggaccgagcacgccaagugguuccccuccugccaguuccuccuccgcuccaagggccgcgacuucguccacuccguccaggagacccacucccagcuccucggcuccugggaccccugggaggagcccgaggacgccgcccccgucgcccccuccguccccgccuccggcuaccccgagcuccccaccccccgccgcgagguccaguccgaguccgcccaggagcccggcggcgucucccccgccgaggcccagcgcgccugguggguccucgagccccccggcgcccgcgacgucgaggcccagcuccgccgccuccaggaggagcgcaccugcaaggucugccucgaccgcgccgucuccaucgucuucguccccugcggccaccucgucugcgccgagugcgcccccggccuccagcucugccccaucugccgcgcccccguccgcucccgcguccgcaccuuccucuccuga

SEQ ID NO: 654 - RNA, 897 nt, Artificial Sequence
  derived and/or modified sequence opt3 from BIRC7__Homo_sapiens__AAG37878
augggccccaaggacagcgccaaaugccugcacagagggccucagccaucccauugggcugcaggagaugguccgacccaagagagguguggcccccggucucucgggucaccugugcuuggacuggacacaugccgcgccugggaucacgucgacggccagaucuugggucaguuacgaccacugacugaagaggaagaggaagagggggcgggagcuacgcuaagucguggccccgccuucccuggcauggggagcgaggaacucagacuggcauccuuuuacgauuggccacuuaccgccgagguucccccugaacuguuggcugcagccggauucuuucauacaggucaccaggacaaggugagguguuucuuuugcuauggcgggcuccaaucuuggaaacggggagaugacccauggacugagcaugcuaagugguucccgucgugucaguuucugcugcgcucaaaaggcagagauuucguacacagcgugcaggagacccacagucagcucuuagguuccugggaccccugggaggaaccugaagaugccgcgccagucgcacccucugugccugccagcggguacccagagcugcccacaccgaggcgggaaguucaauccgagucagcucaggagccuggaggcgugagucccgccgaagcacagcgcgcuugguggguccuugagccaccuggcgcccgagacguggaagcgcaguugagaaggcugcaagaggaacggaccugcaagguaugucuagaucgugccguuagcauuguguuuguccccugcgggcaucucgugugugcagagugcgcuccaggacugcagcuuugucccauaugccgcgccccugugagaucuaggguccggacuuuccuguccuga

SEQ ID NO: 655 - RNA, 897 nt, Artificial Sequence
  derived and/or modified sequence opt4 from BIRC7__Homo_sapiens__AAG37878
augggccccaaggacagcgccaagugccugcacagaggcccccagcccagccacugggccgccggcgacggccccacccaggagagaugcggccccagaagccugggcagccccgugcugggccuggacaccugcagagccugggaccacguggacggccagauccugggccagcugagaccccugaccgaggaggaggaggaggagggcgccggcgccacccugagcagaggccccgccuuccccggcaugggcagcgaggagcugagacuggccagcuucuacgacuggccccugaccgccgaggugccccccgagcugcuggccgccgccggcuucuuccacaccggccaccaggacaaggugagaugcuucuucugcuacggcggccugcagagcuggaagagaggcgacgaccccuggaccgagcacgccaagugguuccccagcugccaguuccugcugagaagcaagggcagagacuucgugcacagcgugcaggagacccacagccagcugcugggcagcugggaccccugggaggagcccgaggacgccgcccccguggcccccagcgugcccgccagcggcuaccccgagcugcccacccccagaagagaggugcagagcgagagcgcccaggagcccggcggcgugagccccgccgaggcccagagagccuggugggugcuggagccccccggcgccagagacguggaggcccagcugagaagacugcaggaggagagaaccugcaaggugugccuggacagagccgugagcaucguguucgugcccugcggccaccuggugugcgccgagugcgcccccggccugcagcugugccccaucugcagagcccccgugagaagcagagugagaaccuuccugagcuga

SEQ ID NO: 656 - RNA, 897 nt, Artificial Sequence
  derived and/or modified sequence opt5 from BIRC7__Homo_sapiens__AAG37878
augggccccaaggacagcgccaaaugccugcacagagggccucagccgucccauugggcugccggagauggccccacccaagagcggugugggccucgcucucucggaagccccgugcugggccuugacacaugcagagcgugggaucacgucgacgggcagauccugggacagcuccggccucugacggaagaggaagaggaagagggcgcuggcgccacccuuucccgcgggcccgccuucccuggaaugggcucugaggaacugagacucgcuagcuuuuacgauuggccgcugacagccgagguucccccugaacugcucgcugccgcgggguucuuucauaccggacaccaggacaaggugcgguguuucuuuugcuauggcgggcugcaauccuggaaacgcggagaugaccccuggacagagcaugccaagugguucccuucuugucaguuucuucugagaagcaaaggccgggauuucgugcacuccguccaggagacccacagccagcuccugggcucuugggaccccugggaggaaccggaagaugcugccccuguggcucccuccguuccugccagcggguaccccgagcuucccacaccucgcagagaagugcaaucugaguccgcgcaggagccgggaggcgucagccccgccgaagcucagcgggccuggugggugcuggagccucccggggcucgcgacguugaagcccagcucagacggcugcaagaggaaagaaccugcaaggugugucuggaucgcgccgucucuauuguguuugugccuugcggacaucucgucugugcugagugcgcgcccggccugcagcuuuguccgaucugccgggccccuguuagaucccgcgugcggacguuccugagcuga

SEQ ID NO: 657 - protein, 759 aa, Artificial Sequence
  BRCA1/m__Homo_sapiens__A0A024R1V0
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 658 - RNA, 2280 nt, Artificial Sequence
  BRCA1/m__Homo_sapiens__EAW60925
auggauuuaucugcucuucgcguugaagaaguacaaaaugucauuaaugcuaugcagaaaaucuuagagugucccaucugucuggaguugaucaaggaaccugucuccacaaagugugaccacauauuuugcaaauuuugcaugcugaaacuucucaaccagaagaaagggccuucacaguguccuuuauguaagaaugauauaaccaaaaggagccuacaagaaaguacgagauuuagucaacuuguugaagagcuauugaaaaucauuugugcuuuucagcuugacacagguuuggaguaugcaaacagcuauaauuuugcaaaaaaggaaaauaacucuccugaacaucuaaaagaugaaguuucuaucauccaaaguaugggcuacagaaaccgugccaaaagacuucuacagagugaacccgaaaauccuuccuugcaggaaaccagucucaguguccaacucucuaaccuuggaacugugagaacucugaggacaaagcagcggauacaaccucaaaagacgucugucuacauugaauugggaucugauucuucugaagauaccguuaauaaggcaacuuauugcagugugggagaucaagaauuguuacaaaucaccccucaaggaaccagggaugaaaucaguuuggauucugcaaaaaaggcugcuugugaauuuucugagacggauguaacaaauacugaacaucaucaacccaguaauaaugauuugaacaccacugagaagcgugcagcugagaggcauccagaaaaguaucagggugaagcagcaucugggugugagagugaaacaagcgucucugaagacugcucagggcuauccucucagagugacauuuuaaccacucagcagagggauaccaugcaacauaaccugauaaagcuccagcaggaaauggcugaacuagaagcuguguuagaacagcaugggagccagccuucuaacagcuacccuuccaucauaagugacucuucugcccuugaggaccugcgaaauccagaacaaagcacaucagaaaaaguauuaacuucacagaaaaguagugaauacccuauaagccagaauccagaaggccuuucugcugacaaguuugaggugucugcagauaguucuaccaguaaaaauaaagaaccaggaguggaaaggucauccccuucuaaaugcccaucauuagaugauaggugguacaugcacaguugcucugggagucuucagaauagaaacuacccaucucaagaggagcucauuaagguuguugauguggaggagcaacagcuggaagagucugggccacacgauuugacggaaacaucuuacuugccaaggcaagaucuagagggaaccccuuaccuggaaucuggaaucagccucuucucugaugacccugaaucugauccuucugaagacagagccccagagucagcucguguuggcaacauaccaucuucaaccucugcauugaaaguuccccaauugaaaguugcagaaucugcccagaguccagcugcugcucauacuacugauacugcuggguauaaugcaauggaagaaagugugagcagggagaagccagaauugacagcuucaacagaaagggucaacaaaagaauguccaugguggugucuggccugaccccagaagaauuuaugcucguguacaaguuugccagaaaacaccacaucacuuuaacuaaucuaauuacugaagagacuacucauguuguuaugaaaacagaugcugaguuugugugugaacggacacugaaauauuuucuaggaauugcgggaggaaaauggguaguuagcuauuucugggugacccagucuauuaaagaaagaaaaaugcugaaugagcaugauuuugaagucagaggagauguggucaauggaagaaaccaccaagguccaaagcgagcaagagaaucccaggacagaaagaucuucagggggcuagaaaucuguugcuaugggcccuucaccaacaugcccacagaucaacuggaauggaugguacagcuguguggugcuucuguggugaaggagcuuucaucauucacccuuggcacagguguccacccaauugugguugugcagccagaugccuggacagaggacaauggcuuccaugcaauugggcagaugugugaggcaccuguggugacccgagaguggguguuggacaguguagcacucuaccagugccaggagcuggacaccuaccugauaccccagaucccccacagccacuacuga

SEQ ID NO: 659 - RNA, 2280 nt, Artificial Sequence
  derived and/or modified sequence opt1 from BRCA1/m__Homo_sapiens__EAW60925
auggaccugagcgcccuccgcguggaggagguccagaacgugaucaacgccaugcagaagauccuggagugccccaucugccuggagcucaucaaggagccgguguccaccaagugcgaccacaucuucugcaaguucugcaugcugaagcugcucaaccagaagaagggccccagccagugcccccugugcaagaacgacaucaccaagcggucccugcaggagagcacgcgcuucucccagcucgucgaggagcugcugaagaucaucugcgcguuccagcucgacaccgggcuggaguacgccaacagcuacaacuucgccaagaaggagaacaacucccccgagcaccugaaggacgaggugagcaucauccaguccaugggcuaccggaaccgcgccaagcggcuccugcagagcgagccggagaaccccucccugcaggagaccagccucuccgugcagcugagcaaccuggggaccguccgcacgcuccggaccaagcagcgcauccagccccagaagaccuccguguacaucgagcugggcagcgacuccagcgaggacaccgugaacaaggccacguacugcuccgucggggaccaggagcugcuccagaucacgccccagggcacccgggacgagaucagccuggacagcgcgaagaaggccgccugcgaguucuccgagaccgacgugaccaacaccgagcaccaccagccgagcaacaacgaccugaacaccaccgagaagcgcgccgcggagcggcaccccgagaaguaccagggcgaggccgccuccgggugcgagagcgagacguccgugagcgaggacugcuccggccucagcucccagagcgacauccugaccacccagcagcgcgacaccaugcagcacaaccugaucaagcuccagcaggagauggccgagcuggaggccguccuggagcagcacgggucccagcccagcaacuccuaccccagcaucaucuccgacagcuccgcgcucgaggaccugcggaacccggagcagagcacguccgagaaggugcugaccagccagaaguccagcgaguaccccaucagccagaaccccgagggccucuccgccgacaaguucgaggugagcgccgacuccagcaccuccaagaacaaggagcccggggucgagcgcagcuccccgagcaagugccccucccuggacgaccggugguacaugcacagcugcuccggcagccugcagaaccgcaacuaccccucccaggaggagcucaucaaggugguggacgucgaggagcagcagcuggaggagagcggcccccacgaccugaccgagacguccuaccucccgcggcaggaccuggaggggacccccuaccuggagagcggcaucagccucuucuccgacgaccccgagagcgaccccuccgaggaccgcgccccggagagcgcccggguggggaacauccccuccagcaccuccgcgcugaaggugccccagcugaaggucgccgagagcgcccagucccccgccgccgcgcacaccacggacaccgccggcuacaacgccauggaggagagcgugucccgcgagaagccggagcucaccgccagcaccgagcgggugaacaagcgcauguccauggucgugagcggccugacgcccgaggaguucaugcuggucuacaaguucgcccgcaagcaccacaucacccugaccaaccucaucaccgaggagacgacccacguggugaugaagaccgacgcggaguucgucugcgagcggacccugaaguacuuccuggggaucgccggcgggaagugggugguguccuacuucugggucacccagagcaucaaggagcgcaagaugcucaacgagcacgacuucgaggugcggggcgacguggucaacgggcgcaaccaccagggccccaagcgggcccgcgagucccaggaccggaagaucuuccgcggccuggagaucugcugcuacgggccguucacgaacaugcccaccgaccagcuggaguggauggugcagcucugcggcgccagcguggucaaggagcuguccagcuucacccuggggaccggcgugcaccccaucguggucgugcagcccgacgcguggacggaggacaacggguuccacgccaucggccagaugugcgaggccccgguggucacccgggagugggugcucgacagcguggcccuguaccagugccaggagcuggacaccuaccucaucccccagaucccccacucccacuacuga

SEQ ID NO: 660 - RNA, 2280 nt, Artificial Sequence
  derived and/or modified sequence opt2 from BRCA1/m__Homo_sapiens__EAW60925
auggaccucuccgcccuccgcgucgaggagguccagaacgucaucaacgccaugcagaagauccucgagugccccaucugccucgagcucaucaaggagcccgucuccaccaagugcgaccacaucuucugcaaguucugcaugcucaagcuccucaaccagaagaagggccccucccagugcccccucugcaagaacgacaucaccaagcgcucccuccaggaguccacccgcuucucccagcucgucgaggagcuccucaagaucaucugcgccuuccagcucgacaccggccucgaguacgccaacuccuacaacuucgccaagaaggagaacaacucccccgagcaccucaaggacgaggucuccaucauccaguccaugggcuaccgcaaccgcgccaagcgccuccuccaguccgagcccgagaaccccucccuccaggagaccucccucuccguccagcucuccaaccucggcaccguccgcacccuccgcaccaagcagcgcauccagccccagaagaccuccgucuacaucgagcucggcuccgacuccuccgaggacaccgucaacaaggccaccuacugcuccgucggcgaccaggagcuccuccagaucaccccccagggcacccgcgacgagaucucccucgacuccgccaagaaggccgccugcgaguucuccgagaccgacgucaccaacaccgagcaccaccagcccuccaacaacgaccucaacaccaccgagaagcgcgccgccgagcgccaccccgagaaguaccagggcgaggccgccuccggcugcgaguccgagaccuccgucuccgaggacugcuccggccucuccucccaguccgacauccucaccacccagcagcgcgacaccaugcagcacaaccucaucaagcuccagcaggagauggccgagcucgaggccguccucgagcagcacggcucccagcccuccaacuccuaccccuccaucaucuccgacuccuccgcccucgaggaccuccgcaaccccgagcaguccaccuccgagaagguccucaccucccagaaguccuccgaguaccccaucucccagaaccccgagggccucuccgccgacaaguucgaggucuccgccgacuccuccaccuccaagaacaaggagcccggcgucgagcgcuccucccccuccaagugccccucccucgacgaccgcugguacaugcacuccugcuccggcucccuccagaaccgcaacuaccccucccaggaggagcucaucaaggucgucgacgucgaggagcagcagcucgaggaguccggcccccacgaccucaccgagaccuccuaccucccccgccaggaccucgagggcacccccuaccucgaguccggcaucucccucuucuccgacgaccccgaguccgaccccuccgaggaccgcgcccccgaguccgcccgcgucggcaacauccccuccuccaccuccgcccucaaggucccccagcucaaggucgccgaguccgcccagucccccgccgccgcccacaccaccgacaccgccggcuacaacgccauggaggaguccgucucccgcgagaagcccgagcucaccgccuccaccgagcgcgucaacaagcgcauguccauggucgucuccggccucacccccgaggaguucaugcucgucuacaaguucgcccgcaagcaccacaucacccucaccaaccucaucaccgaggagaccacccacgucgucaugaagaccgacgccgaguucgucugcgagcgcacccucaaguacuuccucggcaucgccggcggcaagugggucgucuccuacuucugggucacccaguccaucaaggagcgcaagaugcucaacgagcacgacuucgagguccgcggcgacgucgucaacggccgcaaccaccagggccccaagcgcgcccgcgagucccaggaccgcaagaucuuccgcggccucgagaucugcugcuacggccccuucaccaacaugcccaccgaccagcucgaguggaugguccagcucugcggcgccuccgucgucaaggagcucuccuccuucacccucggcaccggcguccaccccaucgucgucguccagcccgacgccuggaccgaggacaacggcuuccacgccaucggccagaugugcgaggcccccgucgucacccgcgaguggguccucgacuccgucgcccucuaccagugccaggagcucgacaccuaccucaucccccagaucccccacucccacuacuga

SEQ ID NO: 661 - RNA, 2280 nt, Artificial Sequence
  derived and/or modified sequence opt3 from BRCA1/m__Homo_sapiens__EAW60925
auggaccugagcgcccucagaguggaggaaguccagaacguuaucaaugcuaugcaaaagauucuugagugccccauaugucuggaauugaucaaagagccuguguccaccaagugcgaucacauuuucuguaaauuuugcauguuaaagcugcuaaaccagaaaaagggcccaucucaguguccgcucugcaagaaugacaucacaaaaaggucacugcaggaaaguacucgguucagccaacuuguagaggagcuguugaagauuaucugugcauuucagcucgauacggggcuggaauacgccaacuccuauaauuucgcgaaaaaggagaacaauucucccgaacaucugaaagacgaggugucgauaauccagucaaugggauaccgcaaccgagcuaagcgucucuuacagagcgagccugaaaauccaagucugcaagagaccucccuuucuguccaguugagcaaccuggguacagugagaacucuaaggaccaagcagcggauucagccccagaaaacauccguuuauaucgaacucggcucagauaguagcgaggacaccgugaauaaggccacuuacugcucugucggggaucaagaacugcuucagauuacaccucaaggaacccgcgacgagaucucccuggauucagcgaaaaaggccgcuugugaguuuagcgaaacggacgugacuaacaccgagcaccaucagccaaguaauaacgauuugaauacaacugagaaaagagcagccgagaggcaccccgaaaaguaucagggcgaggcugccucugguugcgaguccgaaaccagcguaucggaggacuguucugggcucuccucacagagugauauacugacaacccaacagcgggacacgaugcagcauaacuuaauuaaacugcagcaagaaauggcggagcucgaagcaguucuugagcagcacggaagccagccuuccaacucuuacccaagcaucauuucagacaguuccgcccuggaggauuugcgcaauccggaacagagcacuucugagaaggugcuaacaucacaaaagaguagcgaauaucccaucucccagaacccugagggccugucugcugacaaauucgaggucucggccgauagcuccaccucaaagaauaaagaaccaggcguggagcgaaguucucccagcaagugcccuucccucgacgauagaugguacaugcacucaugcagcgggucucugcagaacaggaauuacccaucccaggaagaacuuaucaaaguggucgacguugaagaacaacagcuggaggaaaguggaccccaugauuugacugagacaagcuaucucccgcggcaggaccuggaagguaccccuuacuuagagucuggcauuucccuguuuucagaugaccccgaaagugauccaagcgaggaccgugcaccugagucggcucgcguggggaacauacccuccucuacgagcgcccuaaagguaccacaacucaagguggcggaaucagcccagagucccgcagcugcccacaccacagacacugcuggauauaaugccauggaggaauccgucucuagagagaaaccugaacugaccgcaagcacagagagggugaacaagcggauguccaugguugugucaggccuuacuccagaggaguucauguuggucuacaaauuugcccgaaagcaucacaucacccugacaaaucucauuaccgaggaaacuacgcacgugguaaugaaaacagaugcugaguucguuugugagcgcacccugaaguauuuucuugguaucgcagggggaaaguggguggucagcuacuucugggugacucagaguauaaaagaaagaaagaugcugaacgagcaugacuuugaagucaggggcgaugugguuaauggccggaaccaccaggggccgaaacgcgcaagagagucucaagacaggaagauuuuccguggauuggaaaucugcuguuauggucccuucaccaauaugccuacagaucagcucgaguggauggugcagcugugcggcgccuccguagucaaagaguuaagcucguuuacccuggggacuggagugcauccaaucguugugguccagcccgacgcuuggacagaagauaacggcuuccacgccauuggucaaaugugugaggcaccugugguaacgcgggaaugggugcuagacucaguugcccucuaccagugccaggagcuggauaccuaccuuaucccacagauuccccauucucacuauuga

SEQ ID NO: 662 - RNA, 2280 nt, Artificial Sequence
  derived and/or modified sequence opt4 from BRCA1/m__Homo_sapiens__EAW60925
auggaccugagcgcccugagaguggaggaggugcagaacgugaucaacgccaugcagaagauccuggagugccccaucugccuggagcugaucaaggagcccgugagcaccaagugcgaccacaucuucugcaaguucugcaugcugaagcugcugaaccagaagaagggccccagccagugcccccugugcaagaacgacaucaccaagagaagccugcaggagagcaccagauucagccagcugguggaggagcugcugaagaucaucugcgccuuccagcuggacaccggccuggaguacgccaacagcuacaacuucgccaagaaggagaacaacagccccgagcaccugaaggacgaggugagcaucauccagagcaugggcuacagaaacagagccaagagacugcugcagagcgagcccgagaaccccagccugcaggagaccagccugagcgugcagcugagcaaccugggcaccgugagaacccugagaaccaagcagagaauccagccccagaagaccagcguguacaucgagcugggcagcgacagcagcgaggacaccgugaacaaggccaccuacugcagcgugggcgaccaggagcugcugcagaucaccccccagggcaccagagacgagaucagccuggacagcgccaagaaggccgccugcgaguucagcgagaccgacgugaccaacaccgagcaccaccagcccagcaacaacgaccugaacaccaccgagaagagagccgccgagagacaccccgagaaguaccagggcgaggccgccagcggcugcgagagcgagaccagcgugagcgaggacugcagcggccugagcagccagagcgacauccugaccacccagcagagagacaccaugcagcacaaccugaucaagcugcagcaggagauggccgagcuggaggccgugcuggagcagcacggcagccagcccagcaacagcuaccccagcaucaucagcgacagcagcgcccuggaggaccugagaaaccccgagcagagcaccagcgagaaggugcugaccagccagaagagcagcgaguaccccaucagccagaaccccgagggccugagcgccgacaaguucgaggugagcgccgacagcagcaccagcaagaacaaggagcccggcguggagagaagcagccccagcaagugccccagccuggacgacagaugguacaugcacagcugcagcggcagccugcagaacagaaacuaccccagccaggaggagcugaucaaggugguggacguggaggagcagcagcuggaggagagcggcccccacgaccugaccgagaccagcuaccugcccagacaggaccuggagggcacccccuaccuggagagcggcaucagccuguucagcgacgaccccgagagcgaccccagcgaggacagagcccccgagagcgccagagugggcaacauccccagcagcaccagcgcccugaaggugccccagcugaagguggccgagagcgcccagagccccgccgccgcccacaccaccgacaccgccggcuacaacgccauggaggagagcgugagcagagagaagcccgagcugaccgccagcaccgagagagugaacaagagaaugagcaugguggugagcggccugacccccgaggaguucaugcugguguacaaguucgccagaaagcaccacaucacccugaccaaccugaucaccgaggagaccacccacguggugaugaagaccgacgccgaguucgugugcgagagaacccugaaguacuuccugggcaucgccggcggcaaguggguggugagcuacuucugggugacccagagcaucaaggagagaaagaugcugaacgagcacgacuucgaggugagaggcgacguggugaacggcagaaaccaccagggccccaagagagccagagagagccaggacagaaagaucuucagaggccuggagaucugcugcuacggccccuucaccaacaugcccaccgaccagcuggaguggauggugcagcugugcggcgccagcguggugaaggagcugagcagcuucacccugggcaccggcgugcaccccaucgugguggugcagcccgacgccuggaccgaggacaacggcuuccacgccaucggccagaugugcgaggcccccguggugaccagagagugggugcuggacagcguggcccuguaccagugccaggagcuggacaccuaccugaucccccagaucccccacagccacuacuga

SEQ ID NO: 663 - RNA, 2280 nt, Artificial Sequence
  derived and/or modified sequence opt5 from BRCA1/m__Homo_sapiens__EAW60925
auggaccugagcgcccucagaguggaggaaguccagaacguuaucaaugcuaugcaaaagauucuggagugccccaucugucuugaacugauuaaagagccuguguccaccaagugcgaucacaucuucuguaaauuuugcaugcucaagcugcuuaaccagaaaaagggcccgucucaguguccccugugcaagaaugacauuacaaaacggagccuccaggaauccacgcgcuucucucaacugguggaggagcugcucaagaucaucugugccuuucagcuggauaccgggcuugaauacgcgaacagcuauaauuucgcuaaaaaggagaacaauuccccugaacaucugaaagacgaggucucuauuauccagagcaugggauacagaaaccgggccaagcgccuccugcaguccgagcccgaaaauccuagccuucaagagacaucucuguccgugcagcucagcaaccugggcaccguuagaacacugcggaccaagcagcgcauucagccccagaaaacaucuguguauaucgaacucggguccgauagcucugaggacaccgucaauaaggccacguacugcuccgugggagaucaagaacugcuucagauuaccccucaaggcacaagagacgagaucagccuggauuccgcuaaaaaggccgcuugugaguuuucugaaaccgacguuacaaacaccgagcaccaucagccgagcaauaacgaucucaauacgacagaaaaacgggccgcggagcgccaccccgaaaaguaucagggggaggccgcuuccggaugcgagagcgaaaccucuguguccgaggacuguagcggccugucuagccaguccgauauucuuacaacccaacagagagacaccaugcagcauaaccugaucaaacuccagcaagaaauggccgagcuggaagcuguccuggagcagcacggcucucagccuagcaacuccuaccccagcaucauuucugacuccagcgcccucgaggaucugcggaauccugaacagucuacauccgagaaggugcuuacgagccaaaaguccucugaauaucccaucagccagaacccggaggggcuguccgcggacaaauucgaggugucugccgauagcuccaccagcaagaauaaagaaccuggagucgagagaucuucccccagcaagugcccuucucucgacgaucgcugguacaugcacuccugcagcggcucucugcagaaccggaauuaccccagccaggaagaacuuauuaaaguuguggacguggaggagcaacagcuggaggaauccgggccccaugaucucacagagaccagcuaucugccucgccaggaccuggaaggaacaccguaccucgagucuggcaucucccuguuuagcgaugaccccgaauccgauccuucugaggacagagcucccgagagcgcccgggucgggaacauuccuuccucuaccagcgcucuuaaggugccccaacugaagguugccgaauccgcccagucuccggcugcggcccacacgacagacaccgcuggauauaaugccauggaggaaagcguguccagagagaaaccugaacucaccgccagcacagagcgcgucaacaagcggaugucuauggugguuuccggccugacccccgaggaguucaugcugguguacaaauuugcuagaaagcaucacaucacacuuacgaaucucaucaccgaagaaacaacccacgucgugaugaaaacagaugccgaguucgucugugagcgcacccugaaguauuuucugggcauugcugggggaaagugggugguuagcuacuucugggugacgcagucuaucaaagaacggaagaugcucaacgagcaugacuuugaagucagaggcgaugugguuaaugggcgcaaccaccagggaccuaaacgggcgagagagucccaagaccgcaagauuuuccggggccuggaaaucugcuguuaugggcccuucaccaauaugccuacagaucagcuugaguggauggugcagcugugcggagccagcgucgugaaagagcucucuuccuuuacccugggcacaggcgugcaucccauuguugucgugcagccggacgccuggaccgaagauaacggguuccacgcuaucggacaaaugugugaggccccuguggucacgagagaaugggugcuggacagcguugcucuuuaccagugccaggagcucgauacauaccugaucccccagauuccccauucccacuauuga

SEQ ID NO: 664 - protein, 719 aa, Artificial Sequence
  BRCA1/m__Homo_sapiens__A0A024R1V7
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 665 - RNA, 2160 nt, Artificial Sequence
  BRCA1/m__Homo_sapiens__EAW60922
auggauuuaucugcucuucgcguugaagaaguacaaaaugucauuaaugcuaugcagaaaaucuuagagugucccaucugucuggaguugaucaaggaaccugucuccacaaagugugaccacauauuuugcaaauuuugcaugcugaaacuucucaaccagaagaaagggccuucacaguguccuuuauguaagaaugauauaaccaaaaggagccuacaagaaaguacgagauuuagucaacuuguugaagagcuauugaaaaucauuugugcuuuucagcuugacacagguuuggaguaugcaaacagcuauaauuuugcaaaaaaggaaaauaacucuccugaacaucuaaaagaugaaguuucuaucauccaaaguaugggcuacagaaaccgugccaaaagacuucuacagagugaacccgaaaauccuuccuugcaggaaaccagucucaguguccaacucucuaaccuuggaacugugagaacucugaggacaaagcagcggauacaaccucaaaagacgucugucuacauugaauuggcugcuugugaauuuucugagacggauguaacaaauacugaacaucaucaacccaguaauaaugauuugaacaccacugagaagcgugcagcugagaggcauccagaaaaguaucagggugaagcagcaucugggugugagagugaaacaagcgucucugaagacugcucagggcuauccucucagagugacauuuuaaccacucagcagagggauaccaugcaacauaaccugauaaagcuccagcaggaaauggcugaacuagaagcuguguuagaacagcaugggagccagccuucuaacagcuacccuuccaucauaagugacucuucugcccuugaggaccugcgaaauccagaacaaagcacaucagaaaaagcaguauuaacuucacagaaaaguagugaauacccuauaagccagaauccagaaggccuuucugcugacaaguuugaggugucugcagauaguucuaccaguaaaaauaaagaaccaggaguggaaaggucauccccuucuaaaugcccaucauuagaugauaggugguacaugcacaguugcucugggagucuucagaauagaaacuacccaucucaagaggagcucauuaagguuguugauguggaggagcaacagcuggaagagucugggccacacgauuugacggaaacaucuuacuugccaaggcaagaucuagagggaaccccuuaccuggaaucuggaaucagccucuucucugaugacccugaaucugauccuucugaagacagagccccagagucagcucguguuggcaacauaccaucuucaaccucugcauugaaaguuccccaauugaaaguugcagaaucugcccagaguccagcugcugcucauacuacugauacugcuggguauaaugcaauggaagaaagugugagcagggagaagccagaauugacagcuucaacagaaagggucaacaaaagaauguccaugguggugucuggccugaccccagaagaauuuaugcucguguacaaguuugccagaaaacaccacaucacuuuaacuaaucuaauuacugaagagacuacucauguuguuaugaaaacagaugcugaguuugugugugaacggacacugaaauauuuucuaggaauugcgggaggaaaauggguaguuagcuauuucugggugacccagucuauuaaagaaagaaaaaugcugaaugagcaugauuuugaagucagaggagauguggucaauggaagaaaccaccaagguccaaagcgagcaagagaaucccaggacagaaagaucuucagggggcuagaaaucuguugcuaugggcccuucaccaacaugcccacagaucaacuggaauggaugguacagcuguguggugcuucuguggugaaggagcuuucaucauucacccuuggcacagguguccacccaauugugguugugcagccagaugccuggacagaggacaauggcuuccaugcaauugggcagaugugugaggcaccuguggugacccgagaguggguguuggacaguguagcacucuaccagugccaggagcuggacaccuaccugauaccccagaucccccacagccacuacuga

SEQ ID NO: 666 - RNA, 2160 nt, Artificial Sequence
  derived and/or modified sequence opt1 from BRCA1/m__Homo_sapiens__EAW60922
auggaccugagcgcccuccgcguggaggagguccagaacgugaucaacgccaugcagaagauccuggagugccccaucugccuggagcucaucaaggagccgguguccaccaagugcgaccacaucuucugcaaguucugcaugcugaagcugcucaaccagaagaagggccccagccagugcccccugugcaagaacgacaucaccaagcggucccugcaggagagcacgcgcuucucccagcucgucgaggagcugcugaagaucaucugcgcguuccagcucgacaccgggcuggaguacgccaacagcuacaacuucgccaagaaggagaacaacucccccgagcaccugaaggacgaggugagcaucauccaguccaugggcuaccggaaccgcgccaagcggcuccugcagagcgagccggagaaccccucccugcaggagaccagccucuccgugcagcugagcaaccuggggaccguccgcacgcuccggaccaagcagcgcauccagccccagaagaccuccguguacaucgagcuggccgcgugcgaguucagcgagaccgacgugacgaacaccgagcaccaccagcccuccaacaacgaccugaacaccaccgagaagcgggccgccgagcgccacccggagaaguaccagggcgaggccgcgagcgggugcgaguccgagacgagcgucagcgaggacugcuccggccucagcucccagagcgacauccugaccacccagcagcgggacaccaugcagcacaaccugaucaagcuccagcaggagauggccgagcuggaggccgugcuggagcagcacggcucccagcccagcaacuccuaccccagcaucaucuccgacagcuccgcccucgaggaccugcgcaaccccgagcagagcacguccgagaaggccgugcugaccagccagaaguccagcgaguacccgaucucccagaaccccgaggggcucagcgcggacaaguucgaggucuccgccgacagcagcaccuccaagaacaaggagcccggcguggagcggagcucccccagcaagugcccgucccuggacgaccgcugguacaugcacagcugcuccgggagccugcagaaccggaacuaccccucccaggaggagcucaucaagguggucgacguggaggagcagcagcuggaggagagcggcccccacgaccugaccgagacguccuaccucccccgccaggaccuggaggggaccccguaccuggagagcggcaucucccucuucagcgacgaccccgaguccgaccccagcgaggaccgggcccccgaguccgcccgcgugggcaacaucccgagcagcaccuccgcccugaaggucccccagcugaagguggcggagagcgcccagucccccgccgccgcccacaccacggacaccgcgggguacaacgccauggaggagagcgugucccgggagaagcccgagcucaccgccagcaccgagcgcgucaacaagcggauguccaugguggugagcggccugacgccggaggaguucaugcuggucuacaaguucgcccgcaagcaccacaucacccucaccaaccugaucaccgaggagacgacccacguggucaugaagaccgacgccgaguucgugugcgagcgcacccugaaguacuuccuggggaucgcgggcggcaaguggguggucuccuacuucugggugacgcagagcaucaaggagcggaagaugcucaacgagcacgacuucgaggugcgcggggacgucgugaacggccggaaccaccaggggcccaagcgcgcccgggagucccaggaccgcaagaucuuccggggccuggagaucugcugcuacgggcccuucaccaacaugccgaccgaccagcuggaguggauggugcagcucugcggcgccagcgucgugaaggagcuguccagcuucacccugggcaccggggugcaccccaucgucguggugcagcccgacgccuggacggaggacaacggcuuccacgcgaucgggcagaugugcgaggcccccgucgugacccgcgagugggugcucgacuccgucgcccuguaccagugccaggagcuggacaccuaccucaucccgcagaucccccacagccacuacuga

SEQ ID NO: 667 - RNA, 2160 nt, Artificial Sequence
  derived and/or modified sequence opt2 from BRCA1/m__Homo_sapiens__EAW60922
auggaccucuccgcccuccgcgucgaggagguccagaacgucaucaacgccaugcagaagauccucgagugccccaucugccucgagcucaucaaggagcccgucuccaccaagugcgaccacaucuucugcaaguucugcaugcucaagcuccucaaccagaagaagggccccucccagugcccccucugcaagaacgacaucaccaagcgcucccuccaggaguccacccgcuucucccagcucgucgaggagcuccucaagaucaucugcgccuuccagcucgacaccggccucgaguacgccaacuccuacaacuucgccaagaaggagaacaacucccccgagcaccucaaggacgaggucuccaucauccaguccaugggcuaccgcaaccgcgccaagcgccuccuccaguccgagcccgagaaccccucccuccaggagaccucccucuccguccagcucuccaaccucggcaccguccgcacccuccgcaccaagcagcgcauccagccccagaagaccuccgucuacaucgagcucgccgccugcgaguucuccgagaccgacgucaccaacaccgagcaccaccagcccuccaacaacgaccucaacaccaccgagaagcgcgccgccgagcgccaccccgagaaguaccagggcgaggccgccuccggcugcgaguccgagaccuccgucuccgaggacugcuccggccucuccucccaguccgacauccucaccacccagcagcgcgacaccaugcagcacaaccucaucaagcuccagcaggagauggccgagcucgaggccguccucgagcagcacggcucccagcccuccaacuccuaccccuccaucaucuccgacuccuccgcccucgaggaccuccgcaaccccgagcaguccaccuccgagaaggccguccucaccucccagaaguccuccgaguaccccaucucccagaaccccgagggccucuccgccgacaaguucgaggucuccgccgacuccuccaccuccaagaacaaggagcccggcgucgagcgcuccucccccuccaagugccccucccucgacgaccgcugguacaugcacuccugcuccggcucccuccagaaccgcaacuaccccucccaggaggagcucaucaaggucgucgacgucgaggagcagcagcucgaggaguccggcccccacgaccucaccgagaccuccuaccucccccgccaggaccucgagggcacccccuaccucgaguccggcaucucccucuucuccgacgaccccgaguccgaccccuccgaggaccgcgcccccgaguccgcccgcgucggcaacauccccuccuccaccuccgcccucaaggucccccagcucaaggucgccgaguccgcccagucccccgccgccgcccacaccaccgacaccgccggcuacaacgccauggaggaguccgucucccgcgagaagcccgagcucaccgccuccaccgagcgcgucaacaagcgcauguccauggucgucuccggccucacccccgaggaguucaugcucgucuacaaguucgcccgcaagcaccacaucacccucaccaaccucaucaccgaggagaccacccacgucgucaugaagaccgacgccgaguucgucugcgagcgcacccucaaguacuuccucggcaucgccggcggcaagugggucgucuccuacuucugggucacccaguccaucaaggagcgcaagaugcucaacgagcacgacuucgagguccgcggcgacgucgucaacggccgcaaccaccagggccccaagcgcgcccgcgagucccaggaccgcaagaucuuccgcggccucgagaucugcugcuacggccccuucaccaacaugcccaccgaccagcucgaguggaugguccagcucugcggcgccuccgucgucaaggagcucuccuccuucacccucggcaccggcguccaccccaucgucgucguccagcccgacgccuggaccgaggacaacggcuuccacgccaucggccagaugugcgaggcccccgucgucacccgcgaguggguccucgacuccgucgcccucuaccagugccaggagcucgacaccuaccucaucccccagaucccccacucccacuacuga

SEQ ID NO: 668 - RNA, 2160 nt, Artificial Sequence
  derived and/or modified sequence opt3 from BRCA1/m__Homo_sapiens__EAW60922
auggaccugagcgcccucagaguggaggaaguccagaacguuaucaaugcuaugcaaaagauucuugagugccccauaugucuggaauugaucaaagagccuguguccaccaagugcgaucacauuuucuguaaauuuugcauguuaaagcugcuaaaccagaaaaagggcccaucucaguguccgcucugcaagaaugacaucacaaaaaggucacugcaggaaaguacucgguucagccaacuuguagaggagcuguugaagauuaucugugcauuucagcucgauacggggcuggaauacgccaacuccuauaauuucgcgaaaaaggagaacaauucucccgaacaucugaaagacgaggugucgauaauccagucaaugggauaccgcaaccgagcuaagcgucucuuacagagcgagccugaaaauccaagucugcaagagaccucccuuucuguccaguugagcaaccuggguacagugagaacucuaaggaccaagcagcggauucagccccagaaaacauccguuuauaucgaacucgccgcaugcgaguuuucagaaaccgaugugacuaauacagagcaccaucaaccuaguaacaaugaccugaacaccacggagaagcgcgccgcugaaagacacccagagaaauaccagggcgaagcagccagcgggugugagucugaaacuuccgucucagaggauugcagcggacuuaguucucaauccgacauucugaccacacagcagagggauacuaugcagcauaauuugaucaagcuccaacaggagauggcugaacuggaggccguguuagaacagcacggcagccagcccucgaacucuuauccuuccauaauuucagacaguagcgcgcuggaggaucuccggaacccagaacaauccaccucugagaaagcaguacuuacaagccagaagucaagugaguacccgaucucccagaaucccgaaggucugagcgccgacaaauucgagguuucugcugauucaaguaccagcaagaacaaggaaccugggguggagcgcuccucuccaucgaaaugucccagcuuggacgaccgaugguauaugcacuccugcucaggaagucuacagaauagaaacuacccuucucaagaggaacugauuaaggucguggauguggaggaacagcagcucgaggaaagcggcccacaugaccugacggagacuuccuaccuucccaggcaggaucuggagggcacaccguauuuggaaucagggaucagccucuuuucugacgauccugaguccgaccccagugaagaucgggccccagagagcgcacgugucggaaauaucccuucuuccaccucagcucugaaaguuccccaauuaaagguggccgaaagugcgcagagcccagccgcagcucacacuacagacaccgccgguuacaacgcuauggaggagucgguaucccgcgaaaaacccgagcugacggccucuaccgaaagagugaauaagaggaugagcauggucgugucaggccuaacaccugaggaguucaugcucguuuauaaguuugcacggaaacaucacauuacucugaccaaccuuauaacagaagagacuacccacguggucaugaagacagaugccgaguucgugugcgaacgaaccuugaaauacuuucuggggaucgcuggaggcaaguggguaguuaguuauuucugggugacucaguccauuaaagaacgcaagaugcucaaugagcaugacuuugaggucagaggugauguggucaacgggaggaaucaccaaggaccaaagcgggcgcgcgaaucucaggacagaaaaaucuucaggggccuggagauauguugcuacggcccguucacgaacaugcccacagaccagcuugaauggauggugcagcuguguggggcaagcguugugaaggaguuguccucauuuacccucggaacugguguacauccuauugucgugguucaaccagaugccuggaccgaagacaauggcuuccacgcuaucgggcagaugugcgaggcccccguggucacacgugagugggugcuggauagcguagcauuauaucagugucaggaacuggacaccuaccuaaucccucaaauuccacauagucacuacuga

SEQ ID NO: 669 - RNA, 2160 nt, Artificial Sequence
  derived and/or modified sequence opt4 from BRCA1/m__Homo_sapiens__EAW60922
auggaccugagcgcccugagaguggaggaggugcagaacgugaucaacgccaugcagaagauccuggagugccccaucugccuggagcugaucaaggagcccgugagcaccaagugcgaccacaucuucugcaaguucugcaugcugaagcugcugaaccagaagaagggccccagccagugcccccugugcaagaacgacaucaccaagagaagccugcaggagagcaccagauucagccagcugguggaggagcugcugaagaucaucugcgccuuccagcuggacaccggccuggaguacgccaacagcuacaacuucgccaagaaggagaacaacagccccgagcaccugaaggacgaggugagcaucauccagagcaugggcuacagaaacagagccaagagacugcugcagagcgagcccgagaaccccagccugcaggagaccagccugagcgugcagcugagcaaccugggcaccgugagaacccugagaaccaagcagagaauccagccccagaagaccagcguguacaucgagcuggccgccugcgaguucagcgagaccgacgugaccaacaccgagcaccaccagcccagcaacaacgaccugaacaccaccgagaagagagccgccgagagacaccccgagaaguaccagggcgaggccgccagcggcugcgagagcgagaccagcgugagcgaggacugcagcggccugagcagccagagcgacauccugaccacccagcagagagacaccaugcagcacaaccugaucaagcugcagcaggagauggccgagcuggaggccgugcuggagcagcacggcagccagcccagcaacagcuaccccagcaucaucagcgacagcagcgcccuggaggaccugagaaaccccgagcagagcaccagcgagaaggccgugcugaccagccagaagagcagcgaguaccccaucagccagaaccccgagggccugagcgccgacaaguucgaggugagcgccgacagcagcaccagcaagaacaaggagcccggcguggagagaagcagccccagcaagugccccagccuggacgacagaugguacaugcacagcugcagcggcagccugcagaacagaaacuaccccagccaggaggagcugaucaaggugguggacguggaggagcagcagcuggaggagagcggcccccacgaccugaccgagaccagcuaccugcccagacaggaccuggagggcacccccuaccuggagagcggcaucagccuguucagcgacgaccccgagagcgaccccagcgaggacagagcccccgagagcgccagagugggcaacauccccagcagcaccagcgcccugaaggugccccagcugaagguggccgagagcgcccagagccccgccgccgcccacaccaccgacaccgccggcuacaacgccauggaggagagcgugagcagagagaagcccgagcugaccgccagcaccgagagagugaacaagagaaugagcaugguggugagcggccugacccccgaggaguucaugcugguguacaaguucgccagaaagcaccacaucacccugaccaaccugaucaccgaggagaccacccacguggugaugaagaccgacgccgaguucgugugcgagagaacccugaaguacuuccugggcaucgccggcggcaaguggguggugagcuacuucugggugacccagagcaucaaggagagaaagaugcugaacgagcacgacuucgaggugagaggcgacguggugaacggcagaaaccaccagggccccaagagagccagagagagccaggacagaaagaucuucagaggccuggagaucugcugcuacggccccuucaccaacaugcccaccgaccagcuggaguggauggugcagcugugcggcgccagcguggugaaggagcugagcagcuucacccugggcaccggcgugcaccccaucgugguggugcagcccgacgccuggaccgaggacaacggcuuccacgccaucggccagaugugcgaggcccccguggugaccagagagugggugcuggacagcguggcccuguaccagugccaggagcuggacaccuaccugaucccccagaucccccacagccacuacuga

SEQ ID NO: 670 - RNA, 2160 nt, Artificial Sequence
  derived and/or modified sequence opt5 from BRCA1/m__Homo_sapiens__EAW60922
auggaccugagcgcccucagaguggaggaaguccagaacguuaucaaugcuaugcaaaagauucuggagugccccaucugucuugaacugauuaaagagccuguguccaccaagugcgaucacaucuucuguaaauuuugcaugcucaagcugcuuaaccagaaaaagggcccgucucaguguccccugugcaagaaugacauuacaaaacggagccuccaggaauccacgcgcuucucucaacugguggaggagcugcucaagaucaucugugccuuucagcuggauaccgggcuugaauacgcgaacagcuauaauuucgcuaaaaaggagaacaauuccccugaacaucugaaagacgaggucucuauuauccagagcaugggauacagaaaccgggccaagcgccuccugcaguccgagcccgaaaauccuagccuucaagagacaucucuguccgugcagcucagcaaccugggcaccguuagaacacugcggaccaagcagcgcauucagccccagaaaacaucuguguauaucgaacucgccgcuugcgaguuuuccgaaaccgaugucacgaauaccgagcaccaucaaccuagcaacaaugaccugaacacaaccgagaagagagccgcugaacggcacccggagaaauaccagggggaagccgcgucuggaugugaguccgaaacaagcguguccgaggauugcucuggccuuagcucccaaagcgacauucugaccacgcagcagcgcgauacaaugcagcauaaucucaucaagcugcaacaggagauggccgaacuugaggcuguucuggaacagcacgggucucagcccuccaacagcuauccuucuauuaucagcgacuccucugcccucgaggaucugagaaaccccgaacaaagcaccuccgagaaagcugugcugacaagccagaagucuuccgaguacccuaucagccagaaucccgaaggacucucugccgacaaauucgaggucuccgcggauagcuccaccucuaagaacaaggaaccgggcguggagcggagcuccccuucuaaaugucccagccuggacgaccgcugguauaugcacuccugcagcggcucucuucagaauagaaacuacccuucccaagaggaacugauuaagguggucgauguugaggaacagcagcucgaggaaagcgggccccaugaccugaccgagacaucuuaccuuccccggcaggaucuggagggaacgccuuaucucgaauccggcaucagccuguuuucugacgauccggagagcgaccccuccgaagaucgcgccccugagagcgcuagaguggggaauauucccucuuccaccagcgcccugaaagugccucaacucaaggucgcugaauccgcccagucucccgccgcugcgcacacaaccgacacagccggauacaacgcuauggaggagagcgugucccgggaaaaaccggagcugaccgccucuacggaaagaguuaauaagcgcaugagcaugguggucuccggccuuacaccugaggaguucaugcugguguauaaguuugcccggaaacaucacaucacccucaccaaccugauuacagaagagaccacacacguugugaugaagacggaugcugaguucgucugcgaaagaacccugaaauacuuucuugggaucgccggaggcaaguggguggucucuuauuucugggugacacagagcaucaaagaacgcaagaugcucaaugagcaugacuuugagguucggggcgauguggucaacgggagaaaucaccaaggacccaagcgcgcgcgggaaucccaggacagaaaaauuuuccgcggccuggagaucuguugcuacgggccuuucaccaacaugcccacagaccagcuggaauggauggugcagcucuguggagcuagcguugugaaggagcugucuuccuuuacccuuggcacggggguccauccuauuguggugguucaacccgaugccuggaccgaagacaauggauuccacgccaucggccagaugugcgaggcuccggucgugacacgggagugggugcuggauagcgucgcccucuaucagugucaggaacuggacaccuaccugauuccucaaaucccccauucucacuacuga

SEQ ID NO: 671 - protein, 721 aa, Artificial Sequence
  BRCA1/m__Homo_sapiens__A0A024R1Z8
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 672 - RNA, 2166 nt, Artificial Sequence
  BRCA1/m__Homo_sapiens__EAW60923
auggauuuaucugcucuucgcguugaagaaguacaaaaugucauuaaugcuaugcagaaaaucuuagagugucccaucugucuggaguugaucaaggaaccugucuccacaaagugugaccacauauuuugcaaauuuugcaugcugaaacuucucaaccagaagaaagggccuucacaguguccuuuauguaagaaugauauaaccaaaaggagccuacaagaaaguacgagauuuagucaacuuguugaagagcuauugaaaaucauuugugcuuuucagcuugacacagguuuggaguaugcaaacagcuauaauuuugcaaaaaaggaaaauaacucuccugaacaucuaaaagaugaaguuucuaucauccaaaguaugggcuacagaaaccgugccaaaagacuucuacagagugaacccgaaaauccuuccuugcaggaaaccagucucaguguccaacucucuaaccuuggaacugugagaacucugaggacaaagcagcggauacaaccucaaaagacgucugucuacauugaauugggaucugauucuucugaagauaccguuaauaaggcaacuuauugcagugugggagaucaagaauuguuacaaaucaccccucaaggaaccagggaugaaaucaguuuggauucugcaaaaaagggugaagcagcaucugggugugagagugaaacaagcgucucugaagacugcucagggcuauccucucagagugacauuuuaaccacucagcagagggauaccaugcaacauaaccugauaaagcuccagcaggaaauggcugaacuagaagcuguguuagaacagcaugggagccagccuucuaacagcuacccuuccaucauaagugacucuucugcccuugaggaccugcgaaauccagaacaaagcacaucagaaaaagcaguauuaacuucacagaaaaguagugaauacccuauaagccagaauccagaaggccuuucugcugacaaguuugaggugucugcagauaguucuaccaguaaaaauaaagaaccaggaguggaaaggucauccccuucuaaaugcccaucauuagaugauaggugguacaugcacaguugcucugggagucuucagaauagaaacuacccaucucaagaggagcucauuaagguuguugauguggaggagcaacagcuggaagagucugggccacacgauuugacggaaacaucuuacuugccaaggcaagaucuagagggaaccccuuaccuggaaucuggaaucagccucuucucugaugacccugaaucugauccuucugaagacagagccccagagucagcucguguuggcaacauaccaucuucaaccucugcauugaaaguuccccaauugaaaguugcagaaucugcccagaguccagcugcugcucauacuacugauacugcuggguauaaugcaauggaagaaagugugagcagggagaagccagaauugacagcuucaacagaaagggucaacaaaagaauguccaugguggugucuggccugaccccagaagaauuuaugcucguguacaaguuugccagaaaacaccacaucacuuuaacuaaucuaauuacugaagagacuacucauguuguuaugaaaacagaugcugaguuugugugugaacggacacugaaauauuuucuaggaauugcgggaggaaaauggguaguuagcuauuucugggugacccagucuauuaaagaaagaaaaaugcugaaugagcaugauuuugaagucagaggagauguggucaauggaagaaaccaccaagguccaaagcgagcaagagaaucccaggacagaaagaucuucagggggcuagaaaucuguugcuaugggcccuucaccaacaugcccacagaucaacuggaauggaugguacagcuguguggugcuucuguggugaaggagcuuucaucauucacccuuggcacagguguccacccaauugugguugugcagccagaugccuggacagaggacaauggcuuccaugcaauugggcagaugugugaggcaccuguggugacccgagaguggguguuggacaguguagcacucuaccagugccaggagcuggacaccuaccugauaccccagaucccccacagccacuacuga

SEQ ID NO: 673 - RNA, 2166 nt, Artificial Sequence
  derived and/or modified sequence opt1 from BRCA1/m__Homo_sapiens__EAW60923
auggaccugagcgcccuccgcguggaggagguccagaacgugaucaacgccaugcagaagauccuggagugccccaucugccuggagcucaucaaggagccgguguccaccaagugcgaccacaucuucugcaaguucugcaugcugaagcugcucaaccagaagaagggccccagccagugcccccugugcaagaacgacaucaccaagcggucccugcaggagagcacgcgcuucucccagcucgucgaggagcugcugaagaucaucugcgcguuccagcucgacaccgggcuggaguacgccaacagcuacaacuucgccaagaaggagaacaacucccccgagcaccugaaggacgaggugagcaucauccaguccaugggcuaccggaaccgcgccaagcggcuccugcagagcgagccggagaaccccucccugcaggagaccagccucuccgugcagcugagcaaccuggggaccguccgcacgcuccggaccaagcagcgcauccagccccagaagaccuccguguacaucgagcugggcagcgacuccagcgaggacaccgugaacaaggccacguacugcuccgucggggaccaggagcugcuccagaucacgccccagggcacccgggacgagaucagccuggacagcgcgaagaagggcgaggccgccuccgggugcgagagcgagaccuccgugagcgaggacugcuccggccugagcucccagagcgacauccucaccacccagcagcgcgacaccaugcagcacaaccugaucaagcugcagcaggagauggccgagcucgaggcggugcuggagcagcacgggucccagccgagcaacuccuaccccagcaucaucuccgacagcuccgcccuggaggaccuccggaaccccgagcagagcaccuccgagaaggccguccugacgagccagaaguccagcgaguaccccaucagccagaacccggagggccuguccgccgacaaguucgaggugagcgccgacuccagcaccuccaagaacaaggagcccgggguggagcgcagcucccccagcaagugccccucccucgacgaccggugguacaugcacagcugcuccggcagccugcagaaccgcaacuacccgucccaggaggagcugaucaaggucguggacguggaggagcagcagcucgaggagagcggcccccacgaccugaccgagaccuccuaccugccccggcaggaccucgaggggacgcccuaccuggagagcggcaucucccuguucagcgacgacccggagagcgaccccuccgaggaccgcgcgcccgagagcgcccgggucgggaacauccccuccagcaccuccgcccucaaggugccgcagcugaagguggccgagagcgcccagucccccgcggccgcccacaccaccgacacggccggcuacaacgccauggaggagagcgucucccgcgagaagcccgagcugaccgcgagcaccgagcgggugaacaagcgcauguccaugguggucagcggccucacccccgaggaguucaugcugguguacaaguucgcccggaagcaccacaucacgcugaccaaccugaucaccgaggagaccacgcacgucgugaugaagaccgacgccgaguucgugugcgagcgcacccucaaguacuuccuggggaucgccggcgggaagugggucguguccuacuucugggugacccagagcaucaaggagcgcaagaugcugaacgagcacgacuucgagguccggggcgacguggugaacgggcgcaaccaccagggcccgaagcgggcccgcgagucccaggaccggaagaucuuccgcggccucgagaucugcugcuacgggcccuucacgaacaugcccaccgaccagcuggaguggaugguccagcugugcggcgcgagcguggugaaggagcucuccagcuucacccuggggaccggcguccacccgaucguggugguccagcccgacgccuggaccgaggacaacggguuccacgccaucggccagaugugcgaggcccccguggugacgcgggaguggguccuggacuccguggcgcucuaccagugccaggagcuggacaccuaccugaucccccagaucccgcacagccacuacuga

SEQ ID NO: 674 - RNA, 2166 nt, Artificial Sequence
  derived and/or modified sequence opt2 from BRCA1/m__Homo_sapiens__EAW60923
auggaccucuccgcccuccgcgucgaggagguccagaacgucaucaacgccaugcagaagauccucgagugccccaucugccucgagcucaucaaggagcccgucuccaccaagugcgaccacaucuucugcaaguucugcaugcucaagcuccucaaccagaagaagggccccucccagugcccccucugcaagaacgacaucaccaagcgcucccuccaggaguccacccgcuucucccagcucgucgaggagcuccucaagaucaucugcgccuuccagcucgacaccggccucgaguacgccaacuccuacaacuucgccaagaaggagaacaacucccccgagcaccucaaggacgaggucuccaucauccaguccaugggcuaccgcaaccgcgccaagcgccuccuccaguccgagcccgagaaccccucccuccaggagaccucccucuccguccagcucuccaaccucggcaccguccgcacccuccgcaccaagcagcgcauccagccccagaagaccuccgucuacaucgagcucggcuccgacuccuccgaggacaccgucaacaaggccaccuacugcuccgucggcgaccaggagcuccuccagaucaccccccagggcacccgcgacgagaucucccucgacuccgccaagaagggcgaggccgccuccggcugcgaguccgagaccuccgucuccgaggacugcuccggccucuccucccaguccgacauccucaccacccagcagcgcgacaccaugcagcacaaccucaucaagcuccagcaggagauggccgagcucgaggccguccucgagcagcacggcucccagcccuccaacuccuaccccuccaucaucuccgacuccuccgcccucgaggaccuccgcaaccccgagcaguccaccuccgagaaggccguccucaccucccagaaguccuccgaguaccccaucucccagaaccccgagggccucuccgccgacaaguucgaggucuccgccgacuccuccaccuccaagaacaaggagcccggcgucgagcgcuccucccccuccaagugccccucccucgacgaccgcugguacaugcacuccugcuccggcucccuccagaaccgcaacuaccccucccaggaggagcucaucaaggucgucgacgucgaggagcagcagcucgaggaguccggcccccacgaccucaccgagaccuccuaccucccccgccaggaccucgagggcacccccuaccucgaguccggcaucucccucuucuccgacgaccccgaguccgaccccuccgaggaccgcgcccccgaguccgcccgcgucggcaacauccccuccuccaccuccgcccucaaggucccccagcucaaggucgccgaguccgcccagucccccgccgccgcccacaccaccgacaccgccggcuacaacgccauggaggaguccgucucccgcgagaagcccgagcucaccgccuccaccgagcgcgucaacaagcgcauguccauggucgucuccggccucacccccgaggaguucaugcucgucuacaaguucgcccgcaagcaccacaucacccucaccaaccucaucaccgaggagaccacccacgucgucaugaagaccgacgccgaguucgucugcgagcgcacccucaaguacuuccucggcaucgccggcggcaagugggucgucuccuacuucugggucacccaguccaucaaggagcgcaagaugcucaacgagcacgacuucgagguccgcggcgacgucgucaacggccgcaaccaccagggccccaagcgcgcccgcgagucccaggaccgcaagaucuuccgcggccucgagaucugcugcuacggccccuucaccaacaugcccaccgaccagcucgaguggaugguccagcucugcggcgccuccgucgucaaggagcucuccuccuucacccucggcaccggcguccaccccaucgucgucguccagcccgacgccuggaccgaggacaacggcuuccacgccaucggccagaugugcgaggcccccgucgucacccgcgaguggguccucgacuccgucgcccucuaccagugccaggagcucgacaccuaccucaucccccagaucccccacucccacuacuga

SEQ ID NO: 675 - RNA, 2166 nt, Artificial Sequence
  derived and/or modified sequence opt3 from BRCA1/m__Homo_sapiens__EAW60923
auggaccugagcgcccucagaguggaggaaguccagaacguuaucaaugcuaugcaaaagauucuugagugccccauaugucuggaauugaucaaagagccuguguccaccaagugcgaucacauuuucuguaaauuuugcauguuaaagcugcuaaaccagaaaaagggcccaucucaguguccgcucugcaagaaugacaucacaaaaaggucacugcaggaaaguacucgguucagccaacuuguagaggagcuguugaagauuaucugugcauuucagcucgauacggggcuggaauacgccaacuccuauaauuucgcgaaaaaggagaacaauucucccgaacaucugaaagacgaggugucgauaauccagucaaugggauaccgcaaccgagcuaagcgucucuuacagagcgagccugaaaauccaagucugcaagagaccucccuuucuguccaguugagcaaccuggguacagugagaacucuaaggaccaagcagcggauucagccccagaaaacauccguuuauaucgaacucggcucagauaguagcgaggacaccgugaauaaggccacuuacugcucugucggggaucaagaacugcuucagauuacaccucaaggaacccgcgacgagaucucccuggauucagccaaaaagggcgaggcagcuagcgguugugaaagugagacgucuguguccgaagacugcagcggguugucgucucaguccgauauacucacuacccagcagagagacacaaugcaacacaaccugauuaaauuacagcaggagauggcagaacuggaggccguacucgagcagcauggaucacaaccaaguaauagcuaucccuccaucauuucugauagcucagcucuugaagaccugaggaacccugagcagaguacuuccgaaaaggccguuuugaccagccagaaaucuucagaguacccaaucagucagaauccggaaggccuaagcgcggacaaguuugagguguccgcagauucuucgacaagcaagaacaaagagcccggcgucgaacgguccucaccuaguaaguguccaucucuggacgaucgcugguauaugcacagcugcuccgggucacuccaaaaccgaaauuaccccagccaggaggaacugaucaaagugguggacgucgaggagcagcagcuugaagagucuggaccucaugaucugaccgaaacguccuacuugccaagacaagaccucgaggguacucccuaucuggaaaguggcauuagcuuauucucugaugacccggaguccgauccuucagaggacagggcccccgaaagugcucggguugggaacauaccaagcucgacauccgcccugaaggugccucagcuaaaaguagcagagucugcucagagccccgccgcggcccacaccacugauacagcaggauacaaugcuauggaagagucagugagucgugaaaagccagagcucaccgccuccacggagcgcgucaacaagagaaugucuauggugguuagcggccugacccccgaagaguuuaugcuuguguauaaauucgcuaggaagcaccauaucacauugacuaaucugauuaccgaagagacaacucacgucgugaugaaaaccgacgccgaauuuguaugcgagcggacacucaaguacuuccuggguaucgcagggggaaaauggguuguguccuauuuuugggucacccaaucaauaaaggagcgaaagaugcuuaacgaacaugacuucgaggugcgcggcgaugucgugaauggcagaaaccaccaggggccuaaaagggcccgggaaagccaggaccgcaagauuuuuagaggacuggagaucuguugcuacgguccauucacuaauaugccgacggaucaguuggaguggaugguucaacucuguggcgcuagugugguaaaagaacugucuuccuucacauuagggaccggaguccaccccaucgugguugugcagccugacgcguggacugaggauaacggcuuucaugcaauuggucagaugugcgaagccccagucgugaccagggaguggguacuggacagcguggcucuauaucagugucaagaacucgauacauaccugaucccccagauuccucacucgcauuacuga

SEQ ID NO: 676 - RNA, 2166 nt, Artificial Sequence
  derived and/or modified sequence opt4 from BRCA1/m__Homo_sapiens__EAW60923
auggaccugagcgcccugagaguggaggaggugcagaacgugaucaacgccaugcagaagauccuggagugccccaucugccuggagcugaucaaggagcccgugagcaccaagugcgaccacaucuucugcaaguucugcaugcugaagcugcugaaccagaagaagggccccagccagugcccccugugcaagaacgacaucaccaagagaagccugcaggagagcaccagauucagccagcugguggaggagcugcugaagaucaucugcgccuuccagcuggacaccggccuggaguacgccaacagcuacaacuucgccaagaaggagaacaacagccccgagcaccugaaggacgaggugagcaucauccagagcaugggcuacagaaacagagccaagagacugcugcagagcgagcccgagaaccccagccugcaggagaccagccugagcgugcagcugagcaaccugggcaccgugagaacccugagaaccaagcagagaauccagccccagaagaccagcguguacaucgagcugggcagcgacagcagcgaggacaccgugaacaaggccaccuacugcagcgugggcgaccaggagcugcugcagaucaccccccagggcaccagagacgagaucagccuggacagcgccaagaagggcgaggccgccagcggcugcgagagcgagaccagcgugagcgaggacugcagcggccugagcagccagagcgacauccugaccacccagcagagagacaccaugcagcacaaccugaucaagcugcagcaggagauggccgagcuggaggccgugcuggagcagcacggcagccagcccagcaacagcuaccccagcaucaucagcgacagcagcgcccuggaggaccugagaaaccccgagcagagcaccagcgagaaggccgugcugaccagccagaagagcagcgaguaccccaucagccagaaccccgagggccugagcgccgacaaguucgaggugagcgccgacagcagcaccagcaagaacaaggagcccggcguggagagaagcagccccagcaagugccccagccuggacgacagaugguacaugcacagcugcagcggcagccugcagaacagaaacuaccccagccaggaggagcugaucaaggugguggacguggaggagcagcagcuggaggagagcggcccccacgaccugaccgagaccagcuaccugcccagacaggaccuggagggcacccccuaccuggagagcggcaucagccuguucagcgacgaccccgagagcgaccccagcgaggacagagcccccgagagcgccagagugggcaacauccccagcagcaccagcgcccugaaggugccccagcugaagguggccgagagcgcccagagccccgccgccgcccacaccaccgacaccgccggcuacaacgccauggaggagagcgugagcagagagaagcccgagcugaccgccagcaccgagagagugaacaagagaaugagcaugguggugagcggccugacccccgaggaguucaugcugguguacaaguucgccagaaagcaccacaucacccugaccaaccugaucaccgaggagaccacccacguggugaugaagaccgacgccgaguucgugugcgagagaacccugaaguacuuccugggcaucgccggcggcaaguggguggugagcuacuucugggugacccagagcaucaaggagagaaagaugcugaacgagcacgacuucgaggugagaggcgacguggugaacggcagaaaccaccagggccccaagagagccagagagagccaggacagaaagaucuucagaggccuggagaucugcugcuacggccccuucaccaacaugcccaccgaccagcuggaguggauggugcagcugugcggcgccagcguggugaaggagcugagcagcuucacccugggcaccggcgugcaccccaucgugguggugcagcccgacgccuggaccgaggacaacggcuuccacgccaucggccagaugugcgaggcccccguggugaccagagagugggugcuggacagcguggcccuguaccagugccaggagcuggacaccuaccugaucccccagaucccccacagccacuacuga

SEQ ID NO: 677 - RNA, 2166 nt, Artificial Sequence
  derived and/or modified sequence opt5 from BRCA1/m__Homo_sapiens__EAW60923
auggaccugagcgcccucagaguggaggaaguccagaacguuaucaaugcuaugcaaaagauucuggagugccccaucugucuugaacugauuaaagagccuguguccaccaagugcgaucacaucuucuguaaauuuugcaugcucaagcugcuuaaccagaaaaagggcccgucucaguguccccugugcaagaaugacauuacaaaacggagccuccaggaauccacgcgcuucucucaacugguggaggagcugcucaagaucaucugugccuuucagcuggauaccgggcuugaauacgcgaacagcuauaauuucgcuaaaaaggagaacaauuccccugaacaucugaaagacgaggucucuauuauccagagcaugggauacagaaaccgggccaagcgccuccugcaguccgagcccgaaaauccuagccuucaagagacaucucuguccgugcagcucagcaaccugggcaccguuagaacacugcggaccaagcagcgcauucagccccagaaaacaucuguguauaucgaacucggguccgauagcucugaggacaccgucaauaaggccacguacugcuccgugggagaucaagaacugcuucagauuaccccucaaggcacaagagacgagaucagccuggauuccgcuaaaaagggggaggccgcuucuggaugugaaagcgagaccuccguuagcgaagacugcucuggccucuccagccagucugauauucugacaacccagcagcgggacacgaugcaacacaaccuuaucaaacugcagcaggagauggccgaacucgaggcggugcuggagcagcauggcagccaaccguccaauucuuaucccagcaucauuuccgauagcucugcccuggaagaccuccgcaacccugagcaguccacaagcgaaaaggcuguccugaccucucagaaauccagcgaguaccccaucucccagaauccugaagggcuuucugccgacaaguuugaggugagcgcugauuccucuacaagcaagaacaaagagcccggaguggaaagauccagcccgucuaaguguccuucccuggacgaucggugguauaugcacagcugcucuggcucccuccaaaaccgcaauuaccccagccaggaggaacugauuaaagucguugacguggaggagcagcagcuugaagagucugggccucaugaucugaccgaaaccagcuaccuccccagacaagaccuggagggaacacccuaucuggaauccggcaucagccucuucucugaugacccugaguccgauccgagcgaggaccgggcccccgaauccgcgcgcguggggaacauuccuucuagcacguccgcccugaaggucccccagcuuaaaguggcugagucugcccagagcccugcugccgcccacaccacagauaccgcuggauacaaugcgauggaagaguccguuucuagagaaaagcccgagcugacagccagcaccgagcgggugaacaagagaauguccauggucgugagcggccucacgccggaagaguuuaugcugguuuauaaauucgcucgcaagcaccauaucacacugaccaaucuuaucaccgaagagacaacccacguggucaugaaaacagacgccgaauuugugugcgagcggacgcucaaguacuuccugggcauugccgggggaaaaugggucgugucuuauuuuuggguuacccaauccaucaaggagagaaagaugcugaacgaacaugacuucgaggugcgcggcgaugucgugaaugggcggaaccaccagggaccuaaaagagcucgcgaaagccaggaccggaagauuuuuagaggccucgagaucuguugcuacgggcccuucacaaauaugccuaccgaucagcuggaguggaugguucaacuuuguggagccucuguggucaaagaacuguccagcuucacacucggcaccggcgugcaccccauugugguuguccagccugacgcguggacggaggauaacggguuucaugcuaucggacagaugugcgaagcccccguggugacccgcgaguggguccuggacucuguggcccuguaucagugucaagaacuugauacauaccucaucccgcagauuccucacucccauuacuga

SEQ ID NO: 678 - protein, 11 aa, Artificial Sequence
  BRCA1/m__Homo_sapiens__A0A068BFX7
MDLSALRVEEV

SEQ ID NO: 679 - RNA, 36 nt, Artificial Sequence
  BRCA1/m__Homo_sapiens__AIC83575
auggauuuaucugcucuucgcguugaagaaguauaa

SEQ ID NO: 680 - RNA, 36 nt, Artificial Sequence
  derived and/or modified sequence opt1 from BRCA1/m__Homo_sapiens__AIC83575
auggaccugagcgcccuccgcguggaggaggucuga

SEQ ID NO: 681 - RNA, 36 nt, Artificial Sequence
  derived and/or modified sequence opt2 from BRCA1/m__Homo_sapiens__AIC83575
auggaccucuccgcccuccgcgucgaggaggucuga

SEQ ID NO: 682 - RNA, 36 nt, Artificial Sequence
  derived and/or modified sequence opt3 from BRCA1/m__Homo_sapiens__AIC83575
auggaccugagcgcccucagaguggaggaagucuga

SEQ ID NO: 683 - RNA, 36 nt, Artificial Sequence
  derived and/or modified sequence opt4 from BRCA1/m__Homo_sapiens__AIC83575
auggaccugagcgcccugagaguggaggagguguga

SEQ ID NO: 684 - RNA, 36 nt, Artificial Sequence; identical to SEQ ID NO: 682
  derived and/or modified sequence opt5 from BRCA1/m__Homo_sapiens__AIC83575

SEQ ID NO: 685 - protein, 173 aa, Artificial Sequence
  BRCA1/m__Homo_sapiens__C6YB45
MDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 686 - RNA, 522 nt, Artificial Sequence
  BRCA1/m__Homo_sapiens__ABC59810
auggaugcugaguuugugugugaacggacacugaaauauuuucuaggaauugcgggaggaaaauggguaguuagcuauuucugggugacccagucuauuaaagaaagaaaaaugcugaaugagcaugauuuugaagucagaggagauguggucaauggaagaaaccaccaagguccaaagcgagcaagagaaucccaggacagaaagaucuucagggggcuagaaaucuguugcuaugggcccuucaccaacaugcccacagaucaacuggaauggaugguacagcuguguggugcuucuguggugaaggagcuuucaucauucacccuuggcacagguguccacccaauugugguugugcagccagaugccuggacagaggacaauggcuuccaugcaauugggcagaugugugaggcaccuguggugacccgagaguggguguuggacaguguagcacucuaccagugccaggagcuggacaccuaccugauaccccagaucccccacagccacuacuga

SEQ ID NO: 687 - RNA, 522 nt, Artificial Sequence
  derived and/or modified sequence opt1 from BRCA1/m__Homo_sapiens__ABC59810
auggacgccgaguucgugugcgagcgcacccugaaguacuuccucggcaucgccgggggcaagugggucgugagcuacuucugggugacccaguccaucaaggagcggaagaugcugaacgagcacgacuucgagguccgcggggacguggugaacggccggaaccaccaggggcccaagcgcgcgcgggagagccaggaccgcaagaucuuccggggccuggagaucugcugcuacggcccguucacgaacaugcccaccgaccagcucgaguggaugguccagcugugcggggccuccguggugaaggagcugagcuccuucacccucggcaccgggguccaccccaucguggugguccagcccgacgccuggacggaggacaacggcuuccacgccaucgggcagaugugcgaggccccgguggugacccgcgaguggguccuggacagcguggcgcuguaccagugccaggagcucgacaccuaccugaucccccagaucccccacucccacuacuga

SEQ ID NO: 688 - RNA, 522 nt, Artificial Sequence
  derived and/or modified sequence opt2 from BRCA1/m__Homo_sapiens__ABC59810
auggacgccgaguucgucugcgagcgcacccucaaguacuuccucggcaucgccggcggcaagugggucgucuccuacuucugggucacccaguccaucaaggagcgcaagaugcucaacgagcacgacuucgagguccgcggcgacgucgucaacggccgcaaccaccagggccccaagcgcgcccgcgagucccaggaccgcaagaucuuccgcggccucgagaucugcugcuacggccccuucaccaacaugcccaccgaccagcucgaguggaugguccagcucugcggcgccuccgucgucaaggagcucuccuccuucacccucggcaccggcguccaccccaucgucgucguccagcccgacgccuggaccgaggacaacggcuuccacgccaucggccagaugugcgaggcccccgucgucacccgcgaguggguccucgacuccgucgcccucuaccagugccaggagcucgacaccuaccucaucccccagaucccccacucccacuacuga

SEQ ID NO: 689 - RNA, 522 nt, Artificial Sequence
  derived and/or modified sequence opt3 from BRCA1/m__Homo_sapiens__ABC59810
auggacgccgaguucgugugcgaaagaacccugaaguacuuucucggcaucgcugggggaaaaugggucguuagcuauuucugggugacacaguccauuaaggagaggaaaaugcuuaacgaacacgauuuugagguacggggugacguggucaauggccgcaaccaucaagggcccaagcgagcacgugaaucucaggauagaaaaauauucaggggacuggagaucuguugcuacggcccuuuuacuaauaugccaacggaccaguuggaguggauggugcaguuauguggugccucaguugugaaggaacugaguagcuucacccuagggacaggaguccacccgauugugguaguucaacccgaugcguggacugaggacaacggcuuucaugcuaucggccagaugugcgaagccccuguggucacccgggagugggugcucgauuccguggcacuguaucagugucaggagcuugacacauaccugauuccacaaaucccccacucucauuauuga

SEQ ID NO: 690 - RNA, 522 nt, Artificial Sequence
  derived and/or modified sequence opt4 from BRCA1/m__Homo_sapiens__ABC59810
auggacgccgaguucgugugcgagagaacccugaaguacuuccugggcaucgccggcggcaaguggguggugagcuacuucugggugacccagagcaucaaggagagaaagaugcugaacgagcacgacuucgaggugagaggcgacguggugaacggcagaaaccaccagggccccaagagagccagagagagccaggacagaaagaucuucagaggccuggagaucugcugcuacggccccuucaccaacaugcccaccgaccagcuggaguggauggugcagcugugcggcgccagcguggugaaggagcugagcagcuucacccugggcaccggcgugcaccccaucgugguggugcagcccgacgccuggaccgaggacaacggcuuccacgccaucggccagaugugcgaggcccccguggugaccagagagugggugcuggacagcguggcccuguaccagugccaggagcuggacaccuaccugaucccccagaucccccacagccacuacuga

SEQ ID NO: 691 - RNA, 522 nt, Artificial Sequence
  derived and/or modified sequence opt5 from BRCA1/m__Homo_sapiens__ABC59810
auggacgccgaguucgugugcgaaagaacccugaaguacuuucucggcaucgcugggggaaaaugggucguuagcuauuucugggugacacaguccauuaaggagcggaaaaugcugaacgaacacgauuuugaggugcgcggcgacgucgugaaugggagaaaccaucaaggacccaagcgggcccgcgaaucucaggauagaaaaaucuuccggggccuugagauuuguugcuacgggccuuuuacgaauaugccgaccgaccagcuggaguggaugguucagcucuguggagcgagcguggucaaggaacuguccucuuucacacuuggcaccggcgugcaccccaucguugugguccaaccugaugcuuggacagaggacaacggguuucaugccauuggacagaugugcgaagcccccguggugacccgcgaguggguccuggauagcguugcucucuaucagugucaggagcuggacacauaccugaucccucaaaucccccacucccauuauuga

SEQ ID NO: 692 - protein, 354 aa, Artificial Sequence [sequence omitted]

SEQ ID NO: 693 - RNA, 1065 nt, Artificial Sequence
  BRCA1/m__Homo_sapiens__ABC88652
augcacaguugcucugggagucuucagaauagaaacuacccaucucaagaggagcucauuaagguuguugauguggaggagcaacagcuggaagagucugggccacacgauuugacggaaacaucuuacuugccaaggcaagaucuagagggaaccccuuaccuggaaucuggaaucagccucuucucugaugacccugaaucugauccuucugaagacagagccccagagucagcucguguuggcaacauaccaucuucaaccucugcauugaagguuccccaauugaaaguugcagaaucugcccaggguccagcugcugcucacacuacugauacugcuggguauaaugcaauggaagaaagugugagcagggagaagccagaauugacagcuucaacagaaagggucaacaaaagaauguccaugguggugucuggccugaccccagaagaauuuaugcucguguacaaguuugccagaaaacaccacaucacuuuaacuaaucuaauuacugaagagacuacucauguuguuaugaaaacagaugcugaguuugugugugaacggacacugaaauauuuucuaggaauugcgggaggaaaauggguaguuagcuauuucugggugacccagucuauuaaagaaagaaaaaugcugaaugagcaugauuuugaagucagaggagauguggucaauggaagaaaccaccaagguccaaagcgagcaagagaaucccaggacagaaagaucuucagggggcuagaaaucuguugcuaugggcccuucaccaacaugcccacagaucaacuggaauggaugguacagcuguguggugcuucuguggugaaggagcuuucaucauucacccuuggcacagguguccacccaauugugguugugcagccagaugccuggacagaggacaauggcuuccaugcaauugggcagaugugugagacaccuguggugacccgagaguggguguuggacaguguagcacucuaccagugccaggagcuggacaccuaccugauaccccagaucccccacagucacuacuga

SEQ ID NO: 694 - RNA, 1065 nt, Artificial Sequence
  derived and/or modified sequence opt1 from BRCA1/m__Homo_sapiens__ABC88652
augcacagcugcuccggcagccugcagaaccgcaacuaccccucccaggaggagcucaucaagguggucgacguggaggagcagcagcuggaggagagcgggccgcacgaccugaccgagaccuccuaccucccccggcaggaccuggagggcacgcccuaccuggagagcgggaucucccucuucagcgacgaccccgaguccgacccgagcgaggaccgcgcccccgaguccgcccgggugggcaacauccccagcuccaccagcgcgcugaaggucccccagcugaagguggccgaguccgcccaggggccggccgccgcgcacaccaccgacacggccggcuacaacgccauggaggagagcgugucccgcgagaagcccgagcucaccgccagcaccgagcgggucaacaagcgcauguccaugguggugagcggccugacccccgaggaguucaugcuggucuacaaguucgcgcggaagcaccacaucacgcucaccaaccugaucaccgaggagaccacgcacguggugaugaagaccgacgccgaguucgucugcgagcgcacccugaaguacuuccucgggaucgccggcgggaaguggguggugagcuacuucugggucacccaguccaucaaggagcggaagaugcugaacgagcacgacuucgaggugcgcggcgacguggucaacgggcggaaccaccagggccccaagcgcgcccgggagagccaggaccgcaagaucuuccggggccuggagaucugcugcuacgggccguucacgaacaugcccaccgaccagcucgaguggauggugcagcugugcggcgccuccguggucaaggagcugagcuccuucacccucgggaccggcgugcaccccaucguggucgugcagcccgacgcguggacggaggacaacggcuuccacgccaucgggcagaugugcgagaccccggucgugacccgcgagugggugcuggacagcgucgcccuguaccagugccaggagcucgacaccuaccugaucccccagaucccccacucccacuacuga

SEQ ID NO: 695 - RNA, 1065 nt, Artificial Sequence
  derived and/or modified sequence opt2 from BRCA1/m__Homo_sapiens__ABC88652
augcacuccugcuccggcucccuccagaaccgcaacuaccccucccaggaggagcucaucaaggucgucgacgucgaggagcagcagcucgaggaguccggcccccacgaccucaccgagaccuccuaccucccccgccaggaccucgagggcacccccuaccucgaguccggcaucucccucuucuccgacgaccccgaguccgaccccuccgaggaccgcgcccccgaguccgcccgcgucggcaacauccccuccuccaccuccgcccucaaggucccccagcucaaggucgccgaguccgcccagggccccgccgccgcccacaccaccgacaccgccggcuacaacgccauggaggaguccgucucccgcgagaagcccgagcucaccgccuccaccgagcgcgucaacaagcgcauguccauggucgucuccggccucacccccgaggaguucaugcucgucuacaaguucgcccgcaagcaccacaucacccucaccaaccucaucaccgaggagaccacccacgucgucaugaagaccgacgccgaguucgucugcgagcgcacccucaaguacuuccucggcaucgccggcggcaagugggucgucuccuacuucugggucacccaguccaucaaggagcgcaagaugcucaacgagcacgacuucgagguccgcggcgacgucgucaacggccgcaaccaccagggccccaagcgcgcccgcgagucccaggaccgcaagaucuuccgcggccucgagaucugcugcuacggccccuucaccaacaugcccaccgaccagcucgaguggaugguccagcucugcggcgccuccgucgucaaggagcucuccuccuucacccucggcaccggcguccaccccaucgucgucguccagcccgacgccuggaccgaggacaacggcuuccacgccaucggccagaugugcgagacccccgucgucacccgcgaguggguccucgacuccgucgcccucuaccagugccaggagcucgacaccuaccucaucccccagaucccccacucccacuacuga

SEQ ID NO: 696 - RNA, 1065 nt, Artificial Sequence
  derived and/or modified sequence opt3 from BRCA1/m__Homo_sapiens__ABC88652
augcacagcugcuccggcucucugcagaacagaaauuaccccucacaagaggaacucaucaagguggucgacguugaggaacagcagcuugaggaaagugggccucaugaucugaccgagacaagcuauuugccaaggcaggacuuagagggaacuccguaccuggaauccgguauuucucuauucucggaugaccccgagucagauccuagcgaagaccgggccccagagagugcucgcgugggcaacauacccuccucuacgagcgcacucaaaguaccucaacugaagguggccgaguccgcgcaggggccagcugccgcacacaccacagauacugccggauauaaugcuauggaagagucagucagucgagaaaaacccgagcuuaccgcaagcacagaacgugugaacaagagaaugucuaugguuguguccggccugaccccugaggaguuuauguuggucuacaaauucgccaggaagcaucacaucacucucacaaaucugauuaccgaagagacgacucaugugguaaugaagaccgacgcugaauuuguuugugagcggacacugaaauauuuccucgguaucgccgggggaaaguggguggucucauacuuuugggugacucagagcauuaaagaacgcaagauguuaaacgagcacgauuucgaggugagaggcgacgucguuaauggcaggaaccaccaggggccaaaacgggcgcgcgaaagucaagaucgaaagaucuuuagaggacuggagauaugcuguuaugguccguucaccaauaugcccacagaccagcuugaauggauggugcaguugugcggcgcaucuguagugaaggagcuguccagcuuuacccuagggacgggaguccauccuaucgugguugugcagccagaugccuggacugaagacaacggcuuccacgcuauuggucaaaugugugagacacccgucgugaccagggaguggguacucgacucgguugcccuguaccagugccaggaacuugauacuuaccugaucccucaaauuccacauucucacuauuga

SEQ ID NO: 697 - RNA, 1065 nt, Artificial Sequence
  derived and/or modified sequence opt4 from BRCA1/m__Homo_sapiens__ABC88652
augcacagcugcagcggcagccugcagaacagaaacuaccccagccaggaggagcugaucaaggugguggacguggaggagcagcagcuggaggagagcggcccccacgaccugaccgagaccagcuaccugcccagacaggaccuggagggcacccccuaccuggagagcggcaucagccuguucagcgacgaccccgagagcgaccccagcgaggacagagcccccgagagcgccagagugggcaacauccccagcagcaccagcgcccugaaggugccccagcugaagguggccgagagcgcccagggccccgccgccgcccacaccaccgacaccgccggcuacaacgccauggaggagagcgugagcagagagaagcccgagcugaccgccagcaccgagagagugaacaagagaaugagcaugguggugagcggccugacccccgaggaguucaugcugguguacaaguucgccagaaagcaccacaucacccugaccaaccugaucaccgaggagaccacccacguggugaugaagaccgacgccgaguucgugugcgagagaacccugaaguacuuccugggcaucgccggcggcaaguggguggugagcuacuucugggugacccagagcaucaaggagagaaagaugcugaacgagcacgacuucgaggugagaggcgacguggugaacggcagaaaccaccagggccccaagagagccagagagagccaggacagaaagaucuucagaggccuggagaucugcugcuacggccccuucaccaacaugcccaccgaccagcuggaguggauggugcagcugugcggcgccagcguggugaaggagcugagcagcuucacccugggcaccggcgugcaccccaucgugguggugcagcccgacgccuggaccgaggacaacggcuuccacgccaucggccagaugugcgagacccccguggugaccagagagugggugcuggacagcguggcccuguaccagugccaggagcuggacaccuaccugaucccccagaucccccacagccacuacuga

SEQ ID NO: 698 - RNA, 1065 nt, Artificial Sequence
  derived and/or modified sequence opt5 from BRCA1/m__Homo_sapiens__ABC88652
augcacagcugcuccggcucucugcagaacagaaauuaccccagccaagaggaacucaucaagguggucgacguugaggaacagcagcuggaggaauccgggccucaugaucuuaccgagacaucuuaucugccgcggcaggaccucgagggaacgcccuaccuggaaagcggcauuucccuuuucucugaugacccugagagcgaucccuccgaagaccgcgccccugagagcgcuagaguggggaacauccccucuuccaccagcgcccugaaagugccucaacucaaggucgcggagucugcucagggaccggccgccgcucacacaaccgauacagccggcuauaaugcuauggaagaguccgugagccgggaaaaacccgagcugaccgccucuacagaacgcguuaacaagagaauguccaugguggucagcgggcugaccccugaggaguuuaugcucguguacaaauucgcgcggaagcaucacauuacgcugaccaaucuuaucacagaagagaccacacauguugugaugaagaccgacgccgaauuugucugugagcgcacgcugaaauauuuccucggaauugcuggcggcaagugggugguguccuacuuuugggucacacagucuaucaaagaaagaaagaugcugaacgagcacgauuucgagguucgcggggacguggugaauggacggaaccaccagggccccaaaagagcccgggaaagccaagaucgcaagaucuuuagagggcuugagauuugcuguuauggaccuuucaccaauaugcccacagaccagcuggaauggaugguccagcucugcggcgcuuccgugguuaaggagcugagcucuuuuacccuggggaccggagugcauccgaucgucgugguucagccugaugccuggacagaagacaacggcuuccacgcgauuggccaaaugugugagacgcccguggucacccgggagugggugcucgacuccgucgcccuguaccagugccaggaacuugauacauaccugaucccucaaauuccccauagccacuauuga

SEQ ID NO: 699 - protein, 680 aa, Artificial Sequence
  BRCA1/m__Homo_sapiens__G3XAC3
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 700 - RNA, 2043 nt, Artificial Sequence
  BRCA1/m__Homo_sapiens__EAW60939
auggauuuaucugcucuucgcguugaagaaguacaaaaugucauuaaugcuaugcagaaaaucuuagagugucccaucugucuggaguugaucaaggaaccugucuccacaaagugugaccacauauuuugcaaauuuugcaugcugaaacuucucaaccagaagaaagggccuucacaguguccuuuauguaagaaugauauaaccaaaaggagccuacaagaaaguacgagauuuagucaacuuguugaagagcuauugaaaaucauuugugcuuuucagcuugacacagguuuggaguaugcaaacagcuauaauuuugcaaaaaaggaaaauaacucuccugaacaucuaaaagaugaaguuucuaucauccaaaguaugggcuacagaaaccgugccaaaagacuucuacagagugaacccgaaaauccuuccuugcaggaaaccagucucaguguccaacucucuaaccuuggaacugugagaacucugaggacaaagcagcggauacaaccucaaaagacgucugucuacauugaauugggugaagcagcaucugggugugagagugaaacaagcgucucugaagacugcucagggcuauccucucagagugacauuuuaaccacucagcagagggauaccaugcaacauaaccugauaaagcuccagcaggaaauggcugaacuagaagcuguguuagaacagcaugggagccagccuucuaacagcuacccuuccaucauaagugacucuucugcccuugaggaccugcgaaauccagaacaaagcacaucagaaaaagcaguauuaacuucacagaaaaguagugaauacccuauaagccagaauccagaaggccuuucugcugacaaguuugaggugucugcagauaguucuaccaguaaaaauaaagaaccaggaguggaaaggucauccccuucuaaaugcccaucauuagaugauaggugguacaugcacaguugcucugggagucuucagaauagaaacuacccaucucaagaggagcucauuaagguuguugauguggaggagcaacagcuggaagagucugggccacacgauuugacggaaacaucuuacuugccaaggcaagaucuagagggaaccccuuaccuggaaucuggaaucagccucuucucugaugacccugaaucugauccuucugaagacagagccccagagucagcucguguuggcaacauaccaucuucaaccucugcauugaaaguuccccaauugaaaguugcagaaucugcccagaguccagcugcugcucauacuacugauacugcuggguauaaugcaauggaagaaagugugagcagggagaagccagaauugacagcuucaacagaaagggucaacaaaagaauguccaugguggugucuggccugaccccagaagaauuuaugcucguguacaaguuugccagaaaacaccacaucacuuuaacuaaucuaauuacugaagagacuacucauguuguuaugaaaacagaugcugaguuugugugugaacggacacugaaauauuuucuaggaauugcgggaggaaaauggguaguuagcuauuucugggugacccagucuauuaaagaaagaaaaaugcugaaugagcaugauuuugaagucagaggagauguggucaauggaagaaaccaccaagguccaaagcgagcaagagaaucccaggacagaaagaucuucagggggcuagaaaucuguugcuaugggcccuucaccaacaugcccacagaucaacuggaauggaugguacagcuguguggugcuucuguggugaaggagcuuucaucauucacccuuggcacagguguccacccaauugugguugugcagccagaugccuggacagaggacaauggcuuccaugcaauugggcagaugugugaggcaccuguggugacccgagaguggguguuggacaguguagcacucuaccagugccaggagcuggacaccuaccugauaccccagaucccccacagccacuacuga

SEQ ID NO: 701 - RNA, 2043 nt, Artificial Sequence
  derived and/or modified sequence opt1 from BRCA1/m__Homo_sapiens__EAW60939
auggaccugagcgcccuccgcguggaggagguccagaacgugaucaacgccaugcagaagauccuggagugccccaucugccuggagcucaucaaggagccgguguccaccaagugcgaccacaucuucugcaaguucugcaugcugaagcugcucaaccagaagaagggccccagccagugcccccugugcaagaacgacaucaccaagcggucccugcaggagagcacgcgcuucucccagcucgucgaggagcugcugaagaucaucugcgcguuccagcucgacaccgggcuggaguacgccaacagcuacaacuucgccaagaaggagaacaacucccccgagcaccugaaggacgaggugagcaucauccaguccaugggcuaccggaaccgcgccaagcggcuccugcagagcgagccggagaaccccucccugcaggagaccagccucuccgugcagcugagcaaccuggggaccguccgcacgcuccggaccaagcagcgcauccagccccagaagaccuccguguacaucgagcugggcgaggccgcgagcgggugcgaguccgagaccagcguguccgaggacugcagcggccugagcucccagagcgacauccucacgacccagcagcgggacaccaugcagcacaaccugaucaagcugcagcaggagauggccgagcucgaggccguccuggagcagcacggcucccagcccagcaacuccuacccgagcaucaucuccgacagcuccgcccuggaggaccuccgcaaccccgagcagagcaccuccgagaaggcggugcugacgagccagaaguccagcgaguaccccaucucccagaaccccgaggggcugagcgccgacaaguucgagguguccgccgacagcuccaccagcaagaacaaggagccgggcgucgagcggagcucccccagcaagugccccucccucgacgaccgcugguacaugcacagcugcuccgggagccugcagaaccggaacuaccccucccaggaggagcugaucaaggugguggacgucgaggagcagcagcucgaggagagcggcccgcacgaccugaccgagaccuccuaccugccccgccaggaccucgaggggacgcccuaccuggagagcggcaucucccuguucagcgacgaccccgaguccgacccgagcgaggaccgggcccccgaguccgcccgcgugggcaacauccccagcuccaccagcgcgcucaaggugccccagcugaaggucgccgagagcgcccaguccccggccgccgcgcacaccaccgacacggccggguacaacgccauggaggagagcgugucccgggagaagcccgagcugaccgccagcaccgagcgcgugaacaagcggauguccauggucgugagcggccucacccccgaggaguucaugcugguguacaaguucgcccgcaagcaccacaucacgcugaccaaccucaucaccgaggagaccacgcacgucgugaugaagaccgacgcggaguucgucugcgagcggacccugaaguacuuccuggggaucgccggcggcaagugggugguguccuacuucugggucacccagagcaucaaggagcgcaagaugcugaacgagcacgacuucgaggugcgcggggacguggucaacggccggaaccaccaggggcccaagcgcgcccgggagucccaggaccgcaagaucuuccggggccucgagaucugcugcuacgggccguucacgaacaugcccaccgaccagcuggaguggauggugcagcugugcggcgccagcguggucaaggagcucuccagcuucacccugggcaccggggugcaccccaucguggucgugcagccggacgccuggacggaggacaacggcuuccacgcgaucgggcagaugugcgaggcccccguggucacccgcgagugggugcuggacuccguggcccucuaccagugccaggagcuggacaccuaccugaucccccagaucccccacagccacuacuga

SEQ ID NO: 702 - RNA, 2043 nt, Artificial Sequence
  derived and/or modified sequence opt2 from BRCA1/m__Homo_sapiens__EAW60939
auggaccucuccgcccuccgcgucgaggagguccagaacgucaucaacgccaugcagaagauccucgagugccccaucugccucgagcucaucaaggagcccgucuccaccaagugcgaccacaucuucugcaaguucugcaugcucaagcuccucaaccagaagaagggccccucccagugcccccucugcaagaacgacaucaccaagcgcucccuccaggaguccacccgcuucucccagcucgucgaggagcuccucaagaucaucugcgccuuccagcucgacaccggccucgaguacgccaacuccuacaacuucgccaagaaggagaacaacucccccgagcaccucaaggacgaggucuccaucauccaguccaugggcuaccgcaaccgcgccaagcgccuccuccaguccgagcccgagaaccccucccuccaggagaccucccucuccguccagcucuccaaccucggcaccguccgcacccuccgcaccaagcagcgcauccagccccagaagaccuccgucuacaucgagcucggcgaggccgccuccggcugcgaguccgagaccuccgucuccgaggacugcuccggccucuccucccaguccgacauccucaccacccagcagcgcgacaccaugcagcacaaccucaucaagcuccagcaggagauggccgagcucgaggccguccucgagcagcacggcucccagcccuccaacuccuaccccuccaucaucuccgacuccuccgcccucgaggaccuccgcaaccccgagcaguccaccuccgagaaggccguccucaccucccagaaguccuccgaguaccccaucucccagaaccccgagggccucuccgccgacaaguucgaggucuccgccgacuccuccaccuccaagaacaaggagcccggcgucgagcgcuccucccccuccaagugccccucccucgacgaccgcugguacaugcacuccugcuccggcucccuccagaaccgcaacuaccccucccaggaggagcucaucaaggucgucgacgucgaggagcagcagcucgaggaguccggcccccacgaccucaccgagaccuccuaccucccccgccaggaccucgagggcacccccuaccucgaguccggcaucucccucuucuccgacgaccccgaguccgaccccuccgaggaccgcgcccccgaguccgcccgcgucggcaacauccccuccuccaccuccgcccucaaggucccccagcucaaggucgccgaguccgcccagucccccgccgccgcccacaccaccgacaccgccggcuacaacgccauggaggaguccgucucccgcgagaagcccgagcucaccgccuccaccgagcgcgucaacaagcgcauguccauggucgucuccggccucacccccgaggaguucaugcucgucuacaaguucgcccgcaagcaccacaucacccucaccaaccucaucaccgaggagaccacccacgucgucaugaagaccgacgccgaguucgucugcgagcgcacccucaaguacuuccucggcaucgccggcggcaagugggucgucuccuacuucugggucacccaguccaucaaggagcgcaagaugcucaacgagcacgacuucgagguccgcggcgacgucgucaacggccgcaaccaccagggccccaagcgcgcccgcgagucccaggaccgcaagaucuuccgcggccucgagaucugcugcuacggccccuucaccaacaugcccaccgaccagcucgaguggaugguccagcucugcggcgccuccgucgucaaggagcucuccuccuucacccucggcaccggcguccaccccaucgucgucguccagcccgacgccuggaccgaggacaacggcuuccacgccaucggccagaugugcgaggcccccgucgucacccgcgaguggguccucgacuccgucgcccucuaccagugccaggagcucgacaccuaccucaucccccagaucccccacucccacuacuga

SEQ ID NO: 703 - RNA, 2043 nt, Artificial Sequence
  derived and/or modified sequence opt3 from BRCA1/m__Homo_sapiens__EAW60939
auggaccugagcgcccucagaguggaggaaguccagaacguuaucaaugcuaugcaaaagauucuugagugccccauaugucuggaauugaucaaagagccuguguccaccaagugcgaucacauuuucuguaaauuuugcauguuaaagcugcuaaaccagaaaaagggcccaucucaguguccgcucugcaagaaugacaucacaaaaaggucacugcaggaaaguacucgguucagccaacuuguagaggagcuguugaagauuaucugugcauuucagcucgauacggggcuggaauacgccaacuccuauaauuucgcgaaaaaggagaacaauucucccgaacaucugaaagacgaggugucgauaauccagucaaugggauaccgcaaccgagcuaagcgucucuuacagagcgagccugaaaauccaagucugcaagagaccucccuuucuguccaguugagcaaccuggguacagugagaacucuaaggaccaagcagcggauucagccccagaaaacauccguuuauaucgaacucggcgaggccgcaucagggugcgaaagugagaccagcgugucugaggauuguuccggacugucaagccaaagugacauucuuacuacacagcaacgcgauaccaugcagcacaaucugaucaaguugcagcaggaaauggccgagcucgaagcuguccuggagcaacauggcucucagccuuccaacagcuacccaucgauaauuucugacuccucagcauuagaagaucugagaaaucccgagcagaguacgagcgagaaagccgugcucacuucccagaagucuagcgaauauccuaucucacaaaacccagagggucuuagugcugacaaauuugaaguauccgccgauagcucuaccucaaagaauaaagagccggggguugaaaggaguagccccuccaagugcccuucucuggacgaucggugguacaugcacucguguagcggauccuugcagaaccgcaacuauccaucacaggaggagcuaauuaagguggucgacguggaggaacagcaacuggaagagaguggcccccaugaccucacagagacuucuuaccugccucgacaggaucuugaaggcaccccauaccuggagagcgggaucuccuuguucucagacgaucccgaaagcgacccgucugaggauagagcgccugaauccgcaagggugggaaauauccccaguagcacaucugcccucaaagucccacagcugaagguugcugaguccgcccagaguccugcagcugcccacaccacggacacugcggguuauaacgccauggaggaaucagugagccgggagaaacccgaauuaacagcaucgaccgagcguguaaauaagcgcauguccaugguggucucuggccugacuccagaagaguuuaugcuaguguacaaauucgcuagaaagcaccauauuacacucaccaaccugauaacggaggaaaccacacacguugugaugaagacugaugccgaguuugucugcgaaaggacccuuaaauauuucuuggggaucgcuggaggcaagugggugguaagcuacuuuuggguuacacaaucaauuaaagagcggaagaugcugaaugaacaugacuucgaggugcgaggugaugucgugaacgggcgcaaucaccagggacccaaaagagccagggagagucaggaccggaagaucuuucgcggccucgaaauaugcuguuauggcccuuucacuaacaugccaaccgaucaacuggaguggaugguccagcuuugcggggcauccgugguuaaggaacugucuagcuucacauugggaaccggugugcacccgauuguagucgugcagcccgacgccuggacugaggacaauggcuuucaugcuaucgggcagaugugugaggcgccuguugugacgagagaauggguccucgauuccguggcacuguaccaaugccaggaguuagacacauaucugaucccacagauuccccacucacauuacuga

SEQ ID NO: 704 - RNA, 2043 nt, Artificial Sequence
  derived and/or modified sequence opt4 from BRCA1/m__Homo_sapiens__EAW60939
auggaccugagcgcccugagaguggaggaggugcagaacgugaucaacgccaugcagaagauccuggagugccccaucugccuggagcugaucaaggagcccgugagcaccaagugcgaccacaucuucugcaaguucugcaugcugaagcugcugaaccagaagaagggccccagccagugcccccugugcaagaacgacaucaccaagagaagccugcaggagagcaccagauucagccagcugguggaggagcugcugaagaucaucugcgccuuccagcuggacaccggccuggaguacgccaacagcuacaacuucgccaagaaggagaacaacagccccgagcaccugaaggacgaggugagcaucauccagagcaugggcuacagaaacagagccaagagacugcugcagagcgagcccgagaaccccagccugcaggagaccagccugagcgugcagcugagcaaccugggcaccgugagaacccugagaaccaagcagagaauccagccccagaagaccagcguguacaucgagcugggcgaggccgccagcggcugcgagagcgagaccagcgugagcgaggacugcagcggccugagcagccagagcgacauccugaccacccagcagagagacaccaugcagcacaaccugaucaagcugcagcaggagauggccgagcuggaggccgugcuggagcagcacggcagccagcccagcaacagcuaccccagcaucaucagcgacagcagcgcccuggaggaccugagaaaccccgagcagagcaccagcgagaaggccgugcugaccagccagaagagcagcgaguaccccaucagccagaaccccgagggccugagcgccgacaaguucgaggugagcgccgacagcagcaccagcaagaacaaggagcccggcguggagagaagcagccccagcaagugccccagccuggacgacagaugguacaugcacagcugcagcggcagccugcagaacagaaacuaccccagccaggaggagcugaucaaggugguggacguggaggagcagcagcuggaggagagcggcccccacgaccugaccgagaccagcuaccugcccagacaggaccuggagggcacccccuaccuggagagcggcaucagccuguucagcgacgaccccgagagcgaccccagcgaggacagagcccccgagagcgccagagugggcaacauccccagcagcaccagcgcccugaaggugccccagcugaagguggccgagagcgcccagagccccgccgccgcccacaccaccgacaccgccggcuacaacgccauggaggagagcgugagcagagagaagcccgagcugaccgccagcaccgagagagugaacaagagaaugagcaugguggugagcggccugacccccgaggaguucaugcugguguacaaguucgccagaaagcaccacaucacccugaccaaccugaucaccgaggagaccacccacguggugaugaagaccgacgccgaguucgugugcgagagaacccugaaguacuuccugggcaucgccggcggcaaguggguggugagcuacuucugggugacccagagcaucaaggagagaaagaugcugaacgagcacgacuucgaggugagaggcgacguggugaacggcagaaaccaccagggccccaagagagccagagagagccaggacagaaagaucuucagaggccuggagaucugcugcuacggccccuucaccaacaugcccaccgaccagcuggaguggauggugcagcugugcggcgccagcguggugaaggagcugagcagcuucacccugggcaccggcgugcaccccaucgugguggugcagcccgacgccuggaccgaggacaacggcuuccacgccaucggccagaugugcgaggcccccguggugaccagagagugggugcuggacagcguggcccuguaccagugccaggagcuggacaccuaccugaucccccagaucccccacagccacuacuga

SEQ ID NO: 705 - RNA, 2043 nt, Artificial Sequence
  derived and/or modified sequence opt5 from BRCA1/m__Homo_sapiens__EAW60939
auggaccugagcgcccucagaguggaggaaguccagaacguuaucaaugcuaugcaaaagauucuggagugccccaucugucuugaacugauuaaagagccuguguccaccaagugcgaucacaucuucuguaaauuuugcaugcucaagcugcuuaaccagaaaaagggcccgucucaguguccccugugcaagaaugacauuacaaaacggagccuccaggaauccacgcgcuucucucaacugguggaggagcugcucaagaucaucugugccuuucagcuggauaccgggcuugaauacgcgaacagcuauaauuucgcuaaaaaggagaacaauuccccugaacaucugaaagacgaggucucuauuauccagagcaugggauacagaaaccgggccaagcgccuccugcaguccgagcccgaaaauccuagccuucaagagacaucucuguccgugcagcucagcaaccugggcaccguuagaacacugcggaccaagcagcgcauucagccccagaaaacaucuguguauaucgaacucggggaggccgcuuccggaugcgaaagcgagaccucugucuccgaggauuguagcggccuguccucucaaagcgacauucuuacgacccagcaaagagauacaaugcagcacaaucugaucaagcuccagcaggaaauggccgagcuggaagcugugcuugagcaacaugggucccagccuagcaacucuuacccguccauuaucagcgacucuagcgcccuggaagaucuccggaaucccgagcaguccaccucugagaaagcgguucugacaagccagaaguccagcgaauauccuaucucucaaaaccccgagggacuguccgccgacaaauuugaagugagcgcugauucuuccaccagcaagaauaaagagccuggcgucgaacgcuccucucccagcaagugcccgucccucgacgauagaugguacaugcacucuuguagcggcucccugcagaaccggaacuauccuagccaggaggagcuuauuaaggugguggacgucgaggaacagcaacuggaagagucugggccccaugaccucacggagacauccuaccugccucgccaggaucuugaaggaacccccuaccuggagagcggcaucucucucuucuccgacgaucccgaaagcgacccuucugaggauagagccccggaaagcgcucggguugggaauauucccuccagcacaucugcccugaaagugccucagcugaagguggcggaguccgcccagagccccgcugccgcucacaccaccgacacagccggauauaacgccauggaggaauccgucucucgcgagaaaccugaacucacggcuagcaccgagagagugaauaagcggauguccaugguugugucuggccugacacccgaagaguuuaugcuugucuacaaauucgcgagaaagcaccauaucacccugacaaaccucauuaccgaggaaacgacacacgugguuaugaagaccgaugccgaguuugugugcgaacgcacccugaaauauuuccuggggaucgcuggaggcaagugggucgugagcuacuuuugggucacacaauccaucaaagagcggaagaugcuuaaugaacaugacuucgaggugagaggcgauguugugaacgggcgcaaucaccagggaccgaaacgggccagagagucucaggaccgcaagauuuuucggggccucgaaaucugcuguuaugggccuuucaccaacaugcccacagaucaacuggaguggaugguccagcugugcggagccagcgugguuaaggaacucuccagcuucacgcugggcaccggggugcacccuauugucguggugcagcccgacgcuuggacagaggacaauggauuucaugccaucggccagaugugugaggcgccuguugucaccagagaaugggugcuugauucuguggcucuguaccaaugccaggagcucgacacauaucugauuccccagaucccgcacucccauuacuga

SEQ ID NO: 706 - protein, 181 aa, Artificial Sequence
  BY55__Homo_sapiens__O95971
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 707 - RNA, 546 nt, Artificial Sequence
  BY55__Homo_sapiens__AAC72302
augcuguuggaacccggcagaggcugcugugcccuggccauccugcuggcaauuguggacauccagucugguggaugcauuaacaucaccagcucagcuucccaggaaggaacgcgacuaaacuuaaucuguacuguauggcauaagaaagaagaggcugagggguuuguaguguuuuugugcaaggacaggucuggagacuguucuccugagaccaguuuaaaacagcugagacuuaaaagggauccugggauagaugguguuggugaaauaucaucucaguugauguucaccauaagccaagucacaccguugcacagugggaccuaccaguguugugccagaagccagaagucagguauccgccuucagggccauuuuuucuccauucuauucacagagacagggaacuacacagugacgggauugaaacaaagacaacaccuugaguucagccauaaugaaggcacucucaguucaggcuuccuacaagaaaaggucuggguaaugcuggucaccagccuuguggcccuucaagcuuuguaa

SEQ ID NO: 708 - RNA, 546 nt, Artificial Sequence
  derived and/or modified sequence opt1 from BY55__Homo_sapiens__AAC72302
augcugcucgagcccggccgcgggugcugcgcccuggccauccugcucgcgaucguggacauccagagcggcgggugcaucaacaucaccuccagcgccucccaggagggcacccggcugaaccugaucugcacggucuggcacaagaaggaggaggccgagggguucgugguguuccucugcaaggaccgcagcggcgacugcuccccggagaccagccugaagcagcugcggcucaagcgcgaccccggcaucgacggggucggcgagaucuccagccagcugauguucaccaucucccaggugacgccccugcacagcgggaccuaccagugcugcgcccggucccagaaguccggcauccgccuccaggggcacuucuucagcauccuguucaccgagaccggcaacuacaccgugacgggccugaagcagcggcagcaccucgaguucagccacaacgaggggacccuguccagcggcuuccugcaggagaaggucugggugaugcucgugaccucccuggucgcccugcaggcgcucuga

SEQ ID NO: 709 - RNA, 546 nt, Artificial Sequence
  derived and/or modified sequence opt2 from BY55__Homo_sapiens__AAC72302
augcuccucgagcccggccgcggcugcugcgcccucgccauccuccucgccaucgucgacauccaguccggcggcugcaucaacaucaccuccuccgccucccaggagggcacccgccucaaccucaucugcaccgucuggcacaagaaggaggaggccgagggcuucgucgucuuccucugcaaggaccgcuccggcgacugcucccccgagaccucccucaagcagcuccgccucaagcgcgaccccggcaucgacggcgucggcgagaucuccucccagcucauguucaccaucucccaggucaccccccuccacuccggcaccuaccagugcugcgcccgcucccagaaguccggcauccgccuccagggccacuucuucuccauccucuucaccgagaccggcaacuacaccgucaccggccucaagcagcgccagcaccucgaguucucccacaacgagggcacccucuccuccggcuuccuccaggagaaggucugggucaugcucgucaccucccucgucgcccuccaggcccucuga

SEQ ID NO: 710 - RNA, 546 nt, Artificial Sequence
  derived and/or modified sequence opt3 from BY55__Homo_sapiens__AAC72302
augcugcucgagcccggcagagggugcugugcccuugcuauccuguuggcaauuguggacauacagagcggagguugcaucaacauuaccuccucugccucacaagaaggcacaagguuaaaucugaucuguacugucuggcacaagaaagaggaagcggagggguucguuguguuucuaugcaaggaucggaguggagacuguagcccugaaacgucccucaaacagcugcgccuuaagcgagauccaggcauugacgguguaggggagaucucuucgcagcugauguucaccauaucacaggugacaccguugcauagcggaacuuaccaaugcugugcucguagucagaaauccggcaucagacuccagggccacuuuuucucuauucuguuuaccgagacagggaacuauaccgucacuggacugaagcagaggcaacaucucgaguucagccacaaugaagguacauuauccucaggcuuucugcaggaaaagguguggguuaugcuugugaccaguuuggucgcccugcaggcacuauga

SEQ ID NO: 711 - RNA, 546 nt, Artificial Sequence
  derived and/or modified sequence opt4 from BY55__Homo_sapiens__AAC72302
augcugcuggagcccggcagaggcugcugcgcccuggccauccugcuggccaucguggacauccagagcggcggcugcaucaacaucaccagcagcgccagccaggagggcaccagacugaaccugaucugcaccguguggcacaagaaggaggaggccgagggcuucgugguguuccugugcaaggacagaagcggcgacugcagccccgagaccagccugaagcagcugagacugaagagagaccccggcaucgacggcgugggcgagaucagcagccagcugauguucaccaucagccaggugaccccccugcacagcggcaccuaccagugcugcgccagaagccagaagagcggcaucagacugcagggccacuucuucagcauccuguucaccgagaccggcaacuacaccgugaccggccugaagcagagacagcaccuggaguucagccacaacgagggcacccugagcagcggcuuccugcaggagaaggugugggugaugcuggugaccagccugguggcccugcaggcccuguga

SEQ ID NO: 712 - RNA, 546 nt, Artificial Sequence
  derived and/or modified sequence opt5 from BY55__Homo_sapiens__AAC72302
augcugcucgagcccggcagagggugcugugcccuggcuauccuucuggccauuguggacauccagagcggaggcugcauuaacaucaccuccucugcgagccaagaagggacacggcucaaucugauuuguacggucuggcacaagaaagaggaagcugagggauucguuguguuucuuugcaaggaucgcuccggcgacuguucuccugaaaccagccugaaacagcucagacugaagcgggauccggggaucgacggagugggcgagaucuccucucagcugauguucacaauuagccaggucacaccccuccauuccggcaccuaccaaugcugugcccgcagccagaaaucugggaucagacugcagggacacuuuuucuccauucuuuuuaccgagacaggcaacuauaccgugacggggcugaagcagcggcaacaucucgaguucagccacaaugaaggaacccugucuuccggcuuucuucaggaaaagguuugggugaugcuggucacaagccucguggcccugcaggcucuguga

SEQ ID NO: 713 - protein, 109 aa, Artificial Sequence [sequence omitted]

SEQ ID NO: 714 - RNA, 330 nt, Artificial Sequence
  CAMEL__Homo_sapiens__CAA10193
augcugauggcccaggaggcccuggcauuccugauggcccagggggcaaugcuggcggcccaggagaggcgggugccacgggcggcagagguccccggggcgcaggggcagcaagggccucggggccgagaggaggcgccccgcgggguccgcauggcggugccgcuucugcgcaggauggaaggugccccugcggggccaggaggccggacagccgccugcuucaguugcacaucacgaugccuuucucgucgcccauggaagcggagcugguccgcaggauccugucccgggaugccgcaccucucccccgaccaggggcgguucuga

SEQ ID NO: 715 - RNA, 330 nt, Artificial Sequence
  derived and/or modified sequence opt1 from CAMEL__Homo_sapiens__CAA10193
augcugauggcccaggaggcccucgcguuccugauggcccagggcgccaugcuggccgcccaggagcgccgggugccccgcgcggccgaggucccgggggcccagggccagcaggggccccggggccgcgaggaggcgccccgcggggugcggauggccgugccccuccugcggcgcauggagggcgccccggccggccccgggggccggaccgccgccugcuucagcugcaccucccgcugccugagccggcgccccuggaagcgguccuggagcgcgggguccugccccggcaugccgcaccucagccccgaccaggggcgcuucuga

SEQ ID NO: 716 - RNA, 330 nt, Artificial Sequence
  derived and/or modified sequence opt2 from CAMEL__Homo_sapiens__CAA10193
augcucauggcccaggaggcccucgccuuccucauggcccagggcgccaugcucgccgcccaggagcgccgcgucccccgcgccgccgagguccccggcgcccagggccagcagggcccccgcggccgcgaggaggccccccgcggcguccgcauggccgucccccuccuccgccgcauggagggcgcccccgccggccccggcggccgcaccgccgccugcuucuccugcaccucccgcugccucucccgccgccccuggaagcgcuccugguccgccggcuccugccccggcaugccccaccucucccccgaccagggccgcuucuga

SEQ ID NO: 717 - RNA, 330 nt, Artificial Sequence
  derived and/or modified sequence opt3 from CAMEL__Homo_sapiens__CAA10193
augcugauggcccaggaggcucucgcauuccuuauggcccaaggcgcgaugcuggcugcccaggaaagaagggugccccgggcagccgaggucccuggggcucagggacagcaagguccacgcggccgagaagaggcaccgcgugggguuagaauggccgugcccuuguuaaggcggauggaaggagcuccugccggcccaggugggcgcaccgcggcaugcuuuagcuguacauccagaugccugucuaggcggcccuggaagcgcucauggagugccggaagcuguccuggcaugccacaccuaucccccgaccagggccgauucuga

SEQ ID NO: 718 - RNA, 330 nt, Artificial Sequence
  derived and/or modified sequence opt4 from CAMEL__Homo_sapiens__CAA10193
augcugauggcccaggaggcccuggccuuccugauggcccagggcgccaugcuggccgcccaggagagaagagugcccagagccgccgaggugcccggcgcccagggccagcagggccccagaggcagagaggaggcccccagaggcgugagaauggccgugccccugcugagaagaauggagggcgcccccgccggccccggcggcagaaccgccgccugcuucagcugcaccagcagaugccugagcagaagacccuggaagagaagcuggagcgccggcagcugccccggcaugccccaccugagccccgaccagggcagauucuga

SEQ ID NO: 719 - RNA, 330 nt, Artificial Sequence
  derived and/or modified sequence opt5 from CAMEL__Homo_sapiens__CAA10193
augcugauggcccaggaggcucucgccuuccugauggcgcaaggcgcuaugcuugccgcccaggaaagacgggugccccgcgcugccgaggucccuggggcucagggacagcaaggcccgagagggcgggaagaggcgccccgcggaguuagaauggccgugccucugcuccggcgcauggaaggcgcccccgcugggccuggaggcagaaccgccgcuugcuuuagcuguacaucccggugccugucucgcagacccuggaagcggagcugguccgccggcucuuguccugggaugccgcaccuuagccccgaccagggacgcuucuga

SEQ ID NO: 720 - protein, 522 aa, Artificial Sequence
  CASPA__Homo_sapiens__Q92851-4
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 721 - RNA, 1569 nt, Artificial Sequence
  CASPA__Homo_sapiens__CCDS2340.1
augaaaucucaaggucaacauugguauuccaguucagauaaaaacuguaaagugagcuuucgugagaagcuucugauuauugauucaaaccuggggguccaagauguggagaaccucaaguuucucugcauaggauugguccccaacaagaagcuggagaaguccagcucagccucagauguuuuugaacaucucuuggcagaggaucugcugagugaggaagacccuuucuuccuggcagaacuccucuauaucauacggcagaagaagcugcugcagcaccucaacuguaccaaagaggaaguggagcgacugcugcccacccgacaaaggguuucucuguuuagaaaccugcucuacgaacugucagaaggcauugacucagagaacuuaaaggacaugaucuuccuucugaaagacucgcuucccaaaacugaaaugaccucccuaaguuuccuggcauuucuagagaaacaagguaaaauagaugaagauaaucugacaugccuggaggaccucugcaaaacaguuguaccuaaacuuuugagaaacauagagaaauacaaaagagagaaagcuauccagauagugacaccuccuguagacaaggaagccgagucguaucaaggagaggaagaacuaguuucccaaacagauguuaagacauucuuggaagccuuaccgcaggaguccuggcaaaauaagcaugcagguaguaaugguaacagagccacaaauggugcaccaagccuggucuccagggggaugcaaggagcaucugcuaacacucuaaacucugaaaccagcacaaagagggcagcuguguacaggaugaaucggaaccacagaggccucugugucauugucaacaaccacagcuuuaccucccugaaggacagacaaggaacccauaaagaugcugagauccugagucauguguuccaguggcuuggguucacagugcauauacacaauaaugugacgaaaguggaaauggagaugguccugcagaagcagaagugcaauccagcccaugccgacggggacugcuucguguucuguauucugacccaugggagauuuggagcugucuacucuucggaugaggcccucauucccauucgggagaucaugucucacuucacagcccugcagugcccuagacuggcugaaaaaccuaaacucuuuuucauccaggccugccaaggugaagagauacagccuuccguauccaucgaagcagaugcucugaacccugagcaggcacccacuucccugcaggacaguauuccugccgaggcugacuuccuacuuggucuggccacugucccaggcuauguauccuuucggcauguggaggaaggcagcugguauauucagucucuguguaaucaucugaagaaauuggucccaagacaugaagacaucuuauccauccucacugcugucaacgaugaugugagucgaagaguggacaaacagggaacaaagaaacagaugccccagccugcuuucacacuaaggaaaaaacuaguauucccugugccccuggaugcacuuucauuauag

SEQ ID NO: 722 - RNA, 1569 nt, Artificial Sequence
  derived and/or modified sequence opt1 from CASPA__Homo_sapiens__CCDS2340.1
augaagucccagggccagcacugguacagcagcuccgacaagaacugcaaggugagcuuccgcgagaagcugcucaucaucgacuccaaccuggggguccaggacguggagaaccugaaguuccucugcaucggccuggugcccaacaagaagcuggagaaguccagcagcgccuccgacgucuucgagcaccuccuggccgaggaccugcucagcgaggaggacccguucuuccuggcggagcugcucuacaucauccggcagaagaagcugcugcagcaccucaacugcaccaaggaggagguggagcgccugcugcccacccggcagcgcgugucccucuuccggaaccugcuguacgagcucagcgaggggaucgacuccgagaaccugaaggacaugaucuuccugcucaaggacagccugcccaagacggagaugaccucccugagcuuccucgccuuccuggagaagcagggcaagaucgacgaggacaaccugaccugccucgaggaccugugcaagaccgucgugcccaagcugcuccgcaacaucgagaaguacaagcgggagaaggccauccagaucgugacgccgcccgucgacaaggaggccgaguccuaccagggggaggaggagcuggugagccagaccgacgugaagaccuuccuggaggcccucccccaggaguccuggcagaacaagcacgcgggcagcaacggcaaccgcgccaccaacggggcccccagccuggucucccggggcaugcagggggccagcgcgaacacgcugaacuccgagaccagcaccaagcgcgccgccguguaccggaugaaccgcaaccaccggggccucugcgugaucgucaacaaccacuccuucaccagccugaaggaccgccaggggacgcacaaggacgccgagauccugucccacguguuccaguggcucggcuucaccgugcacauccacaacaacgucaccaagguggagauggagauggugcugcagaagcagaagugcaacccggcccacgcggacggcgacugcuucgucuucugcauccugacccacgggcgguucggcgccguguacagcuccgacgaggcccucauccccauccgcgagaucaugagccacuucacggcccugcagugcccccggcuggccgagaagcccaagcuguucuucauccaggcgugccagggggaggagauccagccguccgugagcaucgaggccgacgcccucaaccccgagcaggcccccaccucccugcaggacagcauccccgccgaggcggacuuccugcucggccuggccaccgucccgggcuacguguccuuccgccacgucgaggaggggagcugguacauccagucccugugcaaccaccucaagaagcuggugccccggcacgaggacauccugagcauccucaccgccgugaacgacgacgucucccgccggguggacaagcagggcacgaagaagcagaugccccagcccgccuucacccugcgcaagaagcugguguucccggucccccucgacgcccugagccuguga

SEQ ID NO: 723 - RNA, 1569 nt, Artificial Sequence
  derived and/or modified sequence opt2 from CASPA__Homo_sapiens__CCDS2340.1
augaagucccagggccagcacugguacuccuccuccgacaagaacugcaaggucuccuuccgcgagaagcuccucaucaucgacuccaaccucggcguccaggacgucgagaaccucaaguuccucugcaucggccucguccccaacaagaagcucgagaaguccuccuccgccuccgacgucuucgagcaccuccucgccgaggaccuccucuccgaggaggaccccuucuuccucgccgagcuccucuacaucauccgccagaagaagcuccuccagcaccucaacugcaccaaggaggaggucgagcgccuccuccccacccgccagcgcgucucccucuuccgcaaccuccucuacgagcucuccgagggcaucgacuccgagaaccucaaggacaugaucuuccuccucaaggacucccuccccaagaccgagaugaccucccucuccuuccucgccuuccucgagaagcagggcaagaucgacgaggacaaccucaccugccucgaggaccucugcaagaccgucguccccaagcuccuccgcaacaucgagaaguacaagcgcgagaaggccauccagaucgucaccccccccgucgacaaggaggccgaguccuaccagggcgaggaggagcucgucucccagaccgacgucaagaccuuccucgaggcccucccccaggaguccuggcagaacaagcacgccggcuccaacggcaaccgcgccaccaacggcgcccccucccucgucucccgcggcaugcagggcgccuccgccaacacccucaacuccgagaccuccaccaagcgcgccgccgucuaccgcaugaaccgcaaccaccgcggccucugcgucaucgucaacaaccacuccuucaccucccucaaggaccgccagggcacccacaaggacgccgagauccucucccacgucuuccaguggcucggcuucaccguccacauccacaacaacgucaccaaggucgagauggagaugguccuccagaagcagaagugcaaccccgcccacgccgacggcgacugcuucgucuucugcauccucacccacggccgcuucggcgccgucuacuccuccgacgaggcccucauccccauccgcgagaucaugucccacuucaccgcccuccagugcccccgccucgccgagaagcccaagcucuucuucauccaggccugccagggcgaggagauccagcccuccgucuccaucgaggccgacgcccucaaccccgagcaggcccccaccucccuccaggacuccauccccgccgaggccgacuuccuccucggccucgccaccguccccggcuacgucuccuuccgccacgucgaggagggcuccugguacauccagucccucugcaaccaccucaagaagcucgucccccgccacgaggacauccucuccauccucaccgccgucaacgacgacgucucccgccgcgucgacaagcagggcaccaagaagcagaugccccagcccgccuucacccuccgcaagaagcucgucuuccccgucccccucgacgcccucucccucuga

SEQ ID NO: 724 - RNA, 1569 nt, Artificial Sequence
  derived and/or modified sequence opt3 from CASPA__Homo_sapiens__CCDS2340.1
augaaaagccagggccaacacugguacuccucuucagacaagaacugcaaggugaguuucagagagaaacugcucaucauugauagcaaucuugggguccaggacguugaaaaccugaaguuuuuguguauaggauuagugcccaauaaaaagcuggagaaguccucuucggccucagauguauucgaacaucuacucgcugaggaccugcuuagcgaagaggauccauuuuuccuggcagaguugcucuauaucauuaggcagaaaaagcugcugcagcaccucaacugcaccaaagaagagguggaacgguuacugccuacacgccaacgagucagucuuuuucguaauuugcuguacgagcuauccgaggguaucgacucugaaaaccucaaggauaugauuuuccugcuuaaagacagccugccgaagacugagaugacguccuugucauuucucgccuuccuggaaaagcagggcaaaaucgaugaggacaauuuaaccugucuggaagaucucugcaagacagugguucccaaacuucugagaaacauagagaaguauaaaagggagaaggcgauccagauugugacuccuccagucgacaaagaagcugagaguuaccagggggaagaggaauuggugagccaaaccgauguaaagacauuucuagaggcccugccccaggagucuuggcagaauaagcaugcaggauccaacggcaaucgggccaccaacggugcuccuucacucguuagccgcgggaugcagggagcaagugccaauacucugaacucugaaacauccaccaaaagagcugccguguauaggaugaaucggaaccaccgcggccuuugugucaucgugaacaaucauagcuucacgucgcugaaggaccgacaaggcacucacaaagacgcggagauuuugucucacguguuucaguggcucggguucaccguccauauccacaacaauguuacaaagguggaaauggagaugguacugcagaaacaaaagugcaacccagcacaugccgauggagacuguuuuguguucugcauauuaacucacgguagauucggcgcugucuacuccucagaugaagcccugauucccaucagggagauuaugagucacuuuaccgcacuacaguguccucggcucgcugagaagccaaaacuguucuuuauccaggccugccagggggaagagauccaaccgagcguguccauugaagcggacgcccuuaaucccgagcaggcaccuacaucuuugcaggauagcauaccagcugaggccgacuuccugcucggacuggcuaccguucccggcuaugugucauuucgucaugucgaagaggguaguugguacauccagucccuuuguaaccaccugaagaaauuggugccucgccaugaagauauucucagcauccugacggccguaaaugacgauguuucuagaaggguggacaagcaagggacuaaaaagcagaugccacagcccgcauucacauuacggaagaaacuggucuuuccggugccucuagaugcccucucacuguga

SEQ ID NO: 725 - RNA, 1569 nt, Artificial Sequence
  derived and/or modified sequence opt4 from CASPA__Homo_sapiens__CCDS2340.1
augaagagccagggccagcacugguacagcagcagcgacaagaacugcaaggugagcuucagagagaagcugcugaucaucgacagcaaccugggcgugcaggacguggagaaccugaaguuccugugcaucggccuggugcccaacaagaagcuggagaagagcagcagcgccagcgacguguucgagcaccugcuggccgaggaccugcugagcgaggaggaccccuucuuccuggccgagcugcuguacaucaucagacagaagaagcugcugcagcaccugaacugcaccaaggaggagguggagagacugcugcccaccagacagagagugagccuguucagaaaccugcuguacgagcugagcgagggcaucgacagcgagaaccugaaggacaugaucuuccugcugaaggacagccugcccaagaccgagaugaccagccugagcuuccuggccuuccuggagaagcagggcaagaucgacgaggacaaccugaccugccuggaggaccugugcaagaccguggugcccaagcugcugagaaacaucgagaaguacaagagagagaaggccauccagaucgugaccccccccguggacaaggaggccgagagcuaccagggcgaggaggagcuggugagccagaccgacgugaagaccuuccuggaggcccugccccaggagagcuggcagaacaagcacgccggcagcaacggcaacagagccaccaacggcgcccccagccuggugagcagaggcaugcagggcgccagcgccaacacccugaacagcgagaccagcaccaagagagccgccguguacagaaugaacagaaaccacagaggccugugcgugaucgugaacaaccacagcuucaccagccugaaggacagacagggcacccacaaggacgccgagauccugagccacguguuccaguggcugggcuucaccgugcacauccacaacaacgugaccaagguggagauggagauggugcugcagaagcagaagugcaaccccgcccacgccgacggcgacugcuucguguucugcauccugacccacggcagauucggcgccguguacagcagcgacgaggcccugauccccaucagagagaucaugagccacuucaccgcccugcagugccccagacuggccgagaagcccaagcuguucuucauccaggccugccagggcgaggagauccagcccagcgugagcaucgaggccgacgcccugaaccccgagcaggcccccaccagccugcaggacagcauccccgccgaggccgacuuccugcugggccuggccaccgugcccggcuacgugagcuucagacacguggaggagggcagcugguacauccagagccugugcaaccaccugaagaagcuggugcccagacacgaggacauccugagcauccugaccgccgugaacgacgacgugagcagaagaguggacaagcagggcaccaagaagcagaugccccagcccgccuucacccugagaaagaagcugguguuccccgugccccuggacgcccugagccuguga

SEQ ID NO: 726 - RNA, 1569 nt, Artificial Sequence
  derived and/or modified sequence opt5 from CASPA__Homo_sapiens__CCDS2340.1
augaaaagccagggccaacacugguacuccucuagcgacaaaaacugcaagguguccuucagagagaaacugcucaucauugauucuaaucuggggguccaggacguugaaaaccuuaaguuucuguguaucggacucgugcccaauaaaaagcuggaaaagagcuccucugccagcgauguguucgagcaucuucuggcugaggaccuccuguccgaagaggauccguuuuuccuggccgagcuccuguauauuauccggcagaaaaagcugcuucagcaccucaacugcaccaaagaagaggucgaacgccugcuuccuacaagacaacgggugagccuguuucgcaaucuccuguacgagcugucugagggcauugacuccgaaaaccucaaggauaugaucuuccugcuuaaagacagccugcccaagacggagaugaccucucucuccuuucuggcguuccuugaaaagcaggggaaaaucgaugaggacaaucugacaugucucgaagaucugugcaagaccguugugccuaaacugcucagaaacauugagaaguauaaacgggagaaggcuauccagauugucacacccccuguggacaaagaagccgagagcuaccagggagaagaggaacugguuucucaaaccgaugugaagacauuucuugaggcccugccccaggaguccuggcagaauaagcaugcuggcagcaacgggaaucgcgccaccaacggagcuccuucccucgucucuagaggcaugcagggcgccagcgcgaauacgcugaacuccgaaaccagcacaaaacgggccgcuguguaucgcaugaauagaaaccaccgggggcuuugugugaucgucaacaaucauucuuucaccucccugaaggaccgccaaggaacacacaaagacgccgagauucucagccacguuuuucaguggcugggcuucaccgugcauauccacaacaaugugacgaaggucgaaauggagauggugcugcagaaacaaaagugcaacccggcucaugccgauggggacuguuuuguuuucugcauucucacacacggaagauucggcgcgguguacucuagcgaugaagcccugauccccauccgggagauuaugucccacuuuaccgcccuucaguguccucgccuggcugagaagcccaaacucuucuuuauccaggcuugccagggggaagagauucaaccuucugucagcaucgaagccgacgcccugaaucccgagcaggcuccgacaucccugcaggauagcauuccugcggaggccgacuuccuucucggacuggcuaccgugcccggcuauguuucuuuuagacauguggaagagggcuccugguacauccagagccuguguaaccaccucaagaaacuggucccucggcaugaagauauccuuucuauucugaccgccgugaaugacgaugucuccagacgcguggacaagcaagggacaaagaagcagaugccccagcccgccuucacgcuccggaagaaacugguuuuuccugugccgcuggaugcucuuagccucuga

SEQ ID NO: 727 - protein, 339 aa, Artificial Sequence
  cathepsin_B__Homo_sapiens__A0A024R374
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 728 - RNA, 1020 nt, Artificial Sequence
  cathepsin_B__Homo_sapiens__EAW65632
auguggcagcucugggccucccucugcugccugcugguguuggccaaugcccggagcaggcccucuuuccauccccugucggaugagcuggucaacuaugucaacaaacggaauaccacguggcaggccgggcacaacuucuacaacguggacaugagcuacuugaagaggcuaugugguaccuuccugggugggcccaagccaccccagagaguuauguuuaccgaggaccugaagcugccugcaagcuucgaugcacgggaacaauggccacagugucccaccaucaaagagaucagagaccagggcuccuguggcuccugcugggccuucggggcuguggaagccaucucugaccggaucugcauccacaccaaugcgcacgucagcguggaggugucggcggaggaccugcucaccugcuguggcagcauguguggggacggcuguaaugguggcuauccugcugaagcuuggaacuucuggacaagaaaaggccugguuucugguggccucuaugaaucccauguagggugcagaccguacuccaucccucccugugagcaccacgucaacggcucccggcccccaugcacgggggagggagauacccccaaguguagcaagaucugugagccuggcuacagcccgaccuacaaacaggacaagcacuacggauacaauuccuacagcgucuccaauagcgagaaggacaucauggccgagaucuacaaaaacggccccguggagggagcuuucucuguguauucggacuuccugcucuacaagucaggaguguaccaacacgucaccggagagaugauggguggccaugccauccgcauccugggcuggggaguggagaauggcacacccuacuggcugguugccaacuccuggaacacugacuggggugacaauggcuucuuuaaaauacucagaggacaggaucacuguggaaucgaaucagaagugguggcuggaauuccacgcaccgaucaguacugggaaaagaucuaa

SEQ ID NO: 729 - RNA, 1020 nt, Artificial Sequence
  derived and/or modified sequence opt1 from cathepsin_B__Homo_sapiens__EAW65632
auguggcagcugugggccagccucugcugccugcuggugcucgccaacgcgcgcucccggcccagcuuccacccgcuguccgacgagcuggucaacuacgugaacaagcgcaacaccaccuggcaggccggccacaacuucuacaacguggacaugagcuaccucaagcggcugugcgggacguuccugggcgggcccaagccgccccagcgcgucauguucaccgaggaccucaagcugcccgccuccuucgacgcccgggagcaguggccccagugccccaccaucaaggagauccgcgaccagggcagcugcggguccugcugggccuucggcgcgguggaggccaucagcgaccggaucugcauccacaccaacgcccacguguccgucgaggugagcgccgaggaccugcucacgugcugcggcuccaugugcggggacggcugcaacgggggcuaccccgcggaggccuggaacuucuggacccgcaaggggcuggugagcggcggccuguacgagucccacgucgggugccggccguacagcaucccgcccugcgagcaccacgugaacggcucccgcccgcccugcaccggggagggcgacacccccaagugcagcaagaucugcgagcccggcuacucccccacguacaagcaggacaagcacuacggguacaacagcuacuccgugagcaacagcgagaaggacaucauggccgagaucuacaagaacggccccgucgagggggccuucuccguguacagcgacuuccuccuguacaaguccggcguguaccagcacgucaccggggagaugaugggcggccacgccauccggauccugggguggggcguggagaacgggacccccuacuggcucguggcgaacagcuggaacaccgacuggggcgacaacggguucuucaagauccugcgcggccaggaccacugcggcaucgaguccgaggucguggccgggaucccccggacggaccaguacugggagaagaucuga

SEQ ID NO: 730 - RNA, 1020 nt, Artificial Sequence
  derived and/or modified sequence opt2 from cathepsin_B__Homo_sapiens__EAW65632
auguggcagcucugggccucccucugcugccuccucguccucgccaacgcccgcucccgccccuccuuccacccccucuccgacgagcucgucaacuacgucaacaagcgcaacaccaccuggcaggccggccacaacuucuacaacgucgacauguccuaccucaagcgccucugcggcaccuuccucggcggccccaagcccccccagcgcgucauguucaccgaggaccucaagcuccccgccuccuucgacgcccgcgagcaguggccccagugccccaccaucaaggagauccgcgaccagggcuccugcggcuccugcugggccuucggcgccgucgaggccaucuccgaccgcaucugcauccacaccaacgcccacgucuccgucgaggucuccgccgaggaccuccucaccugcugcggcuccaugugcggcgacggcugcaacggcggcuaccccgccgaggccuggaacuucuggacccgcaagggccucgucuccggcggccucuacgagucccacgucggcugccgccccuacuccaucccccccugcgagcaccacgucaacggcucccgcccccccugcaccggcgagggcgacacccccaagugcuccaagaucugcgagcccggcuacucccccaccuacaagcaggacaagcacuacggcuacaacuccuacuccgucuccaacuccgagaaggacaucauggccgagaucuacaagaacggccccgucgagggcgccuucuccgucuacuccgacuuccuccucuacaaguccggcgucuaccagcacgucaccggcgagaugaugggcggccacgccauccgcauccucggcuggggcgucgagaacggcacccccuacuggcucgucgccaacuccuggaacaccgacuggggcgacaacggcuucuucaagauccuccgcggccaggaccacugcggcaucgaguccgaggucgucgccggcaucccccgcaccgaccaguacugggagaagaucuga

SEQ ID NO: 731 - RNA, 1020 nt, Artificial Sequence
  derived and/or modified sequence opt3 from cathepsin_B__Homo_sapiens__EAW65632
auguggcagcugugggccagccucugcugucuucugguguuggcuaacgcaagauccaggcccucuuuccacccuuuaucagacgagcuggucaauuacguuaacaagcggaauaccacauggcaagccggccauaacuuuuauaauguggauaugaguuaccuaaaacgccucugcgggacuuuccugggagguccaaagccgccccagcgaguaauguuuacggaagaccuuaaacugccugcgagcuucgaugcucgugagcaguggccacagugucccaccaucaaggaaauuagagaccaaggcuccugcgggucuuguugggccuuuggagcaguggaggccauaucggauaggaucugcauucacacaaacgcucaugucucaguggaaguuagcgcagaggacuugcucacuuguugcggcaguauguguggugaugggugcaauggaggcuauccugccgaggcuuggaacuucuggacccggaaaggccugguguccgggggacuguacgaaucucacgucgguugucgcccauauagcauucccccuugcgagcaucacgugaauggcuccagaccaccgugcacaggggaaggagacacccccaaguguucaaagaucugcgagccuggcuacaguccaacuuauaaacaggauaagcacuacgguuacaacagcuauucuguauccaauucagagaaagacaucauggccgaaauauacaagaacgggcccguugagggagcguuuagcguguauagugauuuccucuuauacaaaucuggcgucuaucagcaugugacaggcgaaaugaugggagggcacgcaaucaggauucuggguuggggcguggagaaugggaccccuuacuggcuugucgccaacuccuggaauacggacuggggagauaacggcuuuuucaagaucuugcggggucaggaccauugugggauugaaagcgagguuguggcuggcaucccacgcacugaccaauauugggagaagauauga

SEQ ID NO: 732 - RNA, 1020 nt, Artificial Sequence
  derived and/or modified sequence opt4 from cathepsin_B__Homo_sapiens__EAW65632
auguggcagcugugggccagccugugcugccugcuggugcuggccaacgccagaagcagacccagcuuccacccccugagcgacgagcuggugaacuacgugaacaagagaaacaccaccuggcaggccggccacaacuucuacaacguggacaugagcuaccugaagagacugugcggcaccuuccugggcggccccaagcccccccagagagugauguucaccgaggaccugaagcugcccgccagcuucgacgccagagagcaguggccccagugccccaccaucaaggagaucagagaccagggcagcugcggcagcugcugggccuucggcgccguggaggccaucagcgacagaaucugcauccacaccaacgcccacgugagcguggaggugagcgccgaggaccugcugaccugcugcggcagcaugugcggcgacggcugcaacggcggcuaccccgccgaggccuggaacuucuggaccagaaagggccuggugagcggcggccuguacgagagccacgugggcugcagacccuacagcaucccccccugcgagcaccacgugaacggcagcagaccccccugcaccggcgagggcgacacccccaagugcagcaagaucugcgagcccggcuacagccccaccuacaagcaggacaagcacuacggcuacaacagcuacagcgugagcaacagcgagaaggacaucauggccgagaucuacaagaacggccccguggagggcgccuucagcguguacagcgacuuccugcuguacaagagcggcguguaccagcacgugaccggcgagaugaugggcggccacgccaucagaauccugggcuggggcguggagaacggcacccccuacuggcugguggccaacagcuggaacaccgacuggggcgacaacggcuucuucaagauccugagaggccaggaccacugcggcaucgagagcgaggugguggccggcauccccagaaccgaccaguacugggagaagaucuga

SEQ ID NO: 733 - RNA, 1020 nt, Artificial Sequence
  derived and/or modified sequence opt5 from cathepsin_B__Homo_sapiens__EAW65632
auguggcagcugugggccagccucugcugucugcuugugcuggcuaacgccagaucccggcccucuuuccacccucucagcgacgagcuggucaauuacguuaacaagcgcaauaccacauggcaagcgggccauaacuuuuauaauguggauauguccuaccuuaaaagacugugcgggacguuccucggaggcccgaagcccccucagcgggugauguuuaccgaagaccugaaacugcccgcuucuuucgaugcccgcgagcaguggccucagugucccacaaucaaggaaauuagagaccaagggagcugcggauccuguugggccuuuggcgcugucgaggccaucucugaucggauuugcauccacaccaacgcucaugugagcguugaaguguccgccgaggaccuccugacauguugcgggagcauguguggagauggcugcaauggcggguauccugcggaggccuggaacuucuggacccgcaaaggacuugucucuggcgggcuguacgaaucccacgugggauguagaccguauagcauucccccuugcgagcaucacguuaauggcucucggcccccuugcacaggggaaggagacacccccaaguguuccaagaucugcgagccgggcuacagcccuacguauaaacaggauaagcacuacggcuacaacucuuauuccgugagcaauuccgagaaagacaucauggcugaaauuuacaagaacgggcccgucgagggagccuuuucuguguauagcgauuuccuccuguacaaauccggcguguaucagcaugucaccggggaaaugaugggaggccacgcuauccgcauucuuggguggggaguugagaauggcacaccuuacuggcugguggccaacagcuggaauaccgacuggggcgauaacggguuuuucaagauccucagaggacaggaccauuguggcauugaaucugagguggucgcggggaucccccggacagaccaauauugggagaagauuuga

SEQ ID NO: 734 - protein, 339 aa, Artificial Sequence; identical to SEQ ID NO: 727
  cathepsin_B__Homo_sapiens__P07858

SEQ ID NO: 735 - RNA, 1020 nt, Artificial Sequence
  cathepsin_B__Homo_sapiens__AAC37547
auguggcagcucugggccucccucugcugccugcugguguuggccaaugcccggagcaggcccucuuuccauccccugucggaugagcuggucaacuaugucaacaaacggaauaccacguggcaggccgggcacaacuucuacaacguggacaugagcuacuugaagaggcuaugugguaccuuccugggugggcccaagccaccccagagaguuauguuuaccgaggaccugaagcugccugcaagcuucgaugcacgggaacaauggccacagugucccaccaucaaagagaucagagaccagggcuccuguggcuccugcugggccuucggggcuguggaagccaucucugaccggaucugcauccacaccaaugcgcacgucagcguggaggugucggcggaggaccugcucacaugcuguggcagcauguguggggacggcuguaaugguggcuauccugcugaagcuuggaacuucuggacaagaaaaggccugguuucugguggccucuaugaaucccauguagggugcagaccguacuccaucccucccugugagcaccacgucaacggcucccggcccccaugcacgggggagggagauacccccaaguguagcaagaucugugagccuggcuacagcccgaccuacaaacaggacaagcacuacggauacaauuccuacagcgucuccaauagcgagaaggacaucauggccgagaucuacaaaaacggccccguggagggagcuuucucuguguauucggacuuccugcucuacaagucaggaguguaccaacacgucaccggagagaugauggguggccaugccauccgcauccugggcuggggaguggagaauggcacacccuacuggcugguugccaacuccuggaacacugacuggggugacaauggcuucuuuaaaauacucagaggacaggaucacuguggaaucgaaucagaagugguggcuggaauuccacgcaccgaucaguacugggaaaagaucuaa

SEQ ID NO: 736 - RNA, 1020 nt, Artificial Sequence; identical to SEQ ID NO: 729
  derived and/or modified sequence opt1 from cathepsin_B__Homo_sapiens__AAC37547

SEQ ID NO: 737 - RNA, 1020 nt, Artificial Sequence; identical to SEQ ID NO: 730
  derived and/or modified sequence opt2 from cathepsin_B__Homo_sapiens__AAC37547

SEQ ID NO: 738 - RNA, 1020 nt, Artificial Sequence; identical to SEQ ID NO: 731
  derived and/or modified sequence opt3 from cathepsin_B__Homo_sapiens__AAC37547

SEQ ID NO: 739 - RNA, 1020 nt, Artificial Sequence; identical to SEQ ID NO: 732
  derived and/or modified sequence opt4 from cathepsin_B__Homo_sapiens__AAC37547

SEQ ID NO: 740 - RNA, 1020 nt, Artificial Sequence; identical to SEQ ID NO: 733
  derived and/or modified sequence opt5 from cathepsin_B__Homo_sapiens__AAC37547

SEQ ID NO: 741 - protein, 333 aa, Artificial Sequence [sequence omitted]

SEQ ID NO: 742 - RNA, 1002 nt, Artificial Sequence
  cathepsin_L__Homo_sapiens__EAW62731
augaauccuacacucauccuugcugccuuuugccugggaauugccucagcuacucuaacauuugaucacaguuuagaggcacaguggaccaaguggaaggcgaugcacaacagauuauacggcaugaaugaagaaggauggaggagagcagugugggagaagaacaugaagaugauugaacugcacaaucaggaauacagggaagggaaacacagcuucacaauggccaugaacgccuuuggagacaugaccagugaagaauucaggcaggugaugaauggcuuucaaaaccguaagcccaggaaggggaaaguguuccaggaaccucuguuuuaugaggcccccagaucuguggauuggagagagaaaggcuacgugacuccugugaagaaucagggucagugugguucuuguugggcuuuuagugcuacuggugcucuugaaggacagauguuccggaaaacugggaggcuuaucucacugagugagcagaaucugguagacugcucugggccucaaggcaaugaaggcugcaaugguggccuaauggauuaugcuuuccaguauguucaggauaauggaggccuggacucugaggaauccuauccauaugaggcaacagaagaauccuguaaguacaaucccaaguauucuguugcuaaugacaccggcuuuguggacaucccuaagcaggagaaggcccugaugaaggcaguugcaacuguggggcccauuucuguugcuauugaugcaggucaugaguccuuccuguucuauaaagaaggcauuuauuuugagccagacuguagcagugaagacauggaucauggugugcuggugguuggcuacggauuugaaagcacagaaucagauaacaauaaauauuggcuggugaagaacagcuggggugaagaauggggcauggguggcuacguaaagauggccaaagaccggagaaaccauuguggaauugccucagcagccagcuaccccacuguguga

SEQ ID NO: 743 - RNA, 1002 nt, Artificial Sequence
  derived and/or modified sequence opt1 from cathepsin_L__Homo_sapiens__EAW62731
augaaccccacccugauccucgccgccuucugccugggcaucgcgagcgccacccugacguucgaccacucccucgaggcccaguggaccaaguggaaggccaugcacaaccgccuguacgggaugaacgaggagggcuggcggcgcgccgugugggagaagaacaugaagaugaucgagcugcacaaccaggaguaccgggaggggaagcacagcuucaccauggcgaugaacgccuucggcgacaugaccuccgaggaguuccgccaggucaugaacggguuccagaaccggaagccgcgcaagggcaagguguuccaggagccccucuucuacgaggcgccccggagcguggacuggcgcgagaagggcuacgucacgcccgugaagaaccaggggcagugcggcuccugcugggccuucagcgccaccggggcccuggagggccagauguuccggaagaccgggcgccugaucucccucagcgagcagaaccugguggacugcuccggcccgcagggcaacgaggggugcaacggcgggcugauggacuacgccuuccaguacguccaggacaacggcggccucgacagcgaggaguccuaccccuacgaggccaccgaggagagcugcaaguacaaccccaaguacuccguggccaacgacacgggguucguggacauccccaagcaggagaaggcgcugaugaaggccgucgccaccgugggcccgaucagcguggccaucgacgccgggcacgaguccuuccuguucuacaaggagggcaucuacuucgagcccgacugcagcuccgaggacauggaccacgggguccucguggugggcuacggcuucgagagcaccgaguccgacaacaacaaguacuggcuggucaagaacagcuggggcgaggagugggggaugggcggguacgugaagauggcgaaggaccggcgcaaccacugcgggaucgccagcgccgccuccuaccccaccguguga

SEQ ID NO: 744 - RNA, 1002 nt, Artificial Sequence
  derived and/or modified sequence opt2 from cathepsin_L__Homo_sapiens__EAW62731
augaaccccacccucauccucgccgccuucugccucggcaucgccuccgccacccucaccuucgaccacucccucgaggcccaguggaccaaguggaaggccaugcacaaccgccucuacggcaugaacgaggagggcuggcgccgcgccgucugggagaagaacaugaagaugaucgagcuccacaaccaggaguaccgcgagggcaagcacuccuucaccauggccaugaacgccuucggcgacaugaccuccgaggaguuccgccaggucaugaacggcuuccagaaccgcaagccccgcaagggcaaggucuuccaggagccccucuucuacgaggccccccgcuccgucgacuggcgcgagaagggcuacgucacccccgucaagaaccagggccagugcggcuccugcugggccuucuccgccaccggcgcccucgagggccagauguuccgcaagaccggccgccucaucucccucuccgagcagaaccucgucgacugcuccggcccccagggcaacgagggcugcaacggcggccucauggacuacgccuuccaguacguccaggacaacggcggccucgacuccgaggaguccuaccccuacgaggccaccgaggaguccugcaaguacaaccccaaguacuccgucgccaacgacaccggcuucgucgacauccccaagcaggagaaggcccucaugaaggccgucgccaccgucggccccaucuccgucgccaucgacgccggccacgaguccuuccucuucuacaaggagggcaucuacuucgagcccgacugcuccuccgaggacauggaccacggcguccucgucgucggcuacggcuucgaguccaccgaguccgacaacaacaaguacuggcucgucaagaacuccuggggcgaggaguggggcaugggcggcuacgucaagauggccaaggaccgccgcaaccacugcggcaucgccuccgccgccuccuaccccaccgucuga

SEQ ID NO: 745 - RNA, 1002 nt, Artificial Sequence
  derived and/or modified sequence opt3 from cathepsin_L__Homo_sapiens__EAW62731
augaaccccacccugauccucgccgcuuucugccuuggcauugcaagcgccacacugacuuuugaccacuccuuggaggcgcaguggacgaaguggaaagcuaugcauaauagauuauacgggaugaacgaagagggauggaggcgggccgugugggaaaagaauaugaaaaugauagagcugcacaaccaagaauaucgcgaggguaagcauucuuucaccauggcaaugaaugccuuuggcgauaugacaucagaggaguuccgacaggucaugaacggguuucagaaucguaaaccuagaaagggaaagguuuuccaggaaccacuauuuuacgaagcuccgaggaguguggacuggcgggagaaaggcuauguaacucccgugaagaaccaaggucagugugggagcugcugggcauucuccgccaccggagcucucgagggccagauguuucgcaaaacaggcagacugaucucucuuucggaacagaaucuggucgauuguucagggccucaaggaaacgaggguugcaauggcggguugauggacuacgccuuccaguaugugcaggauaacggaggccucgacagcgaagagaguuacccauaugaagcgaccgaggaguccuguaaguacaaucccaaauacucuguugcaaacgauacugguuuuguggacauuccuaagcaggaaaaggcccugaugaaagcugucgccacaguggggccaaucagcguagcaauugaugcuggacacgaguccuuccuguuuuauaaggaaggcaucuacuucgagcccgacugcucaagugaagauauggaccauggcguucucguggucggguauggauucgagagcaccgagucugauaauaacaaauacugguuagugaagaacuccuggggugaagaguggggcaugggaggguaugugaaaauggccaaggacaggcggaaucacuguggcauagcgucagccgcaagcuacccuacggucuga

SEQ ID NO: 746 - RNA, 1002 nt, Artificial Sequence
  derived and/or modified sequence opt4 from cathepsin_L__Homo_sapiens__EAW62731
augaaccccacccugauccuggccgccuucugccugggcaucgccagcgccacccugaccuucgaccacagccuggaggcccaguggaccaaguggaaggccaugcacaacagacuguacggcaugaacgaggagggcuggagaagagccgugugggagaagaacaugaagaugaucgagcugcacaaccaggaguacagagagggcaagcacagcuucaccauggccaugaacgccuucggcgacaugaccagcgaggaguucagacaggugaugaacggcuuccagaacagaaagcccagaaagggcaagguguuccaggagccccuguucuacgaggcccccagaagcguggacuggagagagaagggcuacgugacccccgugaagaaccagggccagugcggcagcugcugggccuucagcgccaccggcgcccuggagggccagauguucagaaagaccggcagacugaucagccugagcgagcagaaccugguggacugcagcggcccccagggcaacgagggcugcaacggcggccugauggacuacgccuuccaguacgugcaggacaacggcggccuggacagcgaggagagcuaccccuacgaggccaccgaggagagcugcaaguacaaccccaaguacagcguggccaacgacaccggcuucguggacauccccaagcaggagaaggcccugaugaaggccguggccaccgugggccccaucagcguggccaucgacgccggccacgagagcuuccuguucuacaaggagggcaucuacuucgagcccgacugcagcagcgaggacauggaccacggcgugcugguggugggcuacggcuucgagagcaccgagagcgacaacaacaaguacuggcuggugaagaacagcuggggcgaggaguggggcaugggcggcuacgugaagauggccaaggacagaagaaaccacugcggcaucgccagcgccgccagcuaccccaccguguga

SEQ ID NO: 747 - RNA, 1002 nt, Artificial Sequence
  derived and/or modified sequence opt5 from cathepsin_L__Homo_sapiens__EAW62731
augaaccccacccugauccucgccgcuuucugccugggcauugccagcgcgacacuuacguuugaccacucccuggaggcucaguggaccaaguggaaagccaugcauaauagacucuacgggaugaacgaagagggauggcggcgcgccgugugggaaaagaauaugaaaaugaucgagcugcacaaccaagaauauagagagggcaagcauucuuucacaauggcuaugaaugccuuuggggauaugaccagcgaggaauuucggcaggucaugaacggauuucagaaucgcaaaccuagaaagggcaagguuuuccaggagccgcuuuucuacgaagcuccccgguccguggacuggcgcgagaaaggguaugugacaccugucaagaaccaaggacaguguggcucuugcugggccuucagcgcgaccggcgcccuggaggggcagauguuuagaaaaacaggacggcucauuucccugucugaacagaaucugguggauuguagcggcccccaagggaacgagggaugcaauggcgggcucauggacuacgcuuuccaguauguucaggauaacggaggccuggacuccgaagagagcuacccuuaugaagccaccgaggagucuuguaaguacaaucccaaauacuccguggcuaacgauacgggcuuugucgacaucccuaagcaggaaaaggcccuuaugaaagcgguggccaccguugggccgauuagcguggcuaucgaugccggacacgagucuuuccuguuuuauaaggaaggcaucuacuucgagcccgacugcuccagcgaagauauggaccaugggguccucguggugggauauggcuucgagucuacagaguccgauaauaacaaauacuggcuggucaagaacagcuggggagaagagugggggaugggcggcuauguuaaaauggcuaaggaccgcagaaaucacugugggauugccuccgccgcuucuuacccuaccguguga

SEQ ID NO: 748 - protein, 333 aa, Artificial Sequence [sequence omitted]

SEQ ID NO: 749 - RNA, 1002 nt, Artificial Sequence; identical to SEQ ID NO: 742
  cathepsin_L__Homo_sapiens__AAA66974

SEQ ID NO: 750 - RNA, 1002 nt, Artificial Sequence; identical to SEQ ID NO: 743
  derived and/or modified sequence opt1 from cathepsin_L__Homo_sapiens__AAA66974

SEQ ID NO: 751 - RNA, 1002 nt, Artificial Sequence; identical to SEQ ID NO: 744
  derived and/or modified sequence opt2 from cathepsin_L__Homo_sapiens__AAA66974

SEQ ID NO: 752 - RNA, 1002 nt, Artificial Sequence; identical to SEQ ID NO: 745
  derived and/or modified sequence opt3 from cathepsin_L__Homo_sapiens__AAA66974

SEQ ID NO: 753 - RNA, 1002 nt, Artificial Sequence; identical to SEQ ID NO: 746
  derived and/or modified sequence opt4 from cathepsin_L__Homo_sapiens__AAA66974

SEQ ID NO: 754 - RNA, 1002 nt, Artificial Sequence; identical to SEQ ID NO: 747
  derived and/or modified sequence opt5 from cathepsin_L__Homo_sapiens__AAA66974

SEQ ID NO: 755 - protein, 151 aa, Artificial Sequence
  cathepsin_L__Homo_sapiens__Q9HBQ7
MDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 756 - RNA, 456 nt, Artificial Sequence
  cathepsin_L__Homo_sapiens__AAG17239
auggauuaugcuuuccaguauguucaggauaauggaggccuggacucugaggaauccuauccauaugaggcaacagaagaauccuguaaguacaaucccaaguauucuguugcuaaugacaccggcuuuguggacaucccuaagcaggagaaggcccugaugaaggcaguugcaacuguggggcccauuucuguugcuauugaugcaggucaugaguccuuccuguucuauaaagaaggcauuuauuuugagccagacuguagcagugaagacauggaucauggugugcuggugguuggcuacggauuugaaagcacagaaucagauaacaauaaauauuggcuggugaagaacagcuggggugaagaauggggcauggguggcuacguaaagauggccaaagaccggagaaaccauuguggaauugccucagcagccagcuaccccacuguguga

SEQ ID NO: 757 - RNA, 456 nt, Artificial Sequence
  derived and/or modified sequence opt1 from cathepsin_L__Homo_sapiens__AAG17239
auggacuacgccuuccaguacgugcaggacaacggcgggcuggacagcgaggaguccuaccccuacgaggccaccgaggagagcugcaaguacaacccgaaguacuccgucgcgaacgacaccggcuucguggacauccccaagcaggagaaggcccucaugaaggccguggccacggucgggcccaucagcguggccaucgacgcgggccacgaguccuuccuguucuacaaggaggggaucuacuucgagcccgacugcagcuccgaggacauggaccacggcgugcuggucgugggcuacggguucgagagcaccgaguccgacaacaacaaguacuggcucgugaagaacagcuggggcgaggagugggggaugggcggguacgucaagauggccaaggaccgccggaaccacugcggcaucgccuccgccgcgagcuacccgaccguguga

SEQ ID NO: 758 - RNA, 456 nt, Artificial Sequence
  derived and/or modified sequence opt2 from cathepsin_L__Homo_sapiens__AAG17239
auggacuacgccuuccaguacguccaggacaacggcggccucgacuccgaggaguccuaccccuacgaggccaccgaggaguccugcaaguacaaccccaaguacuccgucgccaacgacaccggcuucgucgacauccccaagcaggagaaggcccucaugaaggccgucgccaccgucggccccaucuccgucgccaucgacgccggccacgaguccuuccucuucuacaaggagggcaucuacuucgagcccgacugcuccuccgaggacauggaccacggcguccucgucgucggcuacggcuucgaguccaccgaguccgacaacaacaaguacuggcucgucaagaacuccuggggcgaggaguggggcaugggcggcuacgucaagauggccaaggaccgccgcaaccacugcggcaucgccuccgccgccuccuaccccaccgucuga

SEQ ID NO: 759 - RNA, 456 nt, Artificial Sequence
  derived and/or modified sequence opt3 from cathepsin_L__Homo_sapiens__AAG17239
auggacuacgccuuccaguaugugcaagauaacggcgggcuggacagcgaggaauccuaccccuaugaggcuaccgaagagucuugcaaguacaauccuaaauauucagucgcaaacgauacaggauuuguugacaucccaaagcaggaaaaagcccucaugaaggcgguggcuacuguagguccgauuaguguggccauagaugcaggccacgagagcuuccuguuuuacaaagaggggaucuauuucgaacccgacuguuccucugaggauauggaccauggaguccuugugguuggcuacgguuuugaaucgacggagucagauaauaacaaguacugguuggugaagaauagcuggggagaggaaugggggaugggcggcuaugucaaaauggccaaggacagaaggaaccacugcgggauugcuagugcagccuccuacccuaccguguga

SEQ ID NO: 760 - RNA, 456 nt, Artificial Sequence
  derived and/or modified sequence opt4 from cathepsin_L__Homo_sapiens__AAG17239
auggacuacgccuuccaguacgugcaggacaacggcggccuggacagcgaggagagcuaccccuacgaggccaccgaggagagcugcaaguacaaccccaaguacagcguggccaacgacaccggcuucguggacauccccaagcaggagaaggcccugaugaaggccguggccaccgugggccccaucagcguggccaucgacgccggccacgagagcuuccuguucuacaaggagggcaucuacuucgagcccgacugcagcagcgaggacauggaccacggcgugcugguggugggcuacggcuucgagagcaccgagagcgacaacaacaaguacuggcuggugaagaacagcuggggcgaggaguggggcaugggcggcuacgugaagauggccaaggacagaagaaaccacugcggcaucgccagcgccgccagcuaccccaccguguga

SEQ ID NO: 761 - RNA, 456 nt, Artificial Sequence
  derived and/or modified sequence opt5 from cathepsin_L__Homo_sapiens__AAG17239
auggacuacgccuuccaguaugugcaagauaacggcgggcuggacagcgaggaauccuaccccuaugaggcuaccgaagagucuugcaaguacaauccuaaauauagcgucgccaacgauacaggauuuguugacaucccgaagcaggaaaaagcgcucaugaaggcuguggccacggugggccccauuuccgucgccaucgaugcugggcacgagucuuuccuguuuuacaaagagggaauuuauuucgaaccugacuguagcuccgaggauauggaccauggcgugcuuguugugggguacggauuugaaucuaccgagagcgauaauaacaaguacuggcuggucaaaaauuccuggggcgaggaauggggcaugggaggguaugugaagauggccaaggacagacggaaccacugcggcaucgcuagcgccgcgucuuaccccacaguuuga

SEQ ID NO: 762 - protein, 327 aa, Artificial Sequence
  CD1A__Homo_sapiens__P06126
MLFLLLPLLAVLPGDGNADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 763 - RNA, 984 nt, Artificial Sequence
  CD1A__Homo_sapiens__AAA51932
augcuguuuuugcuacuuccauuguuagcuguucucccaggugauggcaaugcagacgggcucaaggagccucucuccuuccaugucaccuggaucgcauccuuuuacaaccauuccuggaaacaaaaucuggucucagguuggcugagugauuugcagacucauaccugggacagcaauuccagcaccaucguuuuccugugccccugguccaggggaaacuucagcaaugaggaguggaaggaacuggaaacauuauuccguauacgcaccauucggucauuugagggaauucguagauacgcccaugaauugcaguuugaauauccuuuugagauacaggugacaggaggcugugagcugcacucuggaaaggucucaggaagcuucuugcaguuagcuuaucaaggaucagacuuugugagcuuccagaacaauucaugguugccauauccaguggcugggaauauggccaagcauuucugcaaagugcucaaucagaaucagcaugaaaaugacauaacacacaaucuucucagugacaccugcccacguuucaucuugggucuucuugaugcaggaaaggcacaucuccagcggcaagugaagcccgaggccuggcugucccauggccccaguccuggcccuggccaucugcagcuugugugccaugucucaggauucuacccaaagcccgugugggugauguggaugcggggugagcaggagcagcagggcacucagcgaggggacaucuugcccagugcugaugggacaugguaucuccgcgcaacccuggagguggccgcuggggaggcagcugaccuguccugucgggugaagcacagcagucuagagggccaggacaucguccucuacugggagcaucacaguuccgugggcuucaucaucuuggcggugauagugccuuuacuucuucugauaggucuugcgcuuugguucaggaaacgcuguuucuguuaa

SEQ ID NO: 764 - RNA, 984 nt, Artificial Sequence
  derived and/or modified sequence opt1 from CD1A__Homo_sapiens__AAA51932
augcuguuccuccugcugccccuccuggccgugcugccgggcgacgggaacgccgacggccucaaggagccccugagcuuccacgucaccuggaucgcguccuucuacaaccacagcuggaagcagaaccugguguccggguggcucagcgaccugcagacccacacgugggacuccaacagcuccaccaucguguuccugugccccuggagccgcggcaacuucuccaacgaggaguggaaggagcucgagacccuguuccggauccgcaccauccggagcuucgaggggauccgccgguacgcccacgagcugcaguucgaguaccccuucgagauccaggucacgggcggcugcgagcuccacuccgggaaggugagcggcuccuuccugcagcuggccuaccaggggagcgacuucguguccuuccagaacaacagcuggcucccguaccccgucgccggcaacauggccaagcacuucugcaaggugcugaaccagaaccagcacgagaacgacaucacccacaaccugcucuccgacacgugcccccgcuucauccuggggcugcucgacgcgggcaaggcccaccuccagcgccaggugaagcccgaggccuggcugagccacggcccgucccccgggcccggccaccuccagcuggucugccacgugagcggguucuaccccaagccggugugggucauguggaugcggggcgagcaggagcagcagggcacccagcgcggggacauccugcccagcgccgacggcaccugguaccugcgggcgacccuggagguggccgccggggaggccgccgaccuguccugccgggugaagcacagcucccucgagggccaggacaucguccuguacugggagcaccacagcuccgugggguucaucauccuggcggugaucgucccccuccugcugcucaucggccuggcccugugguuccgcaagcggugcuucugcuga

SEQ ID NO: 765 - RNA, 984 nt, Artificial Sequence
  derived and/or modified sequence opt2 from CD1A__Homo_sapiens__AAA51932
augcucuuccuccuccucccccuccucgccguccuccccggcgacggcaacgccgacggccucaaggagccccucuccuuccacgucaccuggaucgccuccuucuacaaccacuccuggaagcagaaccucgucuccggcuggcucuccgaccuccagacccacaccugggacuccaacuccuccaccaucgucuuccucugccccuggucccgcggcaacuucuccaacgaggaguggaaggagcucgagacccucuuccgcauccgcaccauccgcuccuucgagggcauccgccgcuacgcccacgagcuccaguucgaguaccccuucgagauccaggucaccggcggcugcgagcuccacuccggcaaggucuccggcuccuuccuccagcucgccuaccagggcuccgacuucgucuccuuccagaacaacuccuggcuccccuaccccgucgccggcaacauggccaagcacuucugcaagguccucaaccagaaccagcacgagaacgacaucacccacaaccuccucuccgacaccugcccccgcuucauccucggccuccucgacgccggcaaggcccaccuccagcgccaggucaagcccgaggccuggcucucccacggccccucccccggccccggccaccuccagcucgucugccacgucuccggcuucuaccccaagcccgucugggucauguggaugcgcggcgagcaggagcagcagggcacccagcgcggcgacauccuccccuccgccgacggcaccugguaccuccgcgccacccucgaggucgccgccggcgaggccgccgaccucuccugccgcgucaagcacuccucccucgagggccaggacaucguccucuacugggagcaccacuccuccgucggcuucaucauccucgccgucaucgucccccuccuccuccucaucggccucgcccucugguuccgcaagcgcugcuucugcuga

SEQ ID NO: 766 - RNA, 984 nt, Artificial Sequence
  derived and/or modified sequence opt3 from CD1A__Homo_sapiens__AAA51932
augcuguuccuccuucugcccuuguuagccgugcugccuggcgacgggaacgcugauggacuaaaggagccacucagcuuucacgucaccuggaucgcauccuucuacaaucauucuuggaaacagaaccugguuucagguuggcuuagugaccugcaaacacacacuugggauagcaauuccucuacgauuguguuuuugugcccguggucgagaggcaacuucucaaaugaagaguggaaggaacucgagacccuguuuaggauacggacaauccgcagcuucgaagggauucgacguuaugcccaugagcugcaguuugaguaccccuucgaaauccagguaacuggaggcugugagcuccacagugguaaaguguccgggagcuuuuuacagcuggcguaucaaggaucugacuucgucuccuuucagaacaauucauggcuuccuuacccaguggcuggcaacauggccaagcauuucugcaaaguuuugaaucagaaccagcacgaaaaugauauuacccacaaccugcuaagugacacaugucccagauuuauccucggccugcuugaugcagggaaggcccaucugcaaaggcaagugaagccugaggcuugguugagccacggaccaucucccgguccuggccaucuccagcuggucugccacguguccggguucuauccaaaaccgguauggguuauguggaugcggggagagcaggaacagcagggcacccagcgcggugacauauuacccucagcagaugggacuugguaccugagagccacacucgagguggcugccggagaagcggcagaccuuagcuguagggucaagcacaguucucuggagggccaagauaucguguuguauugggaacaucacuccagcgugggcuucauuauccuagccgucauuguuccucugcuccugcuuaucgggcuggcuuugugguuucggaaacgcugcuucuguuga

SEQ ID NO: 767 - RNA, 984 nt, Artificial Sequence
  derived and/or modified sequence opt4 from CD1A__Homo_sapiens__AAA51932
augcuguuccugcugcugccccugcuggccgugcugcccggcgacggcaacgccgacggccugaaggagccccugagcuuccacgugaccuggaucgccagcuucuacaaccacagcuggaagcagaaccuggugagcggcuggcugagcgaccugcagacccacaccugggacagcaacagcagcaccaucguguuccugugccccuggagcagaggcaacuucagcaacgaggaguggaaggagcuggagacccuguucagaaucagaaccaucagaagcuucgagggcaucagaagauacgcccacgagcugcaguucgaguaccccuucgagauccaggugaccggcggcugcgagcugcacagcggcaaggugagcggcagcuuccugcagcuggccuaccagggcagcgacuucgugagcuuccagaacaacagcuggcugcccuaccccguggccggcaacauggccaagcacuucugcaaggugcugaaccagaaccagcacgagaacgacaucacccacaaccugcugagcgacaccugccccagauucauccugggccugcuggacgccggcaaggcccaccugcagagacaggugaagcccgaggccuggcugagccacggccccagccccggccccggccaccugcagcuggugugccacgugagcggcuucuaccccaagcccgugugggugauguggaugagaggcgagcaggagcagcagggcacccagagaggcgacauccugcccagcgccgacggcaccugguaccugagagccacccuggagguggccgccggcgaggccgccgaccugagcugcagagugaagcacagcagccuggagggccaggacaucgugcuguacugggagcaccacagcagcgugggcuucaucauccuggccgugaucgugccccugcugcugcugaucggccuggcccugugguucagaaagagaugcuucugcuga

SEQ ID NO: 768 - RNA, 984 nt, Artificial Sequence
  derived and/or modified sequence opt5 from CD1A__Homo_sapiens__AAA51932
augcuguuccuccugcuuccccugcucgccgugcugccuggcgacgggaacgcugauggacuuaaggagccgcugagcuuucacgucaccuggaucgccuccuucuacaaucauucuuggaaacagaaccucguuagcggcuggcuguccgaccugcaaacacacacgugggauucuaauagcuccaccauuguguuucucugccccuggucuagagggaacuucagcaaugaagaguggaaggaacuggagacacuuuuucggauccgcaccauuagauccuucgaaggaauccggcgcuaugcgcaugagcugcaguuugaguacccuuucgaaauucaggugacaggcgggugugagcuccacagcggaaaagucucuggcuccuuucugcagcuugcuuaucaaggcagcgacuucgugucuuuucagaacaauuccuggcugcccuacccuguugccgggaacauggccaagcauuucugcaaagugcucaaucagaaccagcacgaaaaugauaucacccacaaccugcugagcgacacaugucccagauuuauccucggacugcuugaugcuggcaaggcccaucugcaacggcaggucaagccugaggcuuggcucucucacgggccgucccccggaccuggccaucugcagcuugugugccacguuagcggguucuaucccaaaccugugugggucauguggaugcgcggagagcaggaacaacagggcacccagagaggcgacauucugcccuccgccgaugggacgugguaccuccgggcgacccuggagguggccgcuggagaagccgcugaccugucuugucgcgugaagcacagcucccucgagggccaagauaucguccuguauugggaacaucacagcucuguuggguucauuauccuugccgugauugugccgcugcuccugcuuaucggacuggcgcucugguuuagaaaacggugcuucuguuga

SEQ ID NO: 769 - protein, 333 aa, Artificial Sequence
  CD1B__Homo_sapiens__P29016
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 770 - RNA, 1002 nt, Artificial Sequence
  CD1B__Homo_sapiens__AAA51939
augcugcugcugccauuucaacuguuagcuguucucuuuccuggugguaacagugaacaugccuuccaggggccgaccuccuuucauguuauccagaccucguccuuuaccaauaguaccugggcacaaacucaaggcucaggcugguuggaugauuugcagauucauggcugggauagcgacucaggcacugccauauuccugaagccuuggucuaaagguaacuuuagugauaaggagguugcugaguuagaggagauauuccgagucuacaucuuuggauucgcucgagaaguacaagacuuugccggugauuuccagaugaaauaccccuuugagauccagggcauagcaggcugugagcuacauucuggaggugccauaguaagcuuccugaggggagcucuaggaggauuggauuuccugagugucaagaaugcuucaugugugccuuccccagaagguggcagcagggcacagaaauucugugcacuaaucauacaauaucaagguaucauggaaacugugagaauucuccucuaugaaaccugcccccgauaucucuugggcguccucaaugcaggaaaagcagaucugcaaagacaagugaagccugaggccuggcuguccaguggccccaguccuggaccuggccgucugcagcuugugugccaugucucaggauucuacccaaagcccgugugggugauguggaugcggggugagcaggagcagcagggcacucagcuaggggacauccugcccaaugcuaacuggacaugguaucuccgagcaacccuggauguggcagauggggaggcggcuggccuguccugucgggugaagcacagcaguuuagagggccaggacaucauccucuacuggagaaaccccaccuccauuggcucaauuguuuuggcaauaauagugccuuccuugcuccuuuugcuaugccuugcauuaugguauaugaggcgccggucauaucagaauaucccauga

SEQ ID NO: 771 - RNA, 1002 nt, Artificial Sequence
  derived and/or modified sequence opt1 from CD1B__Homo_sapiens__AAA51939
augcugcuccugcccuuccagcugcucgccgugcuguucccgggcgggaacagcgagcacgccuuccagggccccaccuccuuccacgucauccagaccagcuccuucacgaacagcaccugggcgcagacccagggguccggcuggcuggacgaccuccagauccacgggugggacagcgacuccggcaccgccaucuuccugaagcccuggagcaagggcaacuucuccgacaaggagguggccgagcuggaggagaucuuccgcguguacaucuucggguucgcccgggagguccaggacuucgccggcgacuuccagaugaaguaccccuucgagauccaggggaucgcgggcugcgagcuccacagcgggggcgccaucguguccuuccugcgcggcgcccucgggggccuggacuuccugagcgugaagaacgccuccugcgucccgagccccgagggcgggucccgggcgcagaaguucugcgcccugaucauccaguaccagggcaucauggagacggugcgcauccuccuguacgagaccugcccccgguaccugcucggggugcugaacgccggcaaggccgaccugcagcgccaggucaagcccgaggccuggcucagcuccgggccgagccccggccccgggcggcugcagcuggugugccacguguccggcuucuaccccaagccggucugggugauguggaugcgcggcgagcaggagcagcaggggacccagcucggcgacauccugcccaacgcgaacuggaccugguaccugcgggccacgcucgacguggccgacggggaggccgccggccugagcugccgcgucaagcacagcucccuggaggggcaggacaucauccucuacuggcggaaccccaccagcaucggcuccaucgugcuggcgaucaucgugcccagccugcuccugcugcucugccuggcccugugguacaugcgccggcgcuccuaccagaacaucccguga

SEQ ID NO: 772 - RNA, 1002 nt, Artificial Sequence
  derived and/or modified sequence opt2 from CD1B__Homo_sapiens__AAA51939
augcuccuccuccccuuccagcuccucgccguccucuuccccggcggcaacuccgagcacgccuuccagggccccaccuccuuccacgucauccagaccuccuccuucaccaacuccaccugggcccagacccagggcuccggcuggcucgacgaccuccagauccacggcugggacuccgacuccggcaccgccaucuuccucaagcccugguccaagggcaacuucuccgacaaggaggucgccgagcucgaggagaucuuccgcgucuacaucuucggcuucgcccgcgagguccaggacuucgccggcgacuuccagaugaaguaccccuucgagauccagggcaucgccggcugcgagcuccacuccggcggcgccaucgucuccuuccuccgcggcgcccucggcggccucgacuuccucuccgucaagaacgccuccugcguccccucccccgagggcggcucccgcgcccagaaguucugcgcccucaucauccaguaccagggcaucauggagaccguccgcauccuccucuacgagaccugcccccgcuaccuccucggcguccucaacgccggcaaggccgaccuccagcgccaggucaagcccgaggccuggcucuccuccggccccucccccggccccggccgccuccagcucgucugccacgucuccggcuucuaccccaagcccgucugggucauguggaugcgcggcgagcaggagcagcagggcacccagcucggcgacauccuccccaacgccaacuggaccugguaccuccgcgccacccucgacgucgccgacggcgaggccgccggccucuccugccgcgucaagcacuccucccucgagggccaggacaucauccucuacuggcgcaaccccaccuccaucggcuccaucguccucgccaucaucguccccucccuccuccuccuccucugccucgcccucugguacaugcgccgccgcuccuaccagaacauccccuga

SEQ ID NO: 773 - RNA, 1002 nt, Artificial Sequence
  derived and/or modified sequence opt3 from CD1B__Homo_sapiens__AAA51939
augcugcuccuucccuuccagcuguuggccguguuauuuccuggcgggaacagcgagcacgcuuuccaaggaccaaccuccuuucaugucauccagacaucuucauucacuaauaguacgugggcacagacccaggguagcggcuggcuggacgaucuacaaauucacgggugggacuccgauucuggaacagccauauuucucaagccguggucgaaaggcaacuucucagacaaggaaguugcggagcuggaagagaucuuuagaguguacauuuucgguuuugcuagggaaguacaggauuucgccggggacuuucagaugaaauaucccuucgagauccagggaauugcaggcugcgagcuucauagcggcggggccaucgugaguuuucugcggggagcuuuggguggccucgauuuccuguccgucaagaaugcaucuugugugccuagcccagaagggggaucccgcgcccaaaaauucugcgcucugauaauccaguaccagggcauuauggagacuguucgaauccucuuauaugaaaccuguccccguuaccugcuugguguguugaacgccgggaaggcggaccugcagagacaagucaagccugaggcauggcuaucaaguggaccaagccccggcccuggcaggcuccagcuggugugccacguaucuggguuuuauccaaaaccgguuugggugauguggaugcggggagagcaggaacaacaggguacacagcuuggcgauauucugcccaaugccaacuggaccugguacuugcgcgcuacucucgacgucgccgauggggaggcagcuggacuguccuguagagugaagcauagcucauuagaaggccaggacaucauacuguauuggaggaauccuacaaguauugguucuaucgugcucgccauuaucgucccaucccuucuguugcuacugugccucgcgcugugguacaugcggcgccgaagcuaccaaaacauccccuga

SEQ ID NO: 774 - RNA, 1002 nt, Artificial Sequence
  derived and/or modified sequence opt4 from CD1B__Homo_sapiens__AAA51939
augcugcugcugcccuuccagcugcuggccgugcuguuccccggcggcaacagcgagcacgccuuccagggccccaccagcuuccacgugauccagaccagcagcuucaccaacagcaccugggcccagacccagggcagcggcuggcuggacgaccugcagauccacggcugggacagcgacagcggcaccgccaucuuccugaagcccuggagcaagggcaacuucagcgacaaggagguggccgagcuggaggagaucuucagaguguacaucuucggcuucgccagagaggugcaggacuucgccggcgacuuccagaugaaguaccccuucgagauccagggcaucgccggcugcgagcugcacagcggcggcgccaucgugagcuuccugagaggcgcccugggcggccuggacuuccugagcgugaagaacgccagcugcgugcccagccccgagggcggcagcagagcccagaaguucugcgcccugaucauccaguaccagggcaucauggagaccgugagaauccugcuguacgagaccugccccagauaccugcugggcgugcugaacgccggcaaggccgaccugcagagacaggugaagcccgaggccuggcugagcagcggccccagccccggccccggcagacugcagcuggugugccacgugagcggcuucuaccccaagcccgugugggugauguggaugagaggcgagcaggagcagcagggcacccagcugggcgacauccugcccaacgccaacuggaccugguaccugagagccacccuggacguggccgacggcgaggccgccggccugagcugcagagugaagcacagcagccuggagggccaggacaucauccuguacuggagaaaccccaccagcaucggcagcaucgugcuggccaucaucgugcccagccugcugcugcugcugugccuggcccugugguacaugagaagaagaagcuaccagaacauccccuga

SEQ ID NO: 775 - RNA, 1002 nt, Artificial Sequence
  derived and/or modified sequence opt5 from CD1B__Homo_sapiens__AAA51939
augcugcuccugcccuuccagcuucuggccgugcucuuuccuggcgggaacagcgagcacgcuuuccaaggaccgaccuccuuucaugucauccagacaucuagcuucaccaauuccacgugggcccagacacagggcucuggguggcuggacgaucuucaaauucacggaugggacagcgauuccggcaccgcgaucuuucugaagcccuggucuaaagggaacuucagcgacaaggaaguugcugagcucgaagagauuuuuagaguguacaucuucggauuugcccgggaagugcaggauuucgccggcgacuuucagaugaaauauccuuucgagauucagggcaucgcugggugcgagcugcauuccggaggcgccaucgucagcuuucugcgcggggcucucggaggccuggauuuccuuucugugaagaaugccuccuguguucccagcccugaagggggaucuagagcgcaaaaauucugcgcccugauuauccaguaccagggcauuauggagacagugcggauccuccuguaugaaaccuguccccgcuaccuucugggcguccucaacgcugggaaggccgaccugcagagacaagugaagccugaggcuuggcuguccagcggaccgucucccggcccugggcggcuccagcugguuugccacguguccggauuuuaucccaaaccugucugggugauguggaugcgcggcgagcaggaacaacaggggacacagcuuggagauauucugcccaaugccaacuggaccugguaccucagagcgacgcuggacguggccgauggcgaggcugccggccuuagcugucgggucaagcauuccucucuggaagggcaggacaucauucucuauuggcgcaauccgaccagcaucggauccaucguucuggcuauuaucgugccuagccugcuccugcuucugugccucgcccugugguacaugagacggcgcucuuaccaaaacauucccuga

SEQ ID NO: 776 - protein, 333 aa, Artificial Sequence
  CD1C__Homo_sapiens__P29017
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 777 - RNA, 1002 nt, Artificial Sequence
  CD1C__Homo_sapiens__AAI26466
augcuguuucugcaguuucugcugcuagcucuucuucucccagguggugacaaugcagacgcaucccaggaacacgucuccuuccaugucauccagaucuucucauuugucaaccaauccugggcacgaggucagggcucaggauggcuggacgaguugcagacucauggcugggacagugaaucaggcacaauaauuuuccugcauaacugguccaagggcaacuucagcaaugaagaguugucagaccuagaguuguuauuucguuucuaccucuuuggauuaacucgggagauucaagaccaugcaagucaagauuacucgaaauaucccuuugaaguacaggugaaagcgggcugugagcugcauucuggaaagagcccagaaggcuucuuucagguagcuuucaacggauuagauuuacugaguuuccagaauacaacaugggugccaucuccaggcuguggaaguuuggcccaaagugucugucaucuacucaaucaucaguaugaaggcgucacagaaacaguguauaaucucauaagaagcacuugcccccgauuucucuugggucuccuggaugcagggaagauguauguacacaggcaagugaggccagaagccuggcuguccagucgccccagccuugggucuggccagcuguugcugguuugucaugccuccggcuucuacccaaagccuguuugggugacauggaugcggaaugaacaggagcaacugggcacuaaacauggugauauucuuccuaaugcugaugggacaugguaucuucaggugauccuggagguggcaucugaggagccugcuggccugucuugucgagugagacacagcagucuaggaggccaggacaucauccucuacuggggacaccacuuuuccaugaauuggauugccuugguagugauagugcccuuggugauucuaauaguccuuguguuaugguuuaagaagcacugcucauaucaggacauccuguga

SEQ ID NO: 778 - RNA, 1002 nt, Artificial Sequence
  derived and/or modified sequence opt1 from CD1C__Homo_sapiens__AAI26466
augcuguuccuccaguuccugcugcucgcccugcugcuccccggcggggacaacgccgacgcgagccaggagcacguguccuuccacgucauccagaucuucagcuucgugaaccaguccugggcccgcggccaggggagcggcuggcuggacgagcugcagacccacgggugggacuccgagagcggcaccaucaucuuccuccacaacugguccaagggcaacuucagcaacgaggagcuguccgaccuggagcuccuguuccgguucuaccuguucgggcucacgcgcgagauccaggaccacgccagccaggacuacuccaaguacccguucgaggugcaggucaaggccggcugcgagcugcacagcgggaagucccccgagggcuucuuccagguggccuucaacgggcuggaccuccugagcuuccagaacaccaccugggugcccucccccggcugcggcagccuggcgcaguccgucugccaccuccugaaccaccaguacgagggggugaccgagacgguguacaaccugauccggagcacgugcccgcgcuuccuccugggccugcucgacgccgggaagauguacguccaccgccaggugcggcccgaggccuggcuguccagccggcccagccugggcuccggccagcuccugcuggugugccacgccagcggguucuaccccaagccggucugggugaccuggaugcgcaacgagcaggagcagcucggcaccaagcacggggacauccugcccaacgcggacggcaccugguaccuccaggugauccuggaggucgccuccgaggagcccgccgggcugagcugccgggugcgccacuccagccugggcggccaggacaucauccucuacugggggcaccacuucuccaugaacuggaucgcccugguggucaucgugccccuggugauccucaucguccuggugcugugguucaagaagcacugcagcuaccaggacauccucuga

SEQ ID NO: 779 - RNA, 1002 nt, Artificial Sequence
  derived and/or modified sequence opt2 from CD1C__Homo_sapiens__AAI26466
augcucuuccuccaguuccuccuccucgcccuccuccuccccggcggcgacaacgccgacgccucccaggagcacgucuccuuccacgucauccagaucuucuccuucgucaaccaguccugggcccgcggccagggcuccggcuggcucgacgagcuccagacccacggcugggacuccgaguccggcaccaucaucuuccuccacaacugguccaagggcaacuucuccaacgaggagcucuccgaccucgagcuccucuuccgcuucuaccucuucggccucacccgcgagauccaggaccacgccucccaggacuacuccaaguaccccuucgagguccaggucaaggccggcugcgagcuccacuccggcaagucccccgagggcuucuuccaggucgccuucaacggccucgaccuccucuccuuccagaacaccaccuggguccccucccccggcugcggcucccucgcccaguccgucugccaccuccucaaccaccaguacgagggcgucaccgagaccgucuacaaccucauccgcuccaccugcccccgcuuccuccucggccuccucgacgccggcaagauguacguccaccgccagguccgccccgaggccuggcucuccucccgccccucccucggcuccggccagcuccuccucgucugccacgccuccggcuucuaccccaagcccgucugggucaccuggaugcgcaacgagcaggagcagcucggcaccaagcacggcgacauccuccccaacgccgacggcaccugguaccuccaggucauccucgaggucgccuccgaggagcccgccggccucuccugccgcguccgccacuccucccucggcggccaggacaucauccucuacuggggccaccacuucuccaugaacuggaucgcccucgucgucaucgucccccucgucauccucaucguccucguccucugguucaagaagcacugcuccuaccaggacauccucuga

SEQ ID NO: 780 - RNA, 1002 nt, Artificial Sequence
  derived and/or modified sequence opt3 from CD1C__Homo_sapiens__AAI26466
augcuguuccuccaguuucuucuguuggccuuacugcuacccggcggggacaacgcugaugcaagccaagagcacguguccuuccaugucauccagauauuuucuuucguuaaucagucaugggccagaggacaggguaguggcuggcucgacgaacugcaaacccacgggugggauagcgaguccggaacaauuaucuuucuucauaacuggucuaagggcaauuucucgaacgaggaacugucagacuuggaacuccuguuuagguucuaccuguuuggucucacucgggagauucaggaucacgcgagccaggacuauaguaaauacccuuucgaggugcagguaaaggcugggugcgaauuacauuccggaaaaucuccagagggcuuuuuccaaguggccuuuaauggccuggaucuuuugagcuuccagaacacgaccugggucccgucccccggguguggaucacuggcacagagugugugccaccuacucaaucaccaguaugaagguguuacagagacuguguacaaccugauccgcagcaccuguccucgauuccuucugggcuugcucgacgccgggaagauguauguccaucgucaagugagaccagaggcuuggcugucuuccaggcccucauuaggaagcggccagcugcuccuuguaugccacgcaagugguuuuuacccuaaaccaguuugggugacauggaugcggaaugaacaggagcaacuggggaccaagcauggagauauuuugcccaacgccgacggcacuugguaucuacaggucauccuggaaguggcuucugaggaaccugccggccucuccugucgcgugagacacagcucgcuugggggacaggauauaauccuguacuggggucaccauuucucuaugaauuggauugcgcuggucguuaucgugccauugguaauucucaucgugcuggucuuaugguuuaagaaacacugcuccuaccaggacauacuguga

SEQ ID NO: 781 - RNA, 1002 nt, Artificial Sequence
  derived and/or modified sequence opt4 from CD1C__Homo_sapiens__AAI26466
augcuguuccugcaguuccugcugcuggcccugcugcugcccggcggcgacaacgccgacgccagccaggagcacgugagcuuccacgugauccagaucuucagcuucgugaaccagagcugggccagaggccagggcagcggcuggcuggacgagcugcagacccacggcugggacagcgagagcggcaccaucaucuuccugcacaacuggagcaagggcaacuucagcaacgaggagcugagcgaccuggagcugcuguucagauucuaccuguucggccugaccagagagauccaggaccacgccagccaggacuacagcaaguaccccuucgaggugcaggugaaggccggcugcgagcugcacagcggcaagagccccgagggcuucuuccagguggccuucaacggccuggaccugcugagcuuccagaacaccaccugggugcccagccccggcugcggcagccuggcccagagcgugugccaccugcugaaccaccaguacgagggcgugaccgagaccguguacaaccugaucagaagcaccugccccagauuccugcugggccugcuggacgccggcaagauguacgugcacagacaggugagacccgaggccuggcugagcagcagacccagccugggcagcggccagcugcugcuggugugccacgccagcggcuucuaccccaagcccgugugggugaccuggaugagaaacgagcaggagcagcugggcaccaagcacggcgacauccugcccaacgccgacggcaccugguaccugcaggugauccuggagguggccagcgaggagcccgccggccugagcugcagagugagacacagcagccugggcggccaggacaucauccuguacuggggccaccacuucagcaugaacuggaucgcccugguggugaucgugccccuggugauccugaucgugcuggugcugugguucaagaagcacugcagcuaccaggacauccuguga

SEQ ID NO: 782 - RNA, 1002 nt, Artificial Sequence
  derived and/or modified sequence opt5 from CD1C__Homo_sapiens__AAI26466
augcuguuccuccaguuucugcuucuggcccuccugcuucccggcggggacaacgcugaugccagccaagagcacguguccuuccaugucauccagaucuuuucuuucguuaaucagagcugggcgagaggacagggcuccggguggcuggacgaacuccaaacccacggaugggauucugagagcggcacaauuauuuuucugcauaacugguccaaggggaauuucucuaacgaggaacugagcgaccucgaacugcuuuuucgguucuaccuguuuggacucacgcgcgagauccaggaucacgcuucccaggacuauagcaaauacccuuucgagguccaggugaaggccggcugcgaacugcauucuggcaaauccccggagggguuuuuccaaguggccuuuaauggacuugaucugcucagcuuccagaacaccacaugggugcccucuccuggcugugggucccuggcucagagcguuugccaucugcucaaucaccaguaugaaggagugaccgagacagucuacaaccugauuagaucuaccuguccccgguuccuucugggccuccuggacgccgggaagauguaugugcaccgccaaguuagaccugaggcuuggcuuuccagccggcccucccugggaucuggccagcuccugcuggugugccacgccagcggcuuuuacccuaaaccggucugggugacauggaugcgcaaugaacaggagcaacucgggaccaagcauggagauauccugcccaacgcggacggcacgugguaucuucaggugauccuggaagucgccuccgaggaaccugcugggcucagcuguagaguucggcacucuucccugggaggccaggauauuauccuuuacugggggcaccauuucagcaugaauuggauugcccugguggugaucgucccccucgugauucugaucguucuggugcucugguuuaagaaacacugcucuuaccaggacauucuguga

SEQ ID NO: 783 - protein, 335 aa, Artificial Sequence
  CD1D__Homo_sapiens__P15813
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 784 - RNA, 1008 nt, Artificial Sequence
  CD1D__Homo_sapiens__AAA59672
auggggugccugcuguuucugcugcucugggcgcuccuccaggcuuggggaagcgcugaagucccgcaaaggcuuuucccccuccgcugccuccagaucucguccuucgccaauagcagcuggacgcgcaccgacggcuuggcguggcugggggagcugcagacgcacagcuggagcaacgacucggacaccguccgcucucugaagccuuggucccagggcacguucagcgaccagcagugggagacgcugcagcauauauuucggguuuaucgaagcagcuucaccagggacgugaaggaauucgccaaaaugcuacgcuuauccuaucccuuggagcuccagguguccgcuggcugugaggugcacccugggaacgccucaaauaacuucuuccauguagcauuucaaggaaaagauauccugaguuuccaaggaacuucuugggagccaacccaagaggccccacuuuggguaaacuuggccauucaagugcucaaccaggacaaguggacgagggaaacagugcaguggcuccuuaauggcaccugcccccaauuugucaguggccuccuugagucagggaagucggaacugaagaagcaagugaagcccaaggccuggcugucccguggccccaguccuggcccuggccgucugcugcuggugugccaugucucaggauucuacccaaagccuguaugggugaaguggaugcggggugagcaggagcagcagggcacucagccaggggacauccugcccaaugcugacgagacaugguaucuccgagcaacccuggaugugguggcuggggaggcagcuggccuguccugucgggugaagcacagcagucuagagggccaggacaucguccucuacuggggugggagcuacaccuccaugggcuugauugccuuggcaguccuggcgugcuugcuguuccuccucauugugggcuuuaccucccgguuuaagaggcaaacuuccuaucagggcguccuguga

SEQ ID NO: 785 - RNA, 1008 nt, Artificial Sequence
  derived and/or modified sequence opt1 from CD1D__Homo_sapiens__AAA59672
augggcugccuccuguuccugcugcucugggcccugcugcaggccugggggagcgcggaggugccccagcgccucuucccgcugcggugccugcagaucuccagcuucgccaacuccagcuggacccgcaccgacggccucgccuggcugggggagcugcagacgcacuccuggagcaacgacuccgacaccguccggagccucaagcccuggucccagggcaccuucagcgaccagcagugggagacccugcagcacaucuuccgcguguaccgguccagcuucacgcgcgacgugaaggaguucgccaagaugcugcggcucuccuacccccuggagcugcaggucagcgccgggugcgaggugcaccccggcaacgcguccaacaacuucuuccacguggccuuccagggcaaggacauccucagcuuccaggggaccuccugggagccgacccaggaggcgccccugugggucaaccuggccauccaggugcucaaccaggacaaguggacccgcgagacggugcaguggcugcugaacgggaccugcccccaguucgucagcgggcuccuggaguccggcaagagcgagcugaagaagcaggucaagcccaaggccuggcucagccgggggccgucccccggccccggccgccugcugcucgugugccacgugagcggguucuaccccaagccggugugggugaaguggaugcggggcgagcaggagcagcaggggacccagcccggcgacauccugcccaacgccgacgagaccugguaccugcgcgccacgcucgacgucguggccggcgaggccgcggggcuguccugccgggugaagcacagcucccuggagggccaggacaucguccucuacuggggcggcagcuacaccuccauggggcugaucgcccuggccgugcucgccugccugcuguuccuccugaucgugggcuucaccagccgcuucaagcggcagaccuccuaccagggcguccuguga

SEQ ID NO: 786 - RNA, 1008 nt, Artificial Sequence
  derived and/or modified sequence opt2 from CD1D__Homo_sapiens__AAA59672
augggcugccuccucuuccuccuccucugggcccuccuccaggccuggggcuccgccgaggucccccagcgccucuucccccuccgcugccuccagaucuccuccuucgccaacuccuccuggacccgcaccgacggccucgccuggcucggcgagcuccagacccacuccugguccaacgacuccgacaccguccgcucccucaagcccuggucccagggcaccuucuccgaccagcagugggagacccuccagcacaucuuccgcgucuaccgcuccuccuucacccgcgacgucaaggaguucgccaagaugcuccgccucuccuacccccucgagcuccaggucuccgccggcugcgagguccaccccggcaacgccuccaacaacuucuuccacgucgccuuccagggcaaggacauccucuccuuccagggcaccuccugggagcccacccaggaggccccccucugggucaaccucgccauccagguccucaaccaggacaaguggacccgcgagaccguccaguggcuccucaacggcaccugcccccaguucgucuccggccuccucgaguccggcaaguccgagcucaagaagcaggucaagcccaaggccuggcucucccgcggccccucccccggccccggccgccuccuccucgucugccacgucuccggcuucuaccccaagcccgucugggucaaguggaugcgcggcgagcaggagcagcagggcacccagcccggcgacauccuccccaacgccgacgagaccugguaccuccgcgccacccucgacgucgucgccggcgaggccgccggccucuccugccgcgucaagcacuccucccucgagggccaggacaucguccucuacuggggcggcuccuacaccuccaugggccucaucgcccucgccguccucgccugccuccucuuccuccucaucgucggcuucaccucccgcuucaagcgccagaccuccuaccagggcguccucuga

SEQ ID NO: 787 - RNA, 1008 nt, Artificial Sequence
  derived and/or modified sequence opt3 from CD1D__Homo_sapiens__AAA59672
augggcugccuccuguuccuucuguugugggccuuacugcaggcuugggggagcgcagaggugccccaaagacuauuuccucucaggugucugcagaucuccucuuucgccaacucaaguuggacccggacagacggacuugcguggcugggugaauugcagacucacagcugguccaaugauucugacacgguccgcucgcucaagccauggucacagggcaccuuuagcgaucaacagugggagacacugcagcauauuuuccgaguuuaccguaguuccuuuacuagagacgugaaagaguucgcuaagaugcugaggcucucuuauccguuagaacugcagguaagcgccgggugcgaagugcaccccggaaacgcauccaauaacuuuuuccaugucgccuuucaaggcaaagauauacuuucauuccaggguaccaguugggagccuacacaggaggcuccauugugggugaaucuggcaauccagguucuaaaccaagacaaguggacccgggaaacugugcaguggcuccugaaugggacauguccccaguuugucagcggacuucuggagucuggcaaauccgaauugaagaagcaagugaaaccuaaggccuggcucucacgcggcccaagccccgggccuggaagacuguuacugguaugccacguuagugguuucuacccaaaaccggugugggucaaguggaugaggggcgagcaggagcagcaggggacccaacccggagauauucucccuaacgcugacgaaacgugguaucuucgggccacucuggaugugguggcgggcgaggcagccgguuugucuugucgcgucaaacauuccagccuagaagggcaggacaucguucuguacuggggaggcucguauaccucuaugggccucauugcucuggccgugcuugcaugccuguuguuucuccugaucguaggguucacaucccgauucaagagacagacuucauaccagggaguguuauga

SEQ ID NO: 788 - RNA, 1008 nt, Artificial Sequence
  derived and/or modified sequence opt4 from CD1D__Homo_sapiens__AAA59672
augggcugccugcuguuccugcugcugugggcccugcugcaggccuggggcagcgccgaggugccccagagacuguucccccugagaugccugcagaucagcagcuucgccaacagcagcuggaccagaaccgacggccuggccuggcugggcgagcugcagacccacagcuggagcaacgacagcgacaccgugagaagccugaagcccuggagccagggcaccuucagcgaccagcagugggagacccugcagcacaucuucagaguguacagaagcagcuucaccagagacgugaaggaguucgccaagaugcugagacugagcuacccccuggagcugcaggugagcgccggcugcgaggugcaccccggcaacgccagcaacaacuucuuccacguggccuuccagggcaaggacauccugagcuuccagggcaccagcugggagcccacccaggaggccccccugugggugaaccuggccauccaggugcugaaccaggacaaguggaccagagagaccgugcaguggcugcugaacggcaccugcccccaguucgugagcggccugcuggagagcggcaagagcgagcugaagaagcaggugaagcccaaggccuggcugagcagaggccccagccccggccccggcagacugcugcuggugugccacgugagcggcuucuaccccaagcccgugugggugaaguggaugagaggcgagcaggagcagcagggcacccagcccggcgacauccugcccaacgccgacgagaccugguaccugagagccacccuggacgugguggccggcgaggccgccggccugagcugcagagugaagcacagcagccuggagggccaggacaucgugcuguacuggggcggcagcuacaccagcaugggccugaucgcccuggccgugcuggccugccugcuguuccugcugaucgugggcuucaccagcagauucaagagacagaccagcuaccagggcgugcuguga

SEQ ID NO: 789 - RNA, 1008 nt, Artificial Sequence
  derived and/or modified sequence opt5 from CD1D__Homo_sapiens__AAA59672
augggcugccuccuguuccugcuucugugggcccuccugcaggcuugggggagcgccgaggugccccaaagacuuuuuccucugcggugucuccagaucuccucuuucgcgaacagcuccuggacccgcacagacggacuggcuuggcugggcgaacuccagacgcacucuuggagcaaugauuccgacaccgucagaucucugaagccguggagccaggggacauuuuccgaucaacagugggagacccuucagcauauuuuccggguuuaccgcagcucuuuuacaagagacgugaaagaguucgccaagaugcugcggcucuccuauccccuggaacuucaggugagcgccggaugcgaaguccacccuggcaacgcuucuaauaacuuuuuccauguggccuuucaagggaaagauauccuguccuuccagggaaccagcugggagcccacacaggaggcuccucucuggguuaaucuggccauucaggugcugaaccaagacaaguggacccgcgaaacgguccaguggcuccugaauggcaccuguccccaguuugugucuggccuucuggaguccgggaaaagcgaacucaagaagcaaguuaaaccuaaggcguggcuguccagaggaccgucucccggcccugggcggcuucugcucgugugccacgucagcggauucuaccccaaaccugugugggugaaguggaugcgcggcgagcaggagcagcaggggacacaacccggagauauccugccgaacgccgacgaaaccugguaucugagagcuacacucgaugucguugccggcgaggcugccggccuguccugucgggugaaacauagcucucuugaagggcaggacauugugcuguacuggggaggcuccuauaccagcauggggcucaucgcgcuggccguccuugcuugccugcucuuucugcugaucgugggauucacgucucgcuucaagagacagacaagcuaccagggcguucucuga

SEQ ID NO: 790 - protein, 388 aa, Artificial Sequence
  CD1E__Homo_sapiens__P15812
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 791 - RNA, 1167 nt, Artificial Sequence
  CD1E__Homo_sapiens__EAW52830
augcugcuccuguuccuccucuucgagggucucugcuguccuggggaaaauacagcagcuccccaggcucuacaauccuaucaucuagcagcagaggagcagcuguccuuccgcaugcuccaaacuuccuccuuugccaaccacagcugggcacacagugagggcucaggauggcugggugaccugcagacucauggcugggacacugucuugggcaccauccgcuuucugaagcccuggucccauggaaacuucagcaagcaggagcugaaaaacuuacagucacuguuccaguuauacuuccauaguuuuauccagauagugcaagcuucugcuggucaauuucagcuugaauaccccuucgagauccagauauuagcuggcuguagaaugaaugccccacaaaucuucuuaaauauggcauaucaagggucagauuuccugaguuuccaaggaauuuccugggagccaucuccaggagcagggauccgggcccagaacaucuguaaagugcucaaucgcuaccuagauauuaaggaaauacugcaaagccuucuuggucacaccugcccucgauuucuagcggggcucauggaagcaggggagucagaacugaaacggaaagugaagccagaggccuggcuguccuguggccccaguccuggcccuggccgucugcagcuugugugccaugucucaggauucuacccaaagcccgugugggugauguggaugcggggugagcaggagcagcggggcacucagcgaggggacguccugccuaaugcugacgagacaugguaucuccgagcaacccuggauguggcggcuggggaggcagcuggccuguccugucgggugaaacacagcagucuagggggccaugaucuaaucauccauugggguggauauuccaucuuucucauccugaucuguuugacugugauaguuacccuggucauauugguuguaguugacucacgguuaaaaaaacagaguucaaauaagaacauucuuucuccccacacacccagcccugucuuucucaugggagccaacacucaggacaccaagaauucaagacaucaguucugcuuggcacaaguaucguggaucaaaaacagaguauugaagaaguggaagacacgccuaaaccaacucugguga

SEQ ID NO: 792 - RNA, 1167 nt, Artificial Sequence
  derived and/or modified sequence opt1 from CD1E__Homo_sapiens__EAW52830
augcugcuccuguuccuccuguucgagggccugugcugccccggggagaacaccgccgccccgcaggcgcugcagagcuaccaccucgccgccgaggagcagcuguccuuccgcaugcugcagaccagcuccuucgccaaccacagcugggcccacuccgagggcagcggguggcucggcgaccugcagacgcacgggugggacaccgugcugggcaccauccgguuccucaagcccuggucccacggcaacuucagcaagcaggagcugaagaaccugcagucccucuuccagcuguacuuccacagcuucauccagaucguccaggcguccgccgggcaguuccagcuggaguaccccuucgagauccagauccucgccggcugccgcaugaacgcgccccagaucuuccugaacauggccuaccaggggagcgacuuccuguccuuccagggcaucagcugggagccgucccccggggccggcauccgggcccagaacaucugcaaggugcucaaccgcuaccuggacaucaaggagauccugcagagccuccugggccacacgugcccccgguuccuggccgggcucauggaggccggcgaguccgagcugaagcgcaaggugaagcccgaggcguggcugagcugcgggccgucccccggccccggccggcuccagcuggucugccacgugagcggguucuaccccaagccggugugggucauguggaugcgcggcgagcaggagcagcgggggacccagcgcggcgacgugcugcccaacgccgacgagaccugguaccuccgggccacccuggacguggccgccggggaggcggccggccugagcugccgcgucaagcacuccagccucggcgggcacgaccugaucauccacuggggcggguacuccaucuuccugauccucaucugccugaccgugaucgugacgcuggucauccucgugguggucgacagccggcugaagaagcaguccagcaacaagaacauccugagcccccacacccccuccccgguguuccucaugggcgccaacacccaggacaccaagaacucccgccaccaguucugccuggcccaggugagcuggaucaagaaccggguccugaagaaguggaagacgcgccucaaccagcugugguga

SEQ ID NO: 793 - RNA, 1167 nt, Artificial Sequence
  derived and/or modified sequence opt2 from CD1E__Homo_sapiens__EAW52830
augcuccuccucuuccuccucuucgagggccucugcugccccggcgagaacaccgccgccccccaggcccuccaguccuaccaccucgccgccgaggagcagcucuccuuccgcaugcuccagaccuccuccuucgccaaccacuccugggcccacuccgagggcuccggcuggcucggcgaccuccagacccacggcugggacaccguccucggcaccauccgcuuccucaagcccuggucccacggcaacuucuccaagcaggagcucaagaaccuccagucccucuuccagcucuacuuccacuccuucauccagaucguccaggccuccgccggccaguuccagcucgaguaccccuucgagauccagauccucgccggcugccgcaugaacgccccccagaucuuccucaacauggccuaccagggcuccgacuuccucuccuuccagggcaucuccugggagcccucccccggcgccggcauccgcgcccagaacaucugcaagguccucaaccgcuaccucgacaucaaggagauccuccagucccuccucggccacaccugcccccgcuuccucgccggccucauggaggccggcgaguccgagcucaagcgcaaggucaagcccgaggccuggcucuccugcggccccucccccggccccggccgccuccagcucgucugccacgucuccggcuucuaccccaagcccgucugggucauguggaugcgcggcgagcaggagcagcgcggcacccagcgcggcgacguccuccccaacgccgacgagaccugguaccuccgcgccacccucgacgucgccgccggcgaggccgccggccucuccugccgcgucaagcacuccucccucggcggccacgaccucaucauccacuggggcggcuacuccaucuuccucauccucaucugccucaccgucaucgucacccucgucauccucgucgucgucgacucccgccucaagaagcaguccuccaacaagaacauccucuccccccacacccccucccccgucuuccucaugggcgccaacacccaggacaccaagaacucccgccaccaguucugccucgcccaggucuccuggaucaagaaccgcguccucaagaaguggaagacccgccucaaccagcucugguga

SEQ ID NO: 794 - RNA, 1167 nt, Artificial Sequence
  derived and/or modified sequence opt3 from CD1E__Homo_sapiens__EAW52830
augcugcuccuuuuccuguuguuugagggcuuaugcugucccggggaaaacaccgccgcuccucaggcacugcaaagcuaccaccuagccgcggaggaacagcucuccuucagaaugcugcagacaucuucauuugcuaaucauaguugggcccacagcgagggauccgguuggcuuggcgaccugcagacucaugggugggauacgguguugggaaccaucagguuccucaagccauggucucacggcaacuuuucgaaacaagaacugaagaaucugcagucacucuuccaguuauauuuucauagcuucauucagauaguccaagcaagugccggucaguuucagcuggaguacccguucgagauccagauucuugcugggugccggaugaacgcaccccaaaucuuuuugaauauggccuaucagggauccgacuuccugucuuuucagggcauuagcugggaaccuuccccaggcgcugggauccgcgcccaaaacauauguaaaguucuaaaucgauaccucgauaucaaggagauucugcagucacuucugggacacacaugcccccguuucuuggcgggucucauggaagcaggcgagagugagcugaaaagaaaggugaagccugaagccugguuaagcugugggccaucucccggaccuggcaggcugcagcucguaugccacguguccgguuucuauccaaaaccggucugggugauguggaugcgcggggagcaggaacaacggggaacucagagaggcgacguucuucccaacgcugaugagaccugguaccugagggccacauuggacguggcagcuggcgaagccgcggggcuaucaugucgggucaagcauagcagucugggaggucacgaucucaucauucauuggggcggguauucuaucuuucugauacuuauuugccugaccgugaucguaacuuugguuauucucguggucguggacucccgccugaaaaagcagagcucgaauaaaaacaucuuaucuccucacacaccaucccccguguuccugaugggagccaauacccaggauacgaagaacucacgacaccaauuuugucuagcacaggucaguuggaucaagaauagaguucucaaaaaguggaaaacuaggcugaaccagcuuugguga

SEQ ID NO: 795 - RNA, 1167 nt, Artificial Sequence
  derived and/or modified sequence opt4 from CD1E__Homo_sapiens__EAW52830
augcugcugcuguuccugcuguucgagggccugugcugccccggcgagaacaccgccgccccccaggcccugcagagcuaccaccuggccgccgaggagcagcugagcuucagaaugcugcagaccagcagcuucgccaaccacagcugggcccacagcgagggcagcggcuggcugggcgaccugcagacccacggcugggacaccgugcugggcaccaucagauuccugaagcccuggagccacggcaacuucagcaagcaggagcugaagaaccugcagagccuguuccagcuguacuuccacagcuucauccagaucgugcaggccagcgccggccaguuccagcuggaguaccccuucgagauccagauccuggccggcugcagaaugaacgccccccagaucuuccugaacauggccuaccagggcagcgacuuccugagcuuccagggcaucagcugggagcccagccccggcgccggcaucagagcccagaacaucugcaaggugcugaacagauaccuggacaucaaggagauccugcagagccugcugggccacaccugccccagauuccuggccggccugauggaggccggcgagagcgagcugaagagaaaggugaagcccgaggccuggcugagcugcggccccagccccggccccggcagacugcagcuggugugccacgugagcggcuucuaccccaagcccgugugggugauguggaugagaggcgagcaggagcagagaggcacccagagaggcgacgugcugcccaacgccgacgagaccugguaccugagagccacccuggacguggccgccggcgaggccgccggccugagcugcagagugaagcacagcagccugggcggccacgaccugaucauccacuggggcggcuacagcaucuuccugauccugaucugccugaccgugaucgugacccuggugauccugguggugguggacagcagacugaagaagcagagcagcaacaagaacauccugagcccccacacccccagccccguguuccugaugggcgccaacacccaggacaccaagaacagcagacaccaguucugccuggcccaggugagcuggaucaagaacagagugcugaagaaguggaagaccagacugaaccagcugugguga

SEQ ID NO: 796 - RNA, 1167 nt, Artificial Sequence
  derived and/or modified sequence opt5 from CD1E__Homo_sapiens__EAW52830
augcugcuccuguuccuucuguuugagggccucugcugucccggggaaaacaccgccgcuccucaggcccugcaaagcuaccaccuugcggcugaggaacagcuguccuucagaaugcuccagacaucuagcuuugccaaucauuccugggcccacucugagggaagcggcuggcugggggaccugcagacgcauggaugggauaccgugcucggcacaauccgguuccugaagccguggucccacgggaacuuuucuaaacaagaacuuaagaaucugcagagccucuuccagcuguauuuucauuccuucauucagaucguccaagcuagcgccggacaguuucagcuugaguaccccuucgagauucagauccuggcuggcugccgcaugaacgccccucaaauuuuucucaauauggcguaucagggcucugacuuccuguccuuucaggggaucagcugggaacccucuccuggagccggcaucagagcucaaaacauuuguaaaguucugaaucgguaccucgauaucaaggagauucugcagucccuucuggggcauaccugcccccgcuuccucgccggacugauggaagcuggcgagagcgagcuuaaaagaaaggugaagccugaagccuggcugucuugugggccgucccccggaccuggccggcuccagcuggugugccacgucagcggcuucuaucccaaaccuguguggguuauguggaugcgcggggagcaggaacaaagaggaacacagcggggcgacgugcugcccaacgcggaugagaccugguaccuccgcgccacacuggacgucgcugccggggaagcugccggacuuuccuguagagugaagcacucuagccugggcgggcacgaucucaucauucauuggggaggcuauuccaucuuucugauucuuaucugccugaccguuaucgugacgcucgucauucuggugguggucgacagccggcugaaaaagcagucuuccaauaaaaacauccucagcccgcacaccccuucucccguuuuccugaugggcgccaauacacaggauaccaagaacagccgccaccaauuuugucuugcucagguguccuggauuaagaauagagugcugaaaaaguggaaaacacggcucaaccagcugugguga

SEQ ID NO: 797 - protein, 297 aa, Artificial Sequence
  CD20__Homo_sapiens__P11836
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 798 - RNA, 894 nt, Artificial Sequence
  CD20__Homo_sapiens__AAA35581
augacaacacccagaaauucaguaaaugggacuuucccggcagagccaaugaaaggcccuauugcuaugcaaucugguccaaaaccacucuucaggaggaugucuucacuggugggccccacgcaaagcuucuucaugagggaaucuaagacuuugggggcuguccagauuaugaaugggcucuuccacauugcccuggggggucuucugaugaucccagcagggaucuaugcacccaucugugugacugugugguacccucucuggggaggcauuauguauauuauuuccggaucacucuuggcagcaacggagaaaaacucuaggaaguguuuggucaaaggaaaaaugauaaugaauucauugagccucuuugcugccauuucuggaaugauucuuucaaucauggacauacuuaauauuaaaauuucccauuuuuuaaaaauggagagucugaauuuuauuagagcucacacaccauauauuaacauauacaacugugaaccagcuaaucccucugagaaaaacuccccaucuacccaauacuguuacagcauacaaucucuguucuugggcauuuugucagugaugcugaucuuugccuucuuccaggaacuuguaauagcuggcaucguugagaaugaauggaaaagaacgugcuccagacccaaaucuaacauaguucuccugucagcagaagaaaaaaaagaacagacuauugaaauaaaagaagaagugguugggcuaacugaaacaucuucccaaccaaagaaugaagaagacauugaaauuauuccaauccaagaagaggaagaagaagaaacagagacgaacuuuccagaaccuccccaagaucaggaauccucaccaauagaaaaugacagcucuccuuaa

SEQ ID NO: 799 - RNA, 894 nt, Artificial Sequence
  derived and/or modified sequence opt1 from CD20__Homo_sapiens__AAA35581
augaccacgccccgcaacagcgugaacggcaccuucccggccgagcccaugaaggggcccaucgccaugcaguccggccccaagccgcuguuccggcgcaugagcucccucgucgggcccacccagagcuucuucaugcgggaguccaagacccugggcgcggugcagaucaugaacgggcuguuccacaucgcccucggcggccugcugaugauccccgccgggaucuacgcccccaucugcgugaccgucugguacccgcucuggggcgggaucauguacaucaucagcggcucccugcuggccgcgacggagaagaacagccgcaagugccucgugaaggggaagaugaucaugaacucccugagccuguucgccgccaucuccggcaugauccucagcaucauggacauccugaacaucaagaucucccacuuccugaagauggagagccucaacuucauccgggcccacacccccuacaucaacaucuacaacugcgagcccgcgaaccccuccgagaagaacagcccguccacccaguacugcuacagcauccagucccuguuccugggcauccucagcgugaugcugaucuucgccuucuuccaggagcuggucaucgccgggaucguggagaacgaguggaagcggaccugcagccgccccaaguccaacaucgugcuccugagcgccgaggagaagaaggagcagacgaucgagaucaaggaggaggucgugggccugaccgagaccuccagccagcccaagaacgaggaggacaucgagaucauccccauccaggaggaggaggaggaggagaccgagacgaacuucccggagccgccccaggaccaggaguccagccccaucgagaacgacuccagccccuga

SEQ ID NO: 800 - RNA, 894 nt, Artificial Sequence
  derived and/or modified sequence opt2 from CD20__Homo_sapiens__AAA35581
augaccaccccccgcaacuccgucaacggcaccuuccccgccgagcccaugaagggccccaucgccaugcaguccggccccaagccccucuuccgccgcauguccucccucgucggccccacccaguccuucuucaugcgcgaguccaagacccucggcgccguccagaucaugaacggccucuuccacaucgcccucggcggccuccucaugauccccgccggcaucuacgcccccaucugcgucaccgucugguacccccucuggggcggcaucauguacaucaucuccggcucccuccucgccgccaccgagaagaacucccgcaagugccucgucaagggcaagaugaucaugaacucccucucccucuucgccgccaucuccggcaugauccucuccaucauggacauccucaacaucaagaucucccacuuccucaagauggagucccucaacuucauccgcgcccacacccccuacaucaacaucuacaacugcgagcccgccaaccccuccgagaagaacucccccuccacccaguacugcuacuccauccagucccucuuccucggcauccucuccgucaugcucaucuucgccuucuuccaggagcucgucaucgccggcaucgucgagaacgaguggaagcgcaccugcucccgccccaaguccaacaucguccuccucuccgccgaggagaagaaggagcagaccaucgagaucaaggaggaggucgucggccucaccgagaccuccucccagcccaagaacgaggaggacaucgagaucauccccauccaggaggaggaggaggaggagaccgagaccaacuuccccgagcccccccaggaccaggaguccucccccaucgagaacgacuccucccccuga

SEQ ID NO: 801 - RNA, 894 nt, Artificial Sequence
  derived and/or modified sequence opt3 from CD20__Homo_sapiens__AAA35581
augaccacacccagaaacagcgugaauggcacuuucccugccgagccaaugaaggggccgaucgcuaugcaguccggacccaaaccucuguuuaggcggaugucuucacucgucgguccaacgcaaaguuucuuuaugcgcgaaagcaagacccuuggcgcaguucagauuaugaacgggcuguuccacauagccuugggaggcuuacugaugauccccgcggguauuuacgcuccuaucugcgugacaguaugguauccacuauggggaggaauuauguacaucauauccggcucucuccuggccgcaacugagaaaaauucgcgaaagugucuugugaaaggcaagaugaucaugaacucacugagcuuguuugccgcuauuagugggaugauccucuccauuauggacauccugaauauaaagauuucucauuuccugaaaauggaaagccucaacuuuauccgugcacacacccccuauauuaauaucuacaacugcgagccugccaauccauccgaaaagaacucaccgaguacacaguauuguuacagcauccagucuuuauuccuggggauucuuuccgucauguugauauuugcuuucuuucaagagcuggugaucgccgguauuguugagaaugaauggaaaagaaccugcucaaggcccaagagcaacaucgugcuacucagugcggaggagaaaaaggaacagacuauagagauuaaggaagaggucgugggccugacagaaaccucuucccagccuaaaaaugaggaagauaucgagaucauuccaauccaggaggaagaggaagaggaaacggagacuaacuuccccgagccuccacaagaccaggaaagcucgcccauugagaaugauucuuccccguga

SEQ ID NO: 802 - RNA, 894 nt, Artificial Sequence
  derived and/or modified sequence opt4 from CD20__Homo_sapiens__AAA35581
augaccacccccagaaacagcgugaacggcaccuuccccgccgagcccaugaagggccccaucgccaugcagagcggccccaagccccuguucagaagaaugagcagccuggugggccccacccagagcuucuucaugagagagagcaagacccugggcgccgugcagaucaugaacggccuguuccacaucgcccugggcggccugcugaugauccccgccggcaucuacgcccccaucugcgugaccgugugguacccccuguggggcggcaucauguacaucaucagcggcagccugcuggccgccaccgagaagaacagcagaaagugccuggugaagggcaagaugaucaugaacagccugagccuguucgccgccaucagcggcaugauccugagcaucauggacauccugaacaucaagaucagccacuuccugaagauggagagccugaacuucaucagagcccacacccccuacaucaacaucuacaacugcgagcccgccaaccccagcgagaagaacagccccagcacccaguacugcuacagcauccagagccuguuccugggcauccugagcgugaugcugaucuucgccuucuuccaggagcuggugaucgccggcaucguggagaacgaguggaagagaaccugcagcagacccaagagcaacaucgugcugcugagcgccgaggagaagaaggagcagaccaucgagaucaaggaggagguggugggccugaccgagaccagcagccagcccaagaacgaggaggacaucgagaucauccccauccaggaggaggaggaggaggagaccgagaccaacuuccccgagcccccccaggaccaggagagcagccccaucgagaacgacagcagccccuga

SEQ ID NO: 803 - RNA, 894 nt, Artificial Sequence
  derived and/or modified sequence opt5 from CD20__Homo_sapiens__AAA35581
augaccacacccagaaacagcgugaauggcacguucccugccgagccgaugaaggggcccaucgcuaugcaguccggaccuaaaccccuguuucggcgcaugucuagccucgucggcccuacccaauccuucuuuaugagagaaucuaagacacugggggccguucagauuaugaacggacuuuuccacaucgcgcugggcgggcuccugaugauucccgcuggaaucuacgccccuauuugcgugaccgugugguauccgcuuuggggcggcaucauguacaucauuagcgggucccugcucgccgcuacagagaaaaauucucggaagugucuggucaaaggaaagaugaucaugaacagccugucccucuuugccgcuauuagcggcaugauccugucuauuauggacauccuuaauauuaagaucucccauuuccugaaaauggaaagccucaacuuuauccgcgcccacacccccuauauuaauaucuacaacugcgagccugcgaaucccucugaaaagaacuccccuagcacacaguauuguuacucuauucagucccuguuccuugggauccugagcgugaugcucauuuuugccuucuuucaagagcugguuaucgcuggaaucguggagaaugaauggaaaagaaccugcucccggcccaagucuaacauuguccugcucagcgccgaggagaaaaaggaacagacgaucgagauuaaggaagaggugguuggccugaccgaaacauccagccagccgaaaaaugaggaagauaucgagauuaucccuauccaggaggaagaggaagaggaaaccgagacaaacuuccccgagccuccccaagaccaggaaucuucccccauugagaaugauagcucuccuuga

SEQ ID NO: 804 - protein, 662 aa, Artificial Sequence [sequence omitted]

SEQ ID NO: 805 - RNA, 1989 nt, Artificial Sequence
  CD22__Homo_sapiens__AAC18956
auggaguccaagacugagaaauggauggaacgaauacaccucaaugucucugaaaggccuuuuccaccucauauccagcucccuccagaaauucaagagucccaggaagucacucugaccugcuugcugaauuucuccugcuauggguauccgauccaauugcaguggcuccuagaggggguuccaaugaggcaggcugcugucaccucgaccuccuugaccaucaagucugucuucacccggagcgagcucaaguucuccccacaguggagucaccaugggaagauugugaccugccagcuucaggaugcagaugggaaguuccucuccaaugacacggugcagcugaacgugaagcacaccccgaaguuggagaucaaggucacucccagugaugccauagugagggagggggacucugugaccaugaccugcgaggucagcagcacgaacccggaguacacgacgguauccuggcucaaggaugggaccucgcugaagaagcagaauacauucacgcuaaaccugcgcgaagugaccaaggaccagagugggaaguacugcugucaggucuccaaugacgugggcccgggaaggucggaagaaguguuccugcaagugcaguaugccccggaaccuuccacgguucagauccuccacucaccggcuguggagggaagucaagucgaguuucuuugcaugucacuggccaauccucuuccaacaaauuacacgugguaccacaaugggaaagaaaugcagggaaggacagaggagaaaguccacaucccaaagauccuccccuggcacgcugggacuuauuccuguguggcagaaaacauucuugguacuggacagaggggcccgggagcugagcuggauguccaguauccucccaagaaggugaccacagugauucaaaaccccaugccgauucgagaaggagacacagugacccuuuccuguaacuacaauuccaguaaccccaguguuacccgguaugaauggaaaccccauggcgccugggaggagccaucgcuuggggugcugaagauccaaaagguuggcugggacaacacaaccaucgccugcgcacguuguaauaguuggugcucgugggccuccccugucgcccugaauguccaguaugccccccgagacgugaggguccggaaaaucaagccccuuuccgagauucacucuggaaacucggucagccuccaaugugacuucucaagcagccaccccaaagaaguccaguucuucugggagaaaaauggcaggcuucuggggaaagaaagccagcugaauuuugacuccaucuccccagaagaugcugggaguuacagcugcugggugaacaacuccauaggacagacagcguccaaggccuggacacuugaagugcuguaugcacccaggaggcugcguguguccaugagcccgggggaccaagugauggaggggaagagugcaacccugaggugugagagcgacgccaacccucccgucucccacuacaccugguuugacuggaauaaccaaagccuccccuaccacagccagaagcugagauuggagccggugaagguccagcacucgggugccuacuggugccaggggaccaacagugugggcaagggccguucgccucucagcacccucaccgucuacuauagcccggagaccaucggcaggcgaguggcugugggacucggguccugccucgccauccucauccuggcaaucugugggcucaagcuccagcgacgagaugcagaguccucagagaugcagagaccuccccggaccugcgaugacacggucacuuauucagcauugcacaagcgccaagugggcgacuaugagaacgucauuccagauuuuccagaagaugaggggauucauuacucagagcugauccaguuuggggucggggagcggccucaggcacaagaaaauguggacuaugugauccucaaacauuga

SEQ ID NO: 806 - RNA, 1989 nt, Artificial Sequence
  derived and/or modified sequence opt1 from CD22__Homo_sapiens__AAC18956
auggagagcaagaccgagaaguggauggagcgcauccaccugaacguguccgagcggcccuucccgccccacauccagcucccgcccgagauccaggagagccaggaggucacccugacgugccugcucaacuucuccugcuacggcuaccccauccagcugcaguggcugcucgagggggugcccaugcgccaggccgccgugaccagcaccucccugaccaucaagagcgucuucacgcgguccgagcugaaguucagcccccaguggucccaccacggcaagaucgugaccugccagcuccaggacgcggacgggaaguuccugagcaacgacaccgugcagcugaacgucaagcacacccccaagcucgagaucaaggugacgccguccgacgccaucgugcgcgagggcgacagcgucaccaugaccugcgagguguccagcaccaaccccgaguacacgaccguguccuggcugaaggacgggaccagccugaagaagcagaacaccuucacgcucaaccugcgggaggucaccaaggaccaguccggcaaguacugcugccaggugagcaacgacgugggccccgggcgcuccgaggaggucuuccuccaggugcaguacgcccccgagccgagcaccgugcagauccugcacagccccgccgucgagggcucccagguggaguuccugugcaugagccuggccaacccccuccccaccaacuacacgugguaccacaacgggaaggagaugcagggccggaccgaggagaaggugcacaucccgaagauccugcccuggcacgcggggaccuacuccugcgucgccgagaacauccugggcaccggccagcgcgggcccggcgccgagcucgacgugcaguacccgcccaagaaggugacgaccgucauccagaaccccaugcccauccgggagggggacaccgugacccugagcugcaacuacaacuccagcaaccccuccgucacgcgcuacgaguggaagccgcacggcgccugggaggagcccagccugggcgugcucaagauccagaagguggggugggacaacaccaccaucgcgugcgcccggugcaacuccuggugcagcugggccucccccgucgcccugaacgugcaguacgcgccccgcgacgugcggguccgcaagaucaagccgcugagcgagauccacuccggcaacagcgugucccuccagugcgacuucagcuccagccaccccaaggaggugcaguucuucugggagaagaacgggcggcugcugggcaaggagucccagcucaacuucgacagcaucagccccgaggacgccggguccuacagcugcugggucaacaacuccaucggccagaccgccagcaaggccuggacgcuggaggugcuguacgccccgcgccggcuccgcguguccaugagccccggcgaccaggucauggaggggaaguccgccacccugcggugcgagagcgacgcgaacccgcccgugucccacuacaccugguucgacuggaacaaccagagccugcccuaccacucccagaagcuccgccuggagcccgugaagguccagcacagcggcgccuacuggugccaggggaccaacuccgugggcaaggggcggagcccccuguccacgcucaccguguacuacagccccgagaccaucggccgccgcgucgccgugggccugggguccugccuggccauccucauccuggccaucugcggccugaagcuccagcggcgcgacgcggagagcagcgagaugcagcggccgccccggaccugcgacgacaccgugacguacuccgcccugcacaagcgccaggucggggacuacgagaacgugauccccgacuuccccgaggacgagggcauccacuacagcgagcugauccaguucggggugggcgagcgcccgcaggcccaggagaacgucgacuacgugauccugaagcacuga

SEQ ID NO: 807 - RNA, 1989 nt, Artificial Sequence
  derived and/or modified sequence opt2 from CD22__Homo_sapiens__AAC18956
auggaguccaagaccgagaaguggauggagcgcauccaccucaacgucuccgagcgccccuuccccccccacauccagcucccccccgagauccaggagucccaggaggucacccucaccugccuccucaacuucuccugcuacggcuaccccauccagcuccaguggcuccucgagggcguccccaugcgccaggccgccgucaccuccaccucccucaccaucaaguccgucuucacccgcuccgagcucaaguucuccccccaguggucccaccacggcaagaucgucaccugccagcuccaggacgccgacggcaaguuccucuccaacgacaccguccagcucaacgucaagcacacccccaagcucgagaucaaggucacccccuccgacgccaucguccgcgagggcgacuccgucaccaugaccugcgaggucuccuccaccaaccccgaguacaccaccgucuccuggcucaaggacggcaccucccucaagaagcagaacaccuucacccucaaccuccgcgaggucaccaaggaccaguccggcaaguacugcugccaggucuccaacgacgucggccccggccgcuccgaggaggucuuccuccagguccaguacgcccccgagcccuccaccguccagauccuccacucccccgccgucgagggcucccaggucgaguuccucugcaugucccucgccaacccccuccccaccaacuacaccugguaccacaacggcaaggagaugcagggccgcaccgaggagaagguccacauccccaagauccuccccuggcacgccggcaccuacuccugcgucgccgagaacauccucggcaccggccagcgcggccccggcgccgagcucgacguccaguacccccccaagaaggucaccaccgucauccagaaccccaugcccauccgcgagggcgacaccgucacccucuccugcaacuacaacuccuccaaccccuccgucacccgcuacgaguggaagccccacggcgccugggaggagcccucccucggcguccucaagauccagaaggucggcugggacaacaccaccaucgccugcgcccgcugcaacuccuggugcuccugggccucccccgucgcccucaacguccaguacgccccccgcgacguccgcguccgcaagaucaagccccucuccgagauccacuccggcaacuccgucucccuccagugcgacuucuccuccucccaccccaaggagguccaguucuucugggagaagaacggccgccuccucggcaaggagucccagcucaacuucgacuccaucucccccgaggacgccggcuccuacuccugcugggucaacaacuccaucggccagaccgccuccaaggccuggacccucgagguccucuacgccccccgccgccuccgcgucuccaugucccccggcgaccaggucauggagggcaaguccgccacccuccgcugcgaguccgacgccaacccccccgucucccacuacaccugguucgacuggaacaaccagucccuccccuaccacucccagaagcuccgccucgagcccgucaagguccagcacuccggcgccuacuggugccagggcaccaacuccgucggcaagggccgcuccccccucuccacccucaccgucuacuacucccccgagaccaucggccgccgcgucgccgucggccucggcuccugccucgccauccucauccucgccaucugcggccucaagcuccagcgccgcgacgccgaguccuccgagaugcagcgccccccccgcaccugcgacgacaccgucaccuacuccgcccuccacaagcgccaggucggcgacuacgagaacgucauccccgacuuccccgaggacgagggcauccacuacuccgagcucauccaguucggcgucggcgagcgcccccaggcccaggagaacgucgacuacgucauccucaagcacuga

SEQ ID NO: 808 - RNA, 1989 nt, Artificial Sequence
  derived and/or modified sequence opt3 from CD22__Homo_sapiens__AAC18956
auggagagcaagaccgaaaaauggauggagagaauccaccugaacguguccgaaaggcccuucccuccacauauucagcucccgcccgagauacaagaaucucaggaggucacacuuacuugccuguugaauuuuucauguuacggcuauccuauccaguuacaguggcugcuagaggggguuccaaugcggcaagccgcugugacgaguaccagccucacaauuaaguccguauucacucgcucugaacugaaauuuucgccccaguggucacaccauggaaagaucgugaccugccagcuucaggacgcagaugguaaauuccugagcaacgacacaguccaauugaaugugaagcacaccccuaagcucgagauuaaaguuacuccaagugaugccaucgugcgagaaggcgacuccgucacaaugaccugugaggugucuagcacgaaccccgaguacacuaccguauccuggcugaaggaugggacaucacugaaaaagcagaauacuuuuacccucaacuuacgugaaguuacaaaagaccagaguggaaaguauugcugucaggugagcaaugaugucggcccugguagaucugaggaaguguuccugcaagugcaguacgcgccagagccguccaccguccagauacuucauucacccgcuguugaagggagccaaguggaguuuuugugcaugagucuggccaacccucuaccaacgaauuauacuugguaccacaacggaaaggagaugcagggcaggacagaagagaaaguacacauccccaagauucucccuuggcaugcaggcaccuauucuuguguggccgaaaauauccuggggacuggacagcgggguccaggcgcugagcuugacguccaguaucccccgaaaaaggugacaaccguuauucaaaacccuaugcccauccgcgaaggggauacggugacccuguccugcaauuacaacagcucgaauccaucugucacaagauacgaguggaaaccucacggagcaugggaggaacccuccuugggcgugcucaagauacagaaaguagguugggacaacacuaccauugccugugcuaggugcaacucaugguguaguugggccagcccaguugcgcugaaugugcaguacgcaccccgggauguccgcgugcgaaagaucaagccuuuauccgagauucauucugggaacagcgucucacugcagugcgacuucaguuccagccacccaaaagaagugcaauuuuucugggagaagaauggaagacuccuuggcaaagaaucucagcugaacuuugauucaaucaguccggaggacgccggcagcuauuccugcuggguuaauaacucuaucgggcagacagcuucgaaggccuggacuuuggaggugcuauacgcacccaggcggcugcguguaagcauguccccuggagaccaggucauggaagguaaaucagcuacccuccgcugugagagugaugccaauccacccgugucucacuauacaugguucgacuggaacaaucaaagccugccuuaccauucccagaaacuuagacuggaaccaguuaaggugcagcacucaggcgcguauuggugccaggggaccaacagcgucggaaagggcaggucucccuuguccacucucacgguguacuacaguccggagacaauuggucggcgaguagccguggggcugggcagcuguuuagcaauacugauccuagcuauuugcggacucaagcugcaacgcagagaugccgagucuuccgaaaugcagaggccuccacggaccugugacgauacuguuaccuauucagcccuucauaaacgccaggucggcgacuacgagaaugugauccccgauuuuccugaagacgaggggauacacuauagugaauugauucaauucggagugggugagagaccccaggcucaggagaacgucgauuacguuauccugaagcauuga

SEQ ID NO: 809 - RNA, 1989 nt, Artificial Sequence
  derived and/or modified sequence opt4 from CD22__Homo_sapiens__AAC18956
auggagagcaagaccgagaaguggauggagagaauccaccugaacgugagcgagagacccuuccccccccacauccagcugccccccgagauccaggagagccaggaggugacccugaccugccugcugaacuucagcugcuacggcuaccccauccagcugcaguggcugcuggagggcgugcccaugagacaggccgccgugaccagcaccagccugaccaucaagagcguguucaccagaagcgagcugaaguucagcccccaguggagccaccacggcaagaucgugaccugccagcugcaggacgccgacggcaaguuccugagcaacgacaccgugcagcugaacgugaagcacacccccaagcuggagaucaaggugacccccagcgacgccaucgugagagagggcgacagcgugaccaugaccugcgaggugagcagcaccaaccccgaguacaccaccgugagcuggcugaaggacggcaccagccugaagaagcagaacaccuucacccugaaccugagagaggugaccaaggaccagagcggcaaguacugcugccaggugagcaacgacgugggccccggcagaagcgaggagguguuccugcaggugcaguacgcccccgagcccagcaccgugcagauccugcacagccccgccguggagggcagccagguggaguuccugugcaugagccuggccaacccccugcccaccaacuacaccugguaccacaacggcaaggagaugcagggcagaaccgaggagaaggugcacauccccaagauccugcccuggcacgccggcaccuacagcugcguggccgagaacauccugggcaccggccagagaggccccggcgccgagcuggacgugcaguacccccccaagaaggugaccaccgugauccagaaccccaugcccaucagagagggcgacaccgugacccugagcugcaacuacaacagcagcaaccccagcgugaccagauacgaguggaagccccacggcgccugggaggagcccagccugggcgugcugaagauccagaaggugggcugggacaacaccaccaucgccugcgccagaugcaacagcuggugcagcugggccagccccguggcccugaacgugcaguacgcccccagagacgugagagugagaaagaucaagccccugagcgagauccacagcggcaacagcgugagccugcagugcgacuucagcagcagccaccccaaggaggugcaguucuucugggagaagaacggcagacugcugggcaaggagagccagcugaacuucgacagcaucagccccgaggacgccggcagcuacagcugcugggugaacaacagcaucggccagaccgccagcaaggccuggacccuggaggugcuguacgcccccagaagacugagagugagcaugagccccggcgaccaggugauggagggcaagagcgccacccugagaugcgagagcgacgccaacccccccgugagccacuacaccugguucgacuggaacaaccagagccugcccuaccacagccagaagcugagacuggagcccgugaaggugcagcacagcggcgccuacuggugccagggcaccaacagcgugggcaagggcagaagcccccugagcacccugaccguguacuacagccccgagaccaucggcagaagaguggccgugggccugggcagcugccuggccauccugauccuggccaucugcggccugaagcugcagagaagagacgccgagagcagcgagaugcagagaccccccagaaccugcgacgacaccgugaccuacagcgcccugcacaagagacaggugggcgacuacgagaacgugauccccgacuuccccgaggacgagggcauccacuacagcgagcugauccaguucggcgugggcgagagaccccaggcccaggagaacguggacuacgugauccugaagcacuga

SEQ ID NO: 810 - RNA, 1989 nt, Artificial Sequence
  derived and/or modified sequence opt5 from CD22__Homo_sapiens__AAC18956
auggagagcaagaccgaaaaauggauggagagaauccaccugaacguguccgaacggcccuucccuccgcauauucagcuucccccugagauccaagaaucucaggaggucacacugacgugccuucugaauuuuagcuguuacggcuaucccauucagcuccaguggcugcuugaggggguuccuaugcgccaagccgcugugaccuccacaucucugaccaucaagagcguguucacaagauccgaacucaaauuuucuccccaguggagccaccauggaaagauugugaccugccagcugcaggacgccgauggcaaauuccuguccaacgacacagugcaacucaauguuaagcacaccccuaagcuggagaucaaagugacgccgagcgaugcgaucguccgggaaggggacucugugaccaugacaugugagguuuccagcaccaaccccgaguacacaaccgugucuuggcuuaaggauggaacgucccugaaaaagcagaauacauuuacccucaaccugcgcgaagucacaaaagaccagagcggcaaguauugcugucaggugucuaaugauguggggccuggaagauccgaggaagucuuccuucaaguucaguacgcucccgagccuagcaccgugcagauucugcauucccccgccguggaaggcucucaagucgaguuucucugcaugagccuggccaacccgcugccuaccaauuauacaugguaccacaacggcaaggagaugcaggggcggacggaagagaaagugcacauccccaagauucucccuuggcaugcuggaaccuauuccuguguugccgaaaauauccugggcacagggcagcgcggacccggcgcugagcuugacgugcaguaucccccuaaaaaggucaccacagugauucaaaacccgaugcccaucagagaaggggauaccguuacgcugagcugcaauuacaacucuuccaauccuagcgugacacgguacgaguggaaaccccacggagccugggaggaaccuucucucggcguccugaagauucagaaagugggcugggacaacaccaccaucgcgugugcccgcugcaacagcugguguuccugggcuucucccgucgcccuuaaugugcaguacgcuccgagagauguucgggugcgcaagaucaagccucugagcgagauucauuccgggaacagcgucucucuccagugcgacuucuccagcucucaccccaaagaagugcaauuuuucugggagaagaauggaagacugcugggcaaagaaucccagcucaacuuugauagcaucuccccugaggacgccgggucuuauagcugcuggguuaauaacuccauuggacagacagcgucuaaggccuggacccuggaggugcuuuacgcuccccggcgccugagagucagcauguccccuggcgaccaggugauggaagggaaaagcgccacacuccggugugagucugaugcuaaucccccggugucccacuauacgugguucgacuggaacaaucaaagccugccuuaccauucucagaagcucagacuggaacccguuaagguccagcacuccggagccuauuggugccagggcaccaacagcgugggcaaagggcgcucuccccucagcacacugaccguguacuacuccccugagacaaucggacggagagucgccgugggccuggggagcugucucgcuauucugauccuugcgaucugcggacugaagcuccaacgccgggaugccgagucuuccgaaaugcagagaccgccccgcaccugugacgauacgguuaccuauagcgcucugcauaaacggcaggucggcgacuacgagaaugucauuccugauuuucccgaagacgaggggauccacuauuccgaacugauucaauucggcgugggagagagaccucaggcccaggagaacguugauuacgugauccuuaagcauuga

SEQ ID NO: 811 - protein, 847 aa, Artificial Sequence
  CD22__Homo_sapiens__P20273
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 812 - RNA, 2544 nt, Artificial Sequence
  CD22__Homo_sapiens__AAB06448
augcaucuccucggccccuggcuccugcuccugguucuagaauacuuggcuuucucugacucaaguaaauggguuuuugagcacccugaaacccucuacgccugggagggggccugcgucuggauccccugcaccuacagagcccuagauggugaccuggaaagcuucauccuguuccacaauccugaguauaacaagaacaccucgaaguuugaugggacaagacucuaugaaagcacaaaggaugggaagguuccuucugagcagaaaagggugcaauuccugggagacaagaauaagaacugcacacugaguauccacccggugcaccucaaugacaguggucagcuggggcugaggauggaguccaagacugagaaauggauggaacgaauacaccucaaugucucugaaaggccuuuuccaccucauauccagcucccuccagaaauucaagagucccaggaagucacucugaccugcuugcugaauuucuccugcuauggguauccgauccaauugcaguggcuccuagaggggguuccaaugaggcaggcugcugucaccucgaccuccuugaccaucaagucugucuucacccggagcgagcucaaguucuccccacaguggagucaccaugggaagauugugaccugccagcuucaggaugcagaugggaaguuccucuccaaugacacggugcagcugaacgugaagcacaccccgaaguuggagaucaaggucacucccagugaugccauagugagggagggggacucugugaccaugaccugcgaggucagcagcagcaacccggaguacacgacgguauccuggcucaaggaugggaccucgcugaagaagcagaauacauucacgcuaaaccugcgcgaagugaccaaggaccagagugggaaguacugcugucaggucuccaaugacgugggcccgggaaggucggaagaaguguuccugcaagugcaguaugccccggaaccuuccacgguucagauccuccacucaccggcuguggagggaagucaagucgaguuucuuugcaugucacuggccaauccucuuccaacaaauuacacgugguaccacaaugggaaagaaaugcagggaaggacagaggagaaaguccacaucccaaagauccuccccuggcacgcugggacuuauuccuguguggcagaaaacauucuugguacuggacagaggggcccgggagcugagcuggauguccaguauccucccaagaaggugaccacagugauucaaaaccccaugccgauucgagaaggagacacagugacccuuuccuguaacuacaauuccaguaaccccaguguuacccgguaugaauggaaaccccauggcgccugggaggagccaucgcuuggggugcugaagauccaaaacguuggcugggacaacacaaccaucgccugcgcagcuuguaauaguuggugcucgugggccuccccugucgcccugaauguccaguaugccccccgagacgugaggguccggaaaaucaagccccuuuccgagauucacucuggaaacucggucagccuccaaugugacuucucaagcagccaccccaaagaaguccaguucuucugggagaaaaauggcaggcuucuggggaaagaaagccagcugaauuuugacuccaucuccccagaagaugcugggaguuacagcugcugggugaacaacuccauaggacagacagcguccaaggccuggacacuugaagugcuguaugcacccaggaggcugcguguguccaugagcccgggggaccaagugauggaggggaagagugcaacccugaccugugagagcgacgccaacccucccgucucccacuacaccugguuugacuggaauaaccaaagccuccccuaccacagccagaagcugagauuggagccggugaagguccagcacucgggugccuacuggugccaggggaccaacagugugggcaagggccguucgccucucagcacccucaccgucuacuauagcccggagaccaucggcaggcgaguggcugugggacucggguccugccucgccauccucauccuggcaaucugugggcucaagcuccagcgacguuggaagaggacacagagccagcaggggcuucaggagaauuccagcggccagagcuucuuugugaggaauaaaaagguuagaagggccccccucucugaaggcccccacucccugggaugcuacaauccaaugauggaagauggcauuagcuacaccacccugcgcuuucccgagaugaacauaccacgaacuggagaugcagaguccucagagaugcagagaccucccccggacugcgaugacacggucacuuauucagcauugcacaagcgccaagugggcgacuaugagaacgucauuccagauuuuccagaagaugaggggauucauuacucagagcugauccaguuuggggucggggagcggccucaggcacaagaaaauguggacuaugugauccucaaacauuga

SEQ ID NO: 813 - RNA, 2544 nt, Artificial Sequence
  derived and/or modified sequence opt1 from CD22__Homo_sapiens__AAB06448
augcaccuccucggccccuggcugcugcuccuggugcuggaguaccucgccuucagcgacuccagcaagugggucuucgagcacccggagacccuguacgccugggagggggcgugcguguggauccccugcaccuaccgcgcccuggacggcgaccucgaguccuucauccuguuccacaaccccgaguacaacaagaacacgagcaaguucgacgggacccggcuguacgaguccaccaaggacggcaaggugcccagcgagcagaagcgcguccaguuccucggggacaagaacaagaacugcacccuguccauccacccggugcaccugaacgacagcggccagcucggccugcggauggaguccaagacggagaaguggauggagcgcauccaccugaacgugagcgagcggcccuucccgccccacauccagcucccgcccgagauccaggagucccaggaggucacccugaccugccugcucaacuucagcugcuacggguaccccauccagcugcaguggcugcucgagggcgugcccaugcgccaggccgccgugaccuccacgagccugaccaucaaguccgucuucacccggagcgagcugaaguucuccccgcaguggagccaccacgggaagaucgugaccugccagcuccaggacgccgacggcaaguuccuguccaacgacacggugcagcugaacgucaagcacacccccaagcucgagaucaaggugacccccagcgacgcgaucgugcgcgagggggacagcgucaccaugacgugcgagguguccagcuccaaccccgaguacaccaccgugagcuggcugaaggacggcaccucccugaagaagcagaacacguucacccucaaccugcgggaggucaccaaggaccagagcggcaaguacugcugccagguguccaacgacguggggcccggccgcagcgaggaggucuuccuccaggugcaguacgcccccgagcccuccaccgugcagauccugcacagccccgccgucgaggggucccagguggaguuccugugcaugagccuggccaacccgcuccccacgaacuacaccugguaccacaacggcaaggagaugcagggccggaccgaggagaagguccacauccccaagauccugcccuggcacgcggggaccuacuccugcguggccgagaacauccugggcacggggcagcgcggcccgggggccgagcucgacgugcaguacccgcccaagaaggucaccaccgugauccagaaccccaugcccauccgggagggcgacaccgugacgcugagcugcaacuacaacuccagcaaccccuccgucacccgcuacgaguggaagccccacggcgccugggaggagccgagccugggggugcucaagauccagaacgugggcugggacaacaccaccaucgccugcgcggccugcaacuccuggugcagcugggccagccccgucgcccugaacgugcaguacgcgccccgggacgugcgcguccggaagaucaagccccuguccgagauccacagcgggaacuccgugagccuccagugcgacuucuccagcucccacccgaaggaggugcaguucuucugggagaagaacggccgccugcuggggaaggagagccagcugaacuucgacuccaucagccccgaggacgccggcuccuacagcugcugggucaacaacuccaucggccagacggccagcaaggccuggacccucgaggugcuguacgcgccccggcgccugcggguguccaugagccccggggaccaggucauggagggcaaguccgccacccugaccugcgagagcgacgccaacccgcccgugagccacuacaccugguucgacuggaacaaccagucccugcccuaccacagccagaagcugcgccucgagcccgugaagguccagcacuccggggccuacuggugccagggcacgaacagcguggggaagggccgcuccccgcugagcacccugaccguguacuacucccccgagaccaucggccggcgcgucgccguggggcucggcagcugccuggccauccugauccucgccaucugcgggcugaagcugcagcggcgcuggaagcggacgcagucccagcagggccuccaggagaacagcuccggccagagcuucuucgugcgcaacaagaagguccggcgcgcgccccuguccgaggggccccacagccugggcugcuacaacccgaugauggaggacgggaucuccuacaccacccuccgguuccccgagaugaacaucccccgcaccggcgacgccgagagcuccgagaugcagcggcccccgcccgacugcgacgacacggugaccuacagcgcccugcacaagcgccaggugggggacuacgagaacgucauccccgacuuccccgaggacgagggcauccacuacuccgagcugauccaguucggcgugggggagcggccgcaggcccaggagaacguggacuacgucauccucaagcacuga

SEQ ID NO: 814 - RNA, 2544 nt, Artificial Sequence
  derived and/or modified sequence opt2 from CD22__Homo_sapiens__AAB06448
augcaccuccucggccccuggcuccuccuccucguccucgaguaccucgccuucuccgacuccuccaagugggucuucgagcaccccgagacccucuacgccugggagggcgccugcgucuggauccccugcaccuaccgcgcccucgacggcgaccucgaguccuucauccucuuccacaaccccgaguacaacaagaacaccuccaaguucgacggcacccgccucuacgaguccaccaaggacggcaagguccccuccgagcagaagcgcguccaguuccucggcgacaagaacaagaacugcacccucuccauccaccccguccaccucaacgacuccggccagcucggccuccgcauggaguccaagaccgagaaguggauggagcgcauccaccucaacgucuccgagcgccccuuccccccccacauccagcucccccccgagauccaggagucccaggaggucacccucaccugccuccucaacuucuccugcuacggcuaccccauccagcuccaguggcuccucgagggcguccccaugcgccaggccgccgucaccuccaccucccucaccaucaaguccgucuucacccgcuccgagcucaaguucuccccccaguggucccaccacggcaagaucgucaccugccagcuccaggacgccgacggcaaguuccucuccaacgacaccguccagcucaacgucaagcacacccccaagcucgagaucaaggucacccccuccgacgccaucguccgcgagggcgacuccgucaccaugaccugcgaggucuccuccuccaaccccgaguacaccaccgucuccuggcucaaggacggcaccucccucaagaagcagaacaccuucacccucaaccuccgcgaggucaccaaggaccaguccggcaaguacugcugccaggucuccaacgacgucggccccggccgcuccgaggaggucuuccuccagguccaguacgcccccgagcccuccaccguccagauccuccacucccccgccgucgagggcucccaggucgaguuccucugcaugucccucgccaacccccuccccaccaacuacaccugguaccacaacggcaaggagaugcagggccgcaccgaggagaagguccacauccccaagauccuccccuggcacgccggcaccuacuccugcgucgccgagaacauccucggcaccggccagcgcggccccggcgccgagcucgacguccaguacccccccaagaaggucaccaccgucauccagaaccccaugcccauccgcgagggcgacaccgucacccucuccugcaacuacaacuccuccaaccccuccgucacccgcuacgaguggaagccccacggcgccugggaggagcccucccucggcguccucaagauccagaacgucggcugggacaacaccaccaucgccugcgccgccugcaacuccuggugcuccugggccucccccgucgcccucaacguccaguacgccccccgcgacguccgcguccgcaagaucaagccccucuccgagauccacuccggcaacuccgucucccuccagugcgacuucuccuccucccaccccaaggagguccaguucuucugggagaagaacggccgccuccucggcaaggagucccagcucaacuucgacuccaucucccccgaggacgccggcuccuacuccugcugggucaacaacuccaucggccagaccgccuccaaggccuggacccucgagguccucuacgccccccgccgccuccgcgucuccaugucccccggcgaccaggucauggagggcaaguccgccacccucaccugcgaguccgacgccaacccccccgucucccacuacaccugguucgacuggaacaaccagucccuccccuaccacucccagaagcuccgccucgagcccgucaagguccagcacuccggcgccuacuggugccagggcaccaacuccgucggcaagggccgcuccccccucuccacccucaccgucuacuacucccccgagaccaucggccgccgcgucgccgucggccucggcuccugccucgccauccucauccucgccaucugcggccucaagcuccagcgccgcuggaagcgcacccagucccagcagggccuccaggagaacuccuccggccaguccuucuucguccgcaacaagaagguccgccgcgccccccucuccgagggcccccacucccucggcugcuacaaccccaugauggaggacggcaucuccuacaccacccuccgcuuccccgagaugaacaucccccgcaccggcgacgccgaguccuccgagaugcagcgccccccccccgacugcgacgacaccgucaccuacuccgcccuccacaagcgccaggucggcgacuacgagaacgucauccccgacuuccccgaggacgagggcauccacuacuccgagcucauccaguucggcgucggcgagcgcccccaggcccaggagaacgucgacuacgucauccucaagcacuga

SEQ ID NO: 815 - RNA, 2544 nt, Artificial Sequence
  derived and/or modified sequence opt3 from CD22__Homo_sapiens__AAB06448
augcaucugcucggccccuggcuucuguuguuagugcuggaguaccuagccuucagcgacuccucuaagugggucuuugaacacccugagacccucuaugcuugggaaggggcaugcguuuggaucccauguacauacagagcccuggauggagaccuugagucauucauucuguuucacaacccggaauauaauaaaaacacuucuaaguucgaugguacgagguuguacgagagcaccaaagacggcaaggugcccuccgagcagaaacggguacaauuucucggggauaagaauaagaacugcacacugucuauacauccugugcaccugaaugacucgggacagcucggcuuacgcauggaaucaaaaacugagaaguggauggaacgaauccaucugaacgucagcgagcguccauuucccccucacauucagcuuccacccgagauccaggaaagucaagaggugaccuugacaugucugcuaaauuucuccugcuaugguuacccuauucagcuccaguggcugcuugaagggguuccaaugagacaggcggcugugaccucuacuagccugacaaucaaauccgucuucaccaggucagaguugaaguuuaguccgcaauggagccaccauggaaaaauagugacgugucagcuccaggaugccgacggcaaguuccugucuaacgauacuguacaguuaaauguuaagcacacccccaaacuggaaaucaaggugacaccuuccgacgcaauuguccgggagggcgauucagugacuaugaccugcgaggugagcaguucuaacccagaauauacaaccgucuccuggcucaaagacgggacgagccuuaagaaacaaaauacuuuuacacugaacuugcgcgagguuaccaaggaucagucgggaaaauacuguugccaggugucuaaugacguaggucccggcagauccgaagagguguuccuacaaguccaguacgccccugaaccaucaacugugcagauccugcauagucccgcuguugaggggagccagguggaguuucucuguaugucccuggcaaacccgcuuccuacaaauuauaccugguaccacaacggaaaggaaaugcaaggcaggacggaggaaaagguccacauucccaaaauccugccauggcaugccgguaccuauucuugcguggcugagaacauauuggggacaggacagcggggcccuggcgccgaacucgacguacaguaucccccaaagaaaguuacuaccgugauucagaaucccaugccuauccgcgagggggauacagucacucugagcuguaacuacaauucaaguaacccauccgugacccgauacgaguggaagccgcacggagcgugggaggaacccagcuuagguguccugaaaauucaaaaugugggcugggacaacacaaccaucgcaugcgccgcuugcaauucuugguguucaugggccaguccuguugcacuaaacgugcaguaugcuccaagagauguaaggguccggaagaucaagccccucagcgaaauucauuccgggaauagugugucgcugcagugcgacuucagcuccucacacccuaaagagguucaguucuuuugggagaagaacggacgucuuuugggcaaagaaagucaacugaauuucgauucuauaagcccagaggacgccgguuccuacucauguugggugaacaauagcaucgggcagacugcgucuaaggccuggacgcucgaaguccuguacgcaccccgcagacuuaggguguccaugaguccgggcgaucagguaauggagggaaaaagcgcuacacugaccugcgaaucugacgccaacccuccagugucccauuauacuugguuugauuggaauaaccagucauugcccuaccacagucaaaagcuccggcuggagccuguuaagguccagcacagcggcgcuuauuggugucaggggaccaacucggugggaaaaggucgaucccccuuaucuacacugaccguguacuauagcccagagacuauuggccgcagagucgccguugggcuaggaucaugccucgcaauccugauacuugccauuuguggcuugaagcugcaaaggcgguggaaacgcacacagagucagcagggucuccaagaaaauuccucugggcagagcuucuuugugagaaacaagaaagugaggcgugcuccucuguccgagggcccccauucauuaggaugcuacaauccaaugauggaagacggcaucagcuauacgacccugcgguucccggagaugaacaucccucgaacuggggaugcggaaaguucugagaugcagagacccccacccgacugugacgauacaguaaccuacuccgcacuucacaagaggcaggucggagacuacgagaaugugauuccugauuuuccagaagacgaggguauccauuauagcgaauugauucaauucggcguuggggagcgcccccaggcccaggaaaacguggauuacgucauacucaagcacuga

SEQ ID NO: 816 - RNA, 2544 nt, Artificial Sequence
  derived and/or modified sequence opt4 from CD22__Homo_sapiens__AAB06448
augcaccugcugggccccuggcugcugcugcuggugcuggaguaccuggccuucagcgacagcagcaaguggguguucgagcaccccgagacccuguacgccugggagggcgccugcguguggauccccugcaccuacagagcccuggacggcgaccuggagagcuucauccuguuccacaaccccgaguacaacaagaacaccagcaaguucgacggcaccagacuguacgagagcaccaaggacggcaaggugcccagcgagcagaagagagugcaguuccugggcgacaagaacaagaacugcacccugagcauccaccccgugcaccugaacgacagcggccagcugggccugagaauggagagcaagaccgagaaguggauggagagaauccaccugaacgugagcgagagacccuuccccccccacauccagcugccccccgagauccaggagagccaggaggugacccugaccugccugcugaacuucagcugcuacggcuaccccauccagcugcaguggcugcuggagggcgugcccaugagacaggccgccgugaccagcaccagccugaccaucaagagcguguucaccagaagcgagcugaaguucagcccccaguggagccaccacggcaagaucgugaccugccagcugcaggacgccgacggcaaguuccugagcaacgacaccgugcagcugaacgugaagcacacccccaagcuggagaucaaggugacccccagcgacgccaucgugagagagggcgacagcgugaccaugaccugcgaggugagcagcagcaaccccgaguacaccaccgugagcuggcugaaggacggcaccagccugaagaagcagaacaccuucacccugaaccugagagaggugaccaaggaccagagcggcaaguacugcugccaggugagcaacgacgugggccccggcagaagcgaggagguguuccugcaggugcaguacgcccccgagcccagcaccgugcagauccugcacagccccgccguggagggcagccagguggaguuccugugcaugagccuggccaacccccugcccaccaacuacaccugguaccacaacggcaaggagaugcagggcagaaccgaggagaaggugcacauccccaagauccugcccuggcacgccggcaccuacagcugcguggccgagaacauccugggcaccggccagagaggccccggcgccgagcuggacgugcaguacccccccaagaaggugaccaccgugauccagaaccccaugcccaucagagagggcgacaccgugacccugagcugcaacuacaacagcagcaaccccagcgugaccagauacgaguggaagccccacggcgccugggaggagcccagccugggcgugcugaagauccagaacgugggcugggacaacaccaccaucgccugcgccgccugcaacagcuggugcagcugggccagccccguggcccugaacgugcaguacgcccccagagacgugagagugagaaagaucaagccccugagcgagauccacagcggcaacagcgugagccugcagugcgacuucagcagcagccaccccaaggaggugcaguucuucugggagaagaacggcagacugcugggcaaggagagccagcugaacuucgacagcaucagccccgaggacgccggcagcuacagcugcugggugaacaacagcaucggccagaccgccagcaaggccuggacccuggaggugcuguacgcccccagaagacugagagugagcaugagccccggcgaccaggugauggagggcaagagcgccacccugaccugcgagagcgacgccaacccccccgugagccacuacaccugguucgacuggaacaaccagagccugcccuaccacagccagaagcugagacuggagcccgugaaggugcagcacagcggcgccuacuggugccagggcaccaacagcgugggcaagggcagaagcccccugagcacccugaccguguacuacagccccgagaccaucggcagaagaguggccgugggccugggcagcugccuggccauccugauccuggccaucugcggccugaagcugcagagaagauggaagagaacccagagccagcagggccugcaggagaacagcagcggccagagcuucuucgugagaaacaagaaggugagaagagccccccugagcgagggcccccacagccugggcugcuacaaccccaugauggaggacggcaucagcuacaccacccugagauuccccgagaugaacauccccagaaccggcgacgccgagagcagcgagaugcagagacccccccccgacugcgacgacaccgugaccuacagcgcccugcacaagagacaggugggcgacuacgagaacgugauccccgacuuccccgaggacgagggcauccacuacagcgagcugauccaguucggcgugggcgagagaccccaggcccaggagaacguggacuacgugauccugaagcacuga

SEQ ID NO: 817 - RNA, 2544 nt, Artificial Sequence
  derived and/or modified sequence opt5 from CD22__Homo_sapiens__AAB06448
augcaucugcucggccccuggcugcuucugcucgugcuggaguaccuugccuucagcgacuccucuaagugggucuuugaacacccugagacccuguaugcuugggaaggggccugcguuuggaucccguguacauacagagcgcucgauggagaccuggagagcuucauucuguuucacaaccccgaauauaauaaaaacacguccaaguucgauggcacccggcucuacgagucuacaaaagacgggaaggugccuagcgagcagaaacgcgugcaauuucugggagauaagaauaagaacugcacccuuuccauccaucccguccaccugaaugacucuggccagcucgggcugagaauggaaagcaaaacagagaaguggauggaacggauucaucuuaacguguccgagcgcccuuuucccccucacauccagcugccgcccgagauucaggaaagccaagagguuacccucacaugucugcugaauuucucuugcuauggauacccuauccagcuccaguggcugcuugaaggcgugcccaugagacaggcugccgucaccuccacgagccugaccaucaaaucuguguucacacgguccgagcucaaguuuagcccucaauggucucaccauggcaaaauuguuaccugucagcugcaggaugccgacgggaaguuccuuuccaacgauacagugcagcugaaugucaagcacacccccaaacucgaaaucaaggugacgccgagcgacgcuauugugcgcgagggagauuccgucacaaugaccugcgagguuucuagcuccaacccugaauauacaaccgugagcuggcugaaagacggcaccucucugaagaaacaaaauacauuuacgcucaaccugagagaggugaccaaggaucaguccgggaaauacuguugccaggucagcaaugacgugggacccggccggucugaagagguuuuccuucaagugcaguacgccccugaacccagcacaguccagauccugcauucccccgcuguggaggggucucagguugaguuucucuguaugagccuggccaacccucuuccgaccaauuauacaugguaccacaacggaaaggaaaugcaaggccgcaccgaggaaaaggugcacauucccaaaauccugccuuggcaugcgggcacguauuccugcgucgccgagaacauucucgggacaggacagagaggccccggggcugaacuggacgugcaguacccucccaagaaagucaccaccgugauccagaauccgaugccuauccgggagggagauacaguuacccugagcuguaacuauaauucuuccaaccccagcgugacacgcuacgaguggaagccucacggcgccugggaggaacccucucucgggguccugaaaauucaaaaugugggaugggacaacacgaccaucgcuugcgccgcgugcaauuccugguguagcugggccuccccuguugcucuuaacgugcaguaugcccccagagauguccgggugcgcaagauuaagccgcugucugaaauccauagcggcaauuccgugucucuccagugcgacuucagcuccagccacccuaaagagguucaguucuuuugggagaagaacggcagacugcuggggaaagaaucucaacuuaauuucgauuccauuagccccgaggacgcuggaucuuacuccuguugggucaacaauagcaucggccagacagccucuaaggccuggacccucgaagugcuguacgcuccccggagacugcgcgugagcauguccccuggggaucaggucauggagggaaaaagcgcgacacuuaccugcgaaucugacgccaacccgcccgugucccauuauacgugguuugauuggaauaaccagagccugccuuaccacucccaaaagcuccggcuggagcccguuaaggugcagcacucuggcgcuuauuggugucaggggaccaacagcgucggcaaaggaagauccccucucucuacacugaccguguacuauagccccgagacaaucggccgccggguugccguggggcugggauccugccuugccauucucauccuggcuauuuguggccugaagcuccaaagacgcuggaaacggacccagucucagcaggggcugcaagaaaauagcuccggacagagcuucuuugucagaaacaagaaagugcgccgggccccucuuucugagggcccccauucccuggggugcuacaauccgaugauggaagacggcaucagcuauacgacacucagauucccugagaugaacauuccccgcaccggagaugcggaaucuuccgagaugcagcggccucccccggacugugacgauacaguuaccuacagcgcucugcacaagagacaggugggcgacuacgagaaugucaucccugauuuucccgaagacgaggggauccauuauucugaacugauucaauucggagugggcgagcggccucaggcccaggaaaacguggauuacgucauccuuaagcacuga

SEQ ID NO: 818 - protein, 847 aa, Artificial Sequence; identical to SEQ ID NO: 811
  CD22__Homo_sapiens__Q0EAF5

SEQ ID NO: 819 - RNA, 2544 nt, Artificial Sequence; identical to SEQ ID NO: 812
  CD22__Homo_sapiens__ABK41939

SEQ ID NO: 820 - RNA, 2544 nt, Artificial Sequence; identical to SEQ ID NO: 813
  derived and/or modified sequence opt1 from CD22__Homo_sapiens__ABK41939

SEQ ID NO: 821 - RNA, 2544 nt, Artificial Sequence; identical to SEQ ID NO: 814
  derived and/or modified sequence opt2 from CD22__Homo_sapiens__ABK41939

SEQ ID NO: 822 - RNA, 2544 nt, Artificial Sequence; identical to SEQ ID NO: 815
  derived and/or modified sequence opt3 from CD22__Homo_sapiens__ABK41939

SEQ ID NO: 823 - RNA, 2544 nt, Artificial Sequence; identical to SEQ ID NO: 816
  derived and/or modified sequence opt4 from CD22__Homo_sapiens__ABK41939

SEQ ID NO: 824 - RNA, 2544 nt, Artificial Sequence; identical to SEQ ID NO: 817
  derived and/or modified sequence opt5 from CD22__Homo_sapiens__ABK41939

SEQ ID NO: 825 - protein, 534 aa, Artificial Sequence
  CD276__Homo_sapiens__Q5ZPR3
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 826 - RNA, 1605 nt, Artificial Sequence
  CD276__Homo_sapiens__CAE47548
augcugcgucggcggggcagcccuggcaugggugugcaugugggugcagcccugggagcacugugguucugccucacaggagcccuggagguccaggucccugaagacccagugguggcacuggugggcaccgaugccacccugugcugcuccuucucccccgagccuggcuucagccuggcacagcucaaccucaucuggcagcugacagauaccaaacagcuggugcacagcuuugcugagggccaggaccagggcagcgccuaugccaaccgcacggcccucuucccggaccugcuggcacagggcaacgcaucccugaggcugcagcgcgugcguguggcggacgagggcagcuucaccugcuucgugagcauccgggauuucggcagcgcugccgucagccugcagguggccgcucccuacucgaagcccagcaugacccuggagcccaacaaggaccugcggccaggggacacggugaccaucacgugcuccagcuaccagggcuacccugaggcugagguguucuggcaggaugggcagggugugccccugacuggcaacgugaccacgucgcagauggccaacgagcagggcuuguuugaugugcacagcauccugcggguggugcugggugcaaauggcaccuacagcugccuggugcgcaaccccgugcugcagcaggaugcgcacagcucugucaccaucacaccccagagaagccccacaggagccguggagguccaggucccugaggacccggugguggcccuagugggcaccgaugccacccugcgcugcuccuucucccccgagccuggcuucagccuggcacagcucaaccucaucuggcagcugacagacaccaaacagcuggugcacaguuucaccgaaggccgggaccagggcagcgccuaugccaaccgcacggcccucuucccggaccugcuggcacaaggcaaugcaucccugaggcugcagcgcgugcguguggcggacgagggcagcuucaccugcuucgugagcauccgggauuucggcagcgcugccgucagccugcagguggccgcucccuacucgaagcccagcaugacccuggagcccaacaaggaccugcggccaggggacacggugaccaucacgugcuccagcuaccggggcuacccugaggcugagguguucuggcaggaugggcagggugugccccugacuggcaacgugaccacgucgcagauggccaacgagcagggcuuguuugaugugcacagcguccugcggguggugcugggugcgaauggcaccuacagcugccuggugcgcaaccccgugcugcagcaggaugcgcacggcucugucaccaucacagggcagccuaugacauuccccccagaggcccugugggugaccguggggcugucugucugucucauugcacugcugguggcccuggcuuucgugugcuggagaaagaucaaacagagcugugaggaggagaaugcaggagcugaggaccaggauggggagggagaaggcuccaagacagcccugcagccucugaaacacucugacagcaaagaagaugauggacaagaaauagccuga

SEQ ID NO: 827 - RNA, 1605 nt, Artificial Sequence
  derived and/or modified sequence opt1 from CD276__Homo_sapiens__CAE47548
augcugcgccggcgcggcagccccgggaugggcgugcacgucggggccgcccucggcgcgcugugguucugccugaccggggcccucgagguccaggugccggaggaccccgugguggcccuggugggcaccgacgccacgcugugcugcuccuucagccccgagcccggcuucucccucgcccagcugaaccugaucuggcagcucaccgacaccaagcagcugguccacagcuucgcggaggggcaggaccagggcuccgccuacgccaaccggaccgcccuguucccggaccuccuggcgcaggggaacgccagccugcgccuccagcgggugcgcguggccgacgagggcuccuucacgugcuucgucagcauccgggacuucggguccgccgccgugagccuccagguggcggcccccuacuccaagcccagcaugacccuggagcccaacaaggaccugcgcccgggcgacaccgucaccaucacgugcuccagcuaccagggcuaccccgaggccgagguguucuggcaggacgggcagggcgugccccugaccgggaacgucaccaccucccagauggccaacgagcagggccuguucgacgugcacagcauccuccgggugguccugggcgccaacgggacguacuccugccuggugcgcaaccccgugcuccagcaggacgcgcacagcuccgucaccaucaccccgcagcggagccccaccggcgccguggaggugcagguccccgaggaccccguggucgcccugguggggacggacgccacccugcgcugcagcuucuccccggagcccggcuucagccucgcccagcugaaccugaucuggcagcucaccgacaccaagcagcuggugcacuccuucacggaggggcgggaccagggcagcgcguacgccaaccgcaccgcccuguuccccgaccuccuggcccagggcaacgccucccugcggcuccagcgcguccggguggcggacgaggggagcuucacgugcuucguguccauccgcgacuucggcagcgccgccgucucccuccagguggccgcgcccuacagcaagccguccaugacccuggagcccaacaaggaccugcggcccggggacaccgugaccaucacgugcagcuccuaccgcggcuaccccgaggccgaggucuucuggcaggacgggcagggcgugccgcugaccggcaacgugaccaccagccagauggccaacgagcaggggcuguucgacguccacuccgugcuccgggugguccugggcgccaacgggaccuacagcugccuggugcgcaaccccgugcuccagcaggacgcccacggcuccgucaccaucacggggcagcccaugaccuucccgcccgaggcgcugugggugaccgugggccugagcgucugccucaucgcccugcugguggcccuggccuucgugugcuggcgcaagaucaagcaguccugcgaggaggagaacgccggcgcggaggaccaggacggggagggcgaggggagcaagaccgcccuccagccccugaagcacagcgacuccaaggaggacgacggccaggagaucgccuga

SEQ ID NO: 828 - RNA, 1605 nt, Artificial Sequence
  derived and/or modified sequence opt2 from CD276__Homo_sapiens__CAE47548
augcuccgccgccgcggcucccccggcaugggcguccacgucggcgccgcccucggcgcccucugguucugccucaccggcgcccucgagguccagguccccgaggaccccgucgucgcccucgucggcaccgacgccacccucugcugcuccuucucccccgagcccggcuucucccucgcccagcucaaccucaucuggcagcucaccgacaccaagcagcucguccacuccuucgccgagggccaggaccagggcuccgccuacgccaaccgcaccgcccucuuccccgaccuccucgcccagggcaacgccucccuccgccuccagcgcguccgcgucgccgacgagggcuccuucaccugcuucgucuccauccgcgacuucggcuccgccgccgucucccuccaggucgccgcccccuacuccaagcccuccaugacccucgagcccaacaaggaccuccgccccggcgacaccgucaccaucaccugcuccuccuaccagggcuaccccgaggccgaggucuucuggcaggacggccagggcgucccccucaccggcaacgucaccaccucccagauggccaacgagcagggccucuucgacguccacuccauccuccgcgucguccucggcgccaacggcaccuacuccugccucguccgcaaccccguccuccagcaggacgcccacuccuccgucaccaucaccccccagcgcucccccaccggcgccgucgagguccagguccccgaggaccccgucgucgcccucgucggcaccgacgccacccuccgcugcuccuucucccccgagcccggcuucucccucgcccagcucaaccucaucuggcagcucaccgacaccaagcagcucguccacuccuucaccgagggccgcgaccagggcuccgccuacgccaaccgcaccgcccucuuccccgaccuccucgcccagggcaacgccucccuccgccuccagcgcguccgcgucgccgacgagggcuccuucaccugcuucgucuccauccgcgacuucggcuccgccgccgucucccuccaggucgccgcccccuacuccaagcccuccaugacccucgagcccaacaaggaccuccgccccggcgacaccgucaccaucaccugcuccuccuaccgcggcuaccccgaggccgaggucuucuggcaggacggccagggcgucccccucaccggcaacgucaccaccucccagauggccaacgagcagggccucuucgacguccacuccguccuccgcgucguccucggcgccaacggcaccuacuccugccucguccgcaaccccguccuccagcaggacgcccacggcuccgucaccaucaccggccagcccaugaccuucccccccgaggcccucugggucaccgucggccucuccgucugccucaucgcccuccucgucgcccucgccuucgucugcuggcgcaagaucaagcaguccugcgaggaggagaacgccggcgccgaggaccaggacggcgagggcgagggcuccaagaccgcccuccagccccucaagcacuccgacuccaaggaggacgacggccaggagaucgccuga

SEQ ID NO: 829 - RNA, 1605 nt, Artificial Sequence
  derived and/or modified sequence opt3 from CD276__Homo_sapiens__CAE47548
augcugagaaggcggggcagccccgggaugggagugcacgucggugccgcucucggcgcacuuugguucugccugaccggggccuuggagguucaggugccugaagacccaguaguggcguuagucggaacagaugcuacucuguguugcuccuuuucuccggagcccggcuucucacuagcccaacucaaccugaucuggcagcuuacggacaccaagcagcuggugcauaguuuugcagaaggucaggaucaagggagcgccuacgcuaaucgcacagcauuguucccugaccuccuggcccagggaaacgcuucccugcgacuccagcguguuagaguggccgaugagggcucuuuuacuuguuucgucucgauuagggacuuuggcucagcggcagugagcuuacagguagccgcuccauauaguaaacccuccaugacccuggaaccuaauaaggaucuucggccaggggacacaguuaccauaacuugcucuagcuaccaaggauaucccgaggccgagguguucuggcaggauggucagggcgucccuuugacagggaacgugaccacgucccagauggcaaaugaacaaggacuguuugacgugcacucaauccuacgcgucguucucggcgcuaacgguacuuacaguugucuggugagaaauccaguacuucagcaggaugcccauagcucugugaccauuacaccgcaaaggucccccacuggggcggucgaggugcagguuccugaagacccaguggucgcccuggugggaaccgaugcaacauugcggugcucauucagccccgagccuggcuuuagucucgcucagcugaacuuaaucuggcagcugaccgacacgaaacaacucguacacucuuucacugagggccgcgaccagggguccgccuaugcuaaucgaacagcccuuuuuccagaucuguuggcacagggaaacgccagccuaagacugcagaggguucggguggcugacgaagguucguucaccuguuucgucucuauucgugauuuuggcuccgcggcagugucacuccaagucgccgcucccuacaguaagccgagcaugacucuggagccuaauaaagaccuucgccccggggauacagugaccaucacgugcuccucuuauagaggauacccagaagccgagguuuucuggcaggacggccagggugugccucugaccgggaacguaacaacuagccagauggcaaaugaacaaggcuuguuugauguccauucagugcucaggguugugcugggagccaacggcaccuacaguuguuuaguccggaaucccgugcugcagcaggacgcucacggguccguaacaauaacuggacagccaaugaccuuucccccugaggcccuaugggugacaguuggucucagcgucugccugaucgcacuuuugguggcgcuggcuuucguguguuggcgaaagauuaagcaaucuugcgaggaagagaacgccggcgcagaagaucaggacggggagggagaaggcucaaaaaccgcccuccagccacugaagcacagugauagcaaagaggacgacggucaagagaucgcuuga

SEQ ID NO: 830 - RNA, 1605 nt, Artificial Sequence
  derived and/or modified sequence opt4 from CD276__Homo_sapiens__CAE47548
augcugagaagaagaggcagccccggcaugggcgugcacgugggcgccgcccugggcgcccugugguucugccugaccggcgcccuggaggugcaggugcccgaggaccccgugguggcccuggugggcaccgacgccacccugugcugcagcuucagccccgagcccggcuucagccuggcccagcugaaccugaucuggcagcugaccgacaccaagcagcuggugcacagcuucgccgagggccaggaccagggcagcgccuacgccaacagaaccgcccuguuccccgaccugcuggcccagggcaacgccagccugagacugcagagagugagaguggccgacgagggcagcuucaccugcuucgugagcaucagagacuucggcagcgccgccgugagccugcagguggccgcccccuacagcaagcccagcaugacccuggagcccaacaaggaccugagacccggcgacaccgugaccaucaccugcagcagcuaccagggcuaccccgaggccgagguguucuggcaggacggccagggcgugccccugaccggcaacgugaccaccagccagauggccaacgagcagggccuguucgacgugcacagcauccugagaguggugcugggcgccaacggcaccuacagcugccuggugagaaaccccgugcugcagcaggacgcccacagcagcgugaccaucaccccccagagaagccccaccggcgccguggaggugcaggugcccgaggaccccgugguggcccuggugggcaccgacgccacccugagaugcagcuucagccccgagcccggcuucagccuggcccagcugaaccugaucuggcagcugaccgacaccaagcagcuggugcacagcuucaccgagggcagagaccagggcagcgccuacgccaacagaaccgcccuguuccccgaccugcuggcccagggcaacgccagccugagacugcagagagugagaguggccgacgagggcagcuucaccugcuucgugagcaucagagacuucggcagcgccgccgugagccugcagguggccgcccccuacagcaagcccagcaugacccuggagcccaacaaggaccugagacccggcgacaccgugaccaucaccugcagcagcuacagaggcuaccccgaggccgagguguucuggcaggacggccagggcgugccccugaccggcaacgugaccaccagccagauggccaacgagcagggccuguucgacgugcacagcgugcugagaguggugcugggcgccaacggcaccuacagcugccuggugagaaaccccgugcugcagcaggacgcccacggcagcgugaccaucaccggccagcccaugaccuucccccccgaggcccugugggugaccgugggccugagcgugugccugaucgcccugcugguggcccuggccuucgugugcuggagaaagaucaagcagagcugcgaggaggagaacgccggcgccgaggaccaggacggcgagggcgagggcagcaagaccgcccugcagccccugaagcacagcgacagcaaggaggacgacggccaggagaucgccuga

SEQ ID NO: 831 - RNA, 1605 nt, Artificial Sequence
  derived and/or modified sequence opt5 from CD276__Homo_sapiens__CAE47548
augcugagacggcgcggcagccccgggaugggagugcacgucggcgccgcucucggggcccugugguucugccuuaccggagcgcuggagguucaggugccugaagacccgguggucgcucucgugggcacagaugccacgcuguguugcuccuuuucucccgagccuggguucagccuugcccaacugaaccucaucuggcagcugaccgacacaaagcagcugguucauuccuuugcugaaggacaggaucaaggcucugccuacgcuaauagaaccgcccucuuccccgaccugcuugcgcagggcaacgccagccugcggcuccagcgcgugagagucgcugaugagggguccuuuacauguuucgugucuauucgggacuuuggaagcgccgcuguuucccuucagguggccgcgccuuauagcaaacccucuaugacccuggaaccuaauaaggaucugcgcccgggcgacacagucaccaucacgugcuccagcuaccaaggguaucccgaggccgagguguucuggcaggauggacagggcgugccucucaccgggaacgucacaaccucucagauggcuaaugaacaaggacuguuugacguucacuccauucugagaguggugcucggcgccaacggcacauacagcugucugguccggaaucccgugcuucagcaggaugcucauucuuccguuaccaucacgccucaacgcagccccacaggggccguggagguccaggugccggaagacccuguuguggcccuggucggaaccgaugcuacacucagaugcuccuucucucccgagccuggcuuuagccuggcgcagcuuaaccugauuuggcagcucaccgacaccaaacaacuggugcacuccuucacagaggggcgggaccagggaagcgccuaugcuaaucgcacggcccuguuucccgaucuccuggcccagggcaacgcuucucuuagacugcagcggguccgcguggccgacgaaggguccuucaccuguuucguuagcaucagagauuuuggaucugcggcugugagccuccaagucgccgcccccuacuccaagccuucuaugacacuggagccgaauaaagaccuucggcccggcgauaccgugacaauuaccugcagcuccuauagaggcuacccugaagcugagguuuucuggcaggacgggcagggagugccccugacgggcaacgucacaaccagccagauggccaaugaacaagggcucuuugaugugcauucugugcugcgcguuguccugggagcuaacggcaccuacuccugucucgugcggaauccugugcugcagcaggacgcccacgggagcgucacaaucaccggccagcccaugacauucccgccugaggcgcuuugggugacgguuggacugucugugugccucaucgcccugcuggucgcucuugccuuuguguguuggagaaagauuaagcaauccugcgaggaagagaacgcuggcgccgaagaucaggacggggagggagaaggcagcaaaaccgcgcuccagccccugaagcacuccgauucuaaagaggacgacgggcaagagaucgccuga

SEQ ID NO: 832 - protein, 212 aa, Artificial Sequence
  CD33__Homo_sapiens__B4DF51
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVSDGASWHPVCPADTSSQCGPPSCPIQHFQN

SEQ ID NO: 833 - RNA, 639 nt, Artificial Sequence
  CD33__Homo_sapiens__BAG57312
augccgcugcugcuacugcugccccugcugugggcagacuugacccacaggcccaaaauccucaucccuggcacucuagaacccggccacuccaaaaaccugaccugcucuguguccugggccugugagcagggaacacccccgaucuucuccugguugucagcugcccccaccucccugggccccaggacuacucacuccucggugcucauaaucaccccacggccccaggaccacggcaccaaccugaccugucaggugaaguucgcuggagcuggugugacuacggagagaaccauccagcucaacgucaccuauguuccacagaacccaacaacugguaucuuuccaggagauggcucagggaaacaagagaccagagcaggagugguucauggggccauuggaggagcugguguuacagcccugcucgcucuuugucucugccucaucuucuucauagugaagacccacaggaggaaagcagccaggacagcagugggcaggaaugacacccacccuaccacagggucagccuccccggugagugauggggcauccuggcauccagucuguccugcagacaccuccucccaauguggcccaccgucaugccccauucagcauuuccagaacuga

SEQ ID NO: 834 - RNA, 639 nt, Artificial Sequence
  derived and/or modified sequence opt1 from CD33__Homo_sapiens__BAG57312
augccccugcuccugcugcucccccugcugugggccgaccucacccaccgccccaagauccugauccccggcacccuggagcccgggcacagcaagaaccucacgugcuccgugagcugggccugcgagcagggcaccccgcccaucuucuccuggcugagcgcggcccccaccucccuggggccccggaccacgcacagcuccguccucaucaucaccccgcgcccccaggaccacggcaccaaccugaccugccaggugaaguucgccggggccggcgugacgaccgagcggaccauccagcugaacgucaccuacgugccccagaaccccacgaccggcaucuucccgggggacggcagcgggaagcaggagacccgcgccggcgugguccacggggcgaucggcggcgccggggugaccgcccuccuggcccugugccucugccugaucuucuucaucgugaagacgcaccggcgcaaggcggcccggaccgccgucggccgcaacgacacccaccccaccacgggguccgccagccccguguccgacggcgccagcuggcaccccgugugcccggcggacaccuccagccagugcggcccgcccuccugccccauccagcacuuccagaacuga

SEQ ID NO: 835 - RNA, 639 nt, Artificial Sequence
  derived and/or modified sequence opt2 from CD33__Homo_sapiens__BAG57312
augccccuccuccuccuccucccccuccucugggccgaccucacccaccgccccaagauccucauccccggcacccucgagcccggccacuccaagaaccucaccugcuccgucuccugggccugcgagcagggcaccccccccaucuucuccuggcucuccgccgcccccaccucccucggcccccgcaccacccacuccuccguccucaucaucaccccccgcccccaggaccacggcaccaaccucaccugccaggucaaguucgccggcgccggcgucaccaccgagcgcaccauccagcucaacgucaccuacgucccccagaaccccaccaccggcaucuuccccggcgacggcuccggcaagcaggagacccgcgccggcgucguccacggcgccaucggcggcgccggcgucaccgcccuccucgcccucugccucugccucaucuucuucaucgucaagacccaccgccgcaaggccgcccgcaccgccgucggccgcaacgacacccaccccaccaccggcuccgccucccccgucuccgacggcgccuccuggcaccccgucugccccgccgacaccuccucccagugcggcccccccuccugccccauccagcacuuccagaacuga

SEQ ID NO: 836 - RNA, 639 nt, Artificial Sequence
  derived and/or modified sequence opt3 from CD33__Homo_sapiens__BAG57312
augccccugcuccuucuguugccuuuacugugggccgaccuaacccacagaccaaagauccucauuccgggcacacuggagcccgggcauagcaaaaaccuuacuugcuccgugucuugggcuugugaacagggaacgccuccaauauucucauggcugagugcagcccccaccagcuuggguccuaggacaacucacuccucuguccucaucauuaccccacggccccaagaucauggcacaaaucugaccugccagguuaaguuugcgggggcuggagugacuacagagcgcaccauccagcugaacguaacguacgugccucagaauccaacuaccggcauuuucccgggugacgggucgggaaaacaagaaacacgagccggcgucgugcacggcgcaaucgggggagccgguguuacugcucucuuagcacugugucuuugcuugauauuuuucaucgugaagacccaucguagaaaagccgcuaggacagccgucggccggaacgauacccaccccacgacugggucagcgagcccugugagugacggagcauccuggcacccaguaugucccgccgauacaucuagccagugcggcccuccauccugucccauucagcauuuucagaauuga

SEQ ID NO: 837 - RNA, 639 nt, Artificial Sequence
  derived and/or modified sequence opt4 from CD33__Homo_sapiens__BAG57312
augccccugcugcugcugcugccccugcugugggccgaccugacccacagacccaagauccugauccccggcacccuggagcccggccacagcaagaaccugaccugcagcgugagcugggccugcgagcagggcaccccccccaucuucagcuggcugagcgccgcccccaccagccugggccccagaaccacccacagcagcgugcugaucaucacccccagaccccaggaccacggcaccaaccugaccugccaggugaaguucgccggcgccggcgugaccaccgagagaaccauccagcugaacgugaccuacgugccccagaaccccaccaccggcaucuuccccggcgacggcagcggcaagcaggagaccagagccggcguggugcacggcgccaucggcggcgccggcgugaccgcccugcuggcccugugccugugccugaucuucuucaucgugaagacccacagaagaaaggccgccagaaccgccgugggcagaaacgacacccaccccaccaccggcagcgccagccccgugagcgacggcgccagcuggcaccccgugugccccgccgacaccagcagccagugcggcccccccagcugccccauccagcacuuccagaacuga

SEQ ID NO: 838 - RNA, 639 nt, Artificial Sequence
  derived and/or modified sequence opt5 from CD33__Homo_sapiens__BAG57312
augccccugcuccugcuucugccucuccugugggccgaccuuacccacagaccgaagauccugauucccggcacacucgagccugggcauagcaaaaaccugacgugcuccgugucuugggcuugugaacagggaacacccccuaucuucagcuggcuguccgccgcgcccaccucucucggcccucggaccacacacagcuccguccugauuaucaccccgcgcccccaagaucaugggacaaaucuuaccugccagguuaaguuugcuggagccggcgugacgaccgagagaacaauucagcugaacgugaccuacgucccucagaaucccacaaccgggaucuucccuggagacggcucuggcaaacaagaaacgcgggccggggugguucacggagcuaucggcggggccggagugacagcucuccuggcccuuugucugugccucaucuuuuucauugucaagacccaucgcagaaaagcggcccggacagcugugggccgcaacgauacccaccccaccacagggagcgccuccccgguuagcgacggagcuucuuggcacccugugugucccgccgauacguccagccagugcggcccucccucuugucccauucagcauuuucagaauuga

SEQ ID NO: 839 - protein, 364 aa, Artificial Sequence
  CD33__Homo_sapiens__P20138
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 840 - RNA, 1095 nt, Artificial Sequence
  CD33__Homo_sapiens__AAK83654
augccgcugcugcuacugcugccccugcugugggcaggggcccuggcuauggauccaaauuucuggcugcaagugcaggagucagugacgguacaggaggguuugugcguccucgugcccugcacuuucuuccaucccauacccuacuacgacaagaacuccccaguucaugguuacugguuccgggaaggagccauuauauccagggacucuccaguggccacaaacaagcuagaucaagaaguacaggaggagacucagggcagauuccgccuccuuggggaucccaguaggaacaacugcucccugagcaucguagacgccaggaggagggauaaugguucauacuucuuucggauggagagaggaaguaccaaauacaguuacaaaucuccccagcucucugugcaugugacagacuugacccacaggcccaaaauccucaucccuggcacucuagaacccggccacuccaaaaaccugaccugcucuguguccugggccugugagcagggaacacccccgaucuucuccugguugucagcugcccccaccucccugggccccaggacuacucacuccucggugcucauaaucaccccacggccccaggaccacggcaccaaccugaccugucaggugaaguucgcuggagcuggugugacuacggagagaaccauccagcucaacgucaccuauguuccacagaacccaacaacugguaucuuuccaggagauggcucagggaaacaagagaccagagcaggagugguucauggggccauuggaggagcugguguuacagcccugcucgcucuuugucucugccucaucuucuucauagugaagacccacaggaggaaagcagccaggacagcagugggcaggaaugacacccacccuaccacagggucagccuccccgaaacaccagaagaaguccaaguuacauggccccacugaaaccucaagcuguucaggugccgccccuacuguggagauggaugaggagcugcauuaugcuucccucaacuuucaugggaugaauccuuccaaggacaccuccaccgaauacucagaggucaggacccaguga

SEQ ID NO: 841 - RNA, 1095 nt, Artificial Sequence
  derived and/or modified sequence opt1 from CD33__Homo_sapiens__AAK83654
augccccugcuccugcugcucccgcugcugugggccggcgcccucgcgauggaccccaacuucuggcuccaggugcaggagagcgucaccgugcaggaggggcugugcgugcucguccccugcaccuucuuccaccccaucccguacuacgacaagaacucccccgugcacggcuacugguuccgcgagggggccaucaucagccgggacucccccguggccacgaacaagcuggaccaggagguccaggaggagacccagggccgcuuccggcugcucggggaccccagccgcaacaacugcucccugagcaucguggacgcccggcgccgggacaacggcuccuacuucuuccgcauggagcggggcagcaccaaguacuccuacaagagcccgcagcuguccgugcacgucaccgaccucacgcaccgccccaagauccugauccccgggacccuggagcccggccacagcaagaaccugaccugcuccgugagcugggccugcgagcaggggaccccgcccaucuucuccuggcugagcgcggcccccacgucccugggcccccggaccacccacagcuccgugcucaucaucaccccgcgcccccaggaccacgggacgaaccugaccugccaggucaaguucgccggcgccggcgugaccaccgagcggacgauccagcugaacgugaccuacgucccccagaaccccaccaccgggaucuucccgggcgacgggagcggcaagcaggagacgcgcgcgggcguggugcacggggccaucggcggggccggcgucaccgcccuccuggcccugugccucugccugaucuucuucaucgugaagacccaccggcgcaaggcggcccggaccgccguggggcgcaacgacacgcaccccaccaccggcagcgccucccccaagcaccagaagaaguccaagcugcacggccccaccgagacgagcagcugcuccggggccgcgccgaccgucgagauggacgaggagcuccacuacgccagccugaacuuccacggcaugaaccccuccaaggacaccagcaccgaguacuccgaggugcggacgcaguga

SEQ ID NO: 842 - RNA, 1095 nt, Artificial Sequence
  derived and/or modified sequence opt2 from CD33__Homo_sapiens__AAK83654
augccccuccuccuccuccucccccuccucugggccggcgcccucgccauggaccccaacuucuggcuccagguccaggaguccgucaccguccaggagggccucugcguccucguccccugcaccuucuuccaccccauccccuacuacgacaagaacucccccguccacggcuacugguuccgcgagggcgccaucaucucccgcgacucccccgucgccaccaacaagcucgaccaggagguccaggaggagacccagggccgcuuccgccuccucggcgaccccucccgcaacaacugcucccucuccaucgucgacgcccgccgccgcgacaacggcuccuacuucuuccgcauggagcgcggcuccaccaaguacuccuacaaguccccccagcucuccguccacgucaccgaccucacccaccgccccaagauccucauccccggcacccucgagcccggccacuccaagaaccucaccugcuccgucuccugggccugcgagcagggcaccccccccaucuucuccuggcucuccgccgcccccaccucccucggcccccgcaccacccacuccuccguccucaucaucaccccccgcccccaggaccacggcaccaaccucaccugccaggucaaguucgccggcgccggcgucaccaccgagcgcaccauccagcucaacgucaccuacgucccccagaaccccaccaccggcaucuuccccggcgacggcuccggcaagcaggagacccgcgccggcgucguccacggcgccaucggcggcgccggcgucaccgcccuccucgcccucugccucugccucaucuucuucaucgucaagacccaccgccgcaaggccgcccgcaccgccgucggccgcaacgacacccaccccaccaccggcuccgccucccccaagcaccagaagaaguccaagcuccacggccccaccgagaccuccuccugcuccggcgccgcccccaccgucgagauggacgaggagcuccacuacgccucccucaacuuccacggcaugaaccccuccaaggacaccuccaccgaguacuccgagguccgcacccaguga

SEQ ID NO: 843 - RNA, 1095 nt, Artificial Sequence
  derived and/or modified sequence opt3 from CD33__Homo_sapiens__AAK83654
augccccugcuccuucuguugccuuuacugugggccggcgcucuagcaauggacccaaacuucuggcuccaggugcaagagagcgucaccguucaggaagggcugugcgugcuuguaccguguacauuuuuccaccccaucccuuacuaugauaaaaauuccccagugcauggauacugguuuagagagggugccauuauaucuagggacucacccgucgcgacuaacaagcuggaucaggaagugcaggaggaaacgcaaggccgguuccgcuugcucggggacccuagucgaaauaacugcagccuguccaucguugaugcucguagaagggacaauggaucuuacuuuuuccggauggagcgcggcucgaccaaguauucauauaaaagcccacagcugagugugcacgucacagaucucacucauagacccaagauuuuaaucccugguacccuggagccagggcacuccaaaaaccuuacauguucugugagcugggccugcgaacagggaaccccgcccauuuuuaguugguugucagcagccccuacuucccugggcccaaggacaacccauagcucuguacuaaucauaacgccccggccucaggaccacggcacuaaucucaccugucaaguuaaguucgcuggggcaggagugacaacugagcgcaccauccagcugaacgucacauacgugccacagaaucccaccacggguauuuuuccgggcgauggguccggaaagcaggaaacucgagccggcgugguccacggugcuaucgggggagccggcguuacagcgcuucuggcauugugccucugucugauuuucuuuaucgugaaaacccauagaaggaaggccgcucggacugccguaggccguaacgacacacacccuaccacggggucagcaagccccaaacaucaaaagaaaaguaaguuacacggaccaaccgagacaucuuccugcagcggugcugccccuacuguggagauggaugaggaacugcacuaugcgucgcucaauuuccauggcaugaaccccucuaaggacaccuccacagaauacucagagguccgcacucaguga

SEQ ID NO: 844 - RNA, 1095 nt, Artificial Sequence
  derived and/or modified sequence opt4 from CD33__Homo_sapiens__AAK83654
augccccugcugcugcugcugccccugcugugggccggcgcccuggccauggaccccaacuucuggcugcaggugcaggagagcgugaccgugcaggagggccugugcgugcuggugcccugcaccuucuuccaccccauccccuacuacgacaagaacagccccgugcacggcuacugguucagagagggcgccaucaucagcagagacagccccguggccaccaacaagcuggaccaggaggugcaggaggagacccagggcagauucagacugcugggcgaccccagcagaaacaacugcagccugagcaucguggacgccagaagaagagacaacggcagcuacuucuucagaauggagagaggcagcaccaaguacagcuacaagagcccccagcugagcgugcacgugaccgaccugacccacagacccaagauccugauccccggcacccuggagcccggccacagcaagaaccugaccugcagcgugagcugggccugcgagcagggcaccccccccaucuucagcuggcugagcgccgcccccaccagccugggccccagaaccacccacagcagcgugcugaucaucacccccagaccccaggaccacggcaccaaccugaccugccaggugaaguucgccggcgccggcgugaccaccgagagaaccauccagcugaacgugaccuacgugccccagaaccccaccaccggcaucuuccccggcgacggcagcggcaagcaggagaccagagccggcguggugcacggcgccaucggcggcgccggcgugaccgcccugcuggcccugugccugugccugaucuucuucaucgugaagacccacagaagaaaggccgccagaaccgccgugggcagaaacgacacccaccccaccaccggcagcgccagccccaagcaccagaagaagagcaagcugcacggccccaccgagaccagcagcugcagcggcgccgcccccaccguggagauggacgaggagcugcacuacgccagccugaacuuccacggcaugaaccccagcaaggacaccagcaccgaguacagcgaggugagaacccaguga

SEQ ID NO: 845 - RNA, 1095 nt, Artificial Sequence
  derived and/or modified sequence opt5 from CD33__Homo_sapiens__AAK83654
augccccugcuccugcuucugccucuccugugggccggcgcucuugccauggacccgaacuucuggcuccaggugcaagagagcgucaccguucaggaagggcugugcgugcuggugcccuguacauuuuuccacccuauccccuacuaugauaaaaauuccccuguccauggauacugguuuagagagggcgcgauuaucucucgggacagccccguggcuacgaacaagcuggaucaggaaguucaggaggaaacccaagggcgcuucagacuccugggagacccuucccggaauaacugcucucuuagcauuguggaugcccgcagacgggacaauggcuccuacuuuuuccgcauggagagagggucuacaaaguauagcuauaaauccccgcagcugagcguccacgugaccgaucucacacaucggcccaagauccugauuccuggaacccuugagcccggccacucuaaaaaccugacauguuccguuagcugggccugcgaacagggcaccccucccaucuuuucuuggcucuccgcugccccgacgagccuggggccucgcaccacacauucuuccgugcugaucauuacccccagaccucaggaccacggaacaaaucucaccugucaagucaaguucgcuggcgccggggugacgacagagcggaccauccagcugaacgugacauacgucccccagaaucccaccaccggaauuuuuccuggcgaugggagcggaaagcaggaaacacgcgcgggcguugugcacggcgccaucgggggagcuggcgugacggcccuucuggcucucugccugugucuuauuuucuuuaucgucaaaacccauagacggaaggccgcgcgcacagccguggggagaaacgacacccacccgacaaccggauccgcuucucccaaacaucaaaagaaaagcaagcugcacggcccuacggagacauccagcugcucuggggccgcucccaccguugagauggaugaggaacuccacuaugccucccugaauuuccauggaaugaacccuagcaaggacaccucuacagaauacagcgaggugcggacccaguga

SEQ ID NO: 846 - protein, 364 aa, Artificial Sequence; identical to SEQ ID NO: 839
  CD33__Homo_sapiens__Q546G0

SEQ ID NO: 847 - RNA, 1095 nt, Artificial Sequence; identical to SEQ ID NO: 840
  CD33__Homo_sapiens__CAD36509

SEQ ID NO: 848 - RNA, 1095 nt, Artificial Sequence; identical to SEQ ID NO: 841
  derived and/or modified sequence opt1 from CD33__Homo_sapiens__CAD36509

SEQ ID NO: 849 - RNA, 1095 nt, Artificial Sequence; identical to SEQ ID NO: 842
  derived and/or modified sequence opt2 from CD33__Homo_sapiens__CAD36509

SEQ ID NO: 850 - RNA, 1095 nt, Artificial Sequence; identical to SEQ ID NO: 843
  derived and/or modified sequence opt3 from CD33__Homo_sapiens__CAD36509

SEQ ID NO: 851 - RNA, 1095 nt, Artificial Sequence; identical to SEQ ID NO: 844
  derived and/or modified sequence opt4 from CD33__Homo_sapiens__CAD36509

SEQ ID NO: 852 - RNA, 1095 nt, Artificial Sequence; identical to SEQ ID NO: 845
  derived and/or modified sequence opt5 from CD33__Homo_sapiens__CAD36509

SEQ ID NO: 853 - protein, 207 aa, Artificial Sequence
  CD3E__Homo_sapiens__P07766
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 854 - RNA, 624 nt, Artificial Sequence
  CD3E__Homo_sapiens__AAA52295
augcagucgggcacucacuggagaguucugggccucugccucuuaucaguugguguuugggggcaagaugguaaugaagaaaugggugguauuacacagacaccauauaaagucuccaucucuggaaccacaguaauauugacaugcccucaguauccuggaucugaaauacuauggcaacacaaugauaaaaacauaggcggugaugaggaugauaaaaacauaggcagugaugaggaucaccugucacugaaggaauuuucagaauuggagcaaagugguuauuaugucugcuaccccagaggaagcaaaccagaagaugcgaacuuuuaucucuaccugagggcaagagugugugagaacugcauggagauggaugugaugucgguggccacaauugucauaguggacaucugcaucacugggggcuugcugcugcugguuuacuacuggagcaagaauagaaaggccaaggccaagccugugacacgaggagcgggugcuggcggcaggcaaaggggacaaaacaaggagaggccaccaccuguucccaacccagacuaugagcccauccggaaaggccagcgggaccuguauucuggccugaaucagagacgcaucuga

SEQ ID NO: 855 - RNA, 624 nt, Artificial Sequence
  derived and/or modified sequence opt1 from CD3E__Homo_sapiens__AAA52295
augcagagcggcacccacuggcgcgugcuggggcucugccugcuguccgucggcgugugggggcaggacggcaacgaggagaugggcgggaucacccagacgcccuacaaggugagcaucuccggcaccaccgucauccugaccugcccccaguaccccgggagcgagauccucuggcagcacaacgacaagaacaucggcggggacgaggacgacaagaacaucggcuccgacgaggaccaccugagccucaaggaguucuccgagcuggagcagagcggguacuacgugugcuacccccggggcuccaagcccgaggacgccaacuucuaccuguaccuccgcgcccgggugugcgagaacugcauggagauggacgucaugagcguggcgacgaucgugaucgucgacaucugcaucaccggcgggcugcugcuccugguguacuacugguccaagaaccgcaaggccaaggccaagccggugacccggggcgccggggccggcggccgccagcgggggcagaacaaggagcgcccgccgcccguccccaaccccgacuacgagcccauccggaagggccagcgcgaccuguacagcgggcucaaccagcggcgcaucuga

SEQ ID NO: 856 - RNA, 624 nt, Artificial Sequence
  derived and/or modified sequence opt2 from CD3E__Homo_sapiens__AAA52295
augcaguccggcacccacuggcgcguccucggccucugccuccucuccgucggcgucuggggccaggacggcaacgaggagaugggcggcaucacccagacccccuacaaggucuccaucuccggcaccaccgucauccucaccugcccccaguaccccggcuccgagauccucuggcagcacaacgacaagaacaucggcggcgacgaggacgacaagaacaucggcuccgacgaggaccaccucucccucaaggaguucuccgagcucgagcaguccggcuacuacgucugcuacccccgcggcuccaagcccgaggacgccaacuucuaccucuaccuccgcgcccgcgucugcgagaacugcauggagauggacgucauguccgucgccaccaucgucaucgucgacaucugcaucaccggcggccuccuccuccucgucuacuacugguccaagaaccgcaaggccaaggccaagcccgucacccgcggcgccggcgccggcggccgccagcgcggccagaacaaggagcgccccccccccguccccaaccccgacuacgagcccauccgcaagggccagcgcgaccucuacuccggccucaaccagcgccgcaucuga

SEQ ID NO: 857 - RNA, 624 nt, Artificial Sequence
  derived and/or modified sequence opt3 from CD3E__Homo_sapiens__AAA52295
augcagagcggcacccacuggagagugcuggggcucugccuucuguccgucggaguuuggggucaagacggcaacgaggaaaugggagggaucacacagacucccuacaaggugucuauuucaggcacgaccguaauauugacauguccucaguauccagguagugagaucuuauggcagcauaaugauaaaaacauugggggagacgaagaugacaagaauaucggcagcgaugaggaccaccugucccuaaaagaguucucugaacucgagcaaucgggcuacuaugugugcuacccgagggggucaaagcccgaagaugccaacuuuuaucuguaccuucgggcucgcgucugugagaauugcauggaaauggacgugaugagcguugcaacuauugugaucgucgauauauguaucaccggaggucuguugcuccugguguauuacuggaguaaaaaccgaaaggccaaggcgaaaccuguaacacguggcgcuggggccggaggcagacagaggggucagaauaaggagcggccacccccuguuccaaaccccgacuacgagccuauucgcaaagggcagagagaucuguauuccggacucaaucaaaggcggaucuga

SEQ ID NO: 858 - RNA, 624 nt, Artificial Sequence
  derived and/or modified sequence opt4 from CD3E__Homo_sapiens__AAA52295
augcagagcggcacccacuggagagugcugggccugugccugcugagcgugggcguguggggccaggacggcaacgaggagaugggcggcaucacccagacccccuacaaggugagcaucagcggcaccaccgugauccugaccugcccccaguaccccggcagcgagauccuguggcagcacaacgacaagaacaucggcggcgacgaggacgacaagaacaucggcagcgacgaggaccaccugagccugaaggaguucagcgagcuggagcagagcggcuacuacgugugcuaccccagaggcagcaagcccgaggacgccaacuucuaccuguaccugagagccagagugugcgagaacugcauggagauggacgugaugagcguggccaccaucgugaucguggacaucugcaucaccggcggccugcugcugcugguguacuacuggagcaagaacagaaaggccaaggccaagcccgugaccagaggcgccggcgccggcggcagacagagaggccagaacaaggagagacccccccccgugcccaaccccgacuacgagcccaucagaaagggccagagagaccuguacagcggccugaaccagagaagaaucuga

SEQ ID NO: 859 - RNA, 624 nt, Artificial Sequence
  derived and/or modified sequence opt5 from CD3E__Homo_sapiens__AAA52295
augcagagcggcacccacuggagagugcuggggcucugccugcuuuccgucggaguuuggggccaagacgggaacgaggaaaugggaggcaucacacagacgcccuacaaggugucuauuagcgggaccacagugauccugaccuguccucaguauccgggauccgagauucucuggcagcauaaugauaaaaacaucggcggcgacgaagaugacaagaauauugggucugaugaggaccaccugagccuuaaagaguucuccgaacuggagcaaucuggauacuaugucugcuacccccggggcagcaagccugaagaugccaacuuuuaucucuaccugcgcgcuagagugugugagaauugcauggaaauggacguuauguccguggccacaaucgucaucguggauauuuguaucaccgggggacugcuccugcuuguuuauuacuggagcaaaaaccggaaggcgaaggcuaaacccgugacacgcggcgccggggccggaggcagacagcggggccagaauaaggagcgcccucccccugucccgaaccccgacuacgagccuauuagaaaagggcagcgggaucuguauucuggacucaaucaacgcagaaucuga

SEQ ID NO: 860 - protein, 164 aa, Artificial Sequence
  CD3Z__Homo_sapiens__P20963
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 861 - RNA, 495 nt, Artificial Sequence
  CD3Z__Homo_sapiens__AAH25703
augaaguggaaggcgcuuuucaccgcggccauccugcaggcacaguugccgauuacagaggcacagagcuuuggccugcuggaucccaaacucugcuaccugcuggauggaauccucuucaucuauggugucauucucacugccuuguuccugagagugaaguucagcaggagcgcagacgcccccgcguaccagcagggccagaaccagcucuauaacgagcucaaucuaggacgaagagaggaguacgauguuuuggacaagagacguggccgggacccugagauggggggaaagccgcagagaaggaagaacccucaggaaggccuguacaaugaacugcagaaagauaagauggcggaggccuacagugagauugggaugaaaggcgagcgccggaggggcaaggggcacgauggccuuuaccagggucucaguacagccaccaaggacaccuacgacgcccuucacaugcaggcccugcccccucgcuaa

SEQ ID NO: 862 - RNA, 495 nt, Artificial Sequence
  derived and/or modified sequence opt1 from CD3Z__Homo_sapiens__AAH25703
augaaguggaaggcccuguucaccgccgcgauccuccaggcccagcugcccaucaccgaggcccagagcuucggccugcucgaccccaagcugugcuaccugcucgacgggauccuguucaucuacggcgugauccugacggcccucuuccugcgcgucaaguucucccggagcgccgacgcgcccgccuaccagcaggggcagaaccagcuguacaacgagcucaaccugggccgccgggaggaguacgacgugcuggacaagcgccgggggcgcgaccccgagaugggcggcaagccccagcggcgcaagaacccgcaggaggggcucuacaacgagcugcagaaggacaagauggccgaggccuacuccgagaucggcaugaagggggagcggcgccggggcaaggggcacgacggccuguaccagggccucagcaccgcgaccaaggacaccuacgacgcccugcacaugcaggcccugccgccccgcuga

SEQ ID NO: 863 - RNA, 495 nt, Artificial Sequence
  derived and/or modified sequence opt2 from CD3Z__Homo_sapiens__AAH25703
augaaguggaaggcccucuucaccgccgccauccuccaggcccagcuccccaucaccgaggcccaguccuucggccuccucgaccccaagcucugcuaccuccucgacggcauccucuucaucuacggcgucauccucaccgcccucuuccuccgcgucaaguucucccgcuccgccgacgcccccgccuaccagcagggccagaaccagcucuacaacgagcucaaccucggccgccgcgaggaguacgacguccucgacaagcgccgcggccgcgaccccgagaugggcggcaagccccagcgccgcaagaacccccaggagggccucuacaacgagcuccagaaggacaagauggccgaggccuacuccgagaucggcaugaagggcgagcgccgccgcggcaagggccacgacggccucuaccagggccucuccaccgccaccaaggacaccuacgacgcccuccacaugcaggcccuccccccccgcuga

SEQ ID NO: 864 - RNA, 495 nt, Artificial Sequence
  derived and/or modified sequence opt3 from CD3Z__Homo_sapiens__AAH25703
augaaguggaaagcccuguucaccgcugcaauccuccaggcccaacuucccauuacagaggcgcagagcuuuggccuguuggacccuaaguuaugcuaccugcuagaugggauacucuucaucuauggagugauucugacugcucuuuuucugagagucaaauucuccaggucugccgacgcaccagccuaccagcagggucaaaaccaguuguauaaugaacucaaccugggccggcgcgaggaauacgauguucuggacaagcgacgugggagagauccggagaugggaggcaaaccccagaggcggaagaauccucaggaaggucucuauaacgaguuacaaaaggacaaaauggcugaggcauacucagaaaucgggaugaagggagagcgcagaaggggcaaaggccacgaugggcuguaucagggacuuaguacggccaccaaggacacauacgaugcuuugcauaugcaggcccugccaccccgguga

SEQ ID NO: 865 - RNA, 495 nt, Artificial Sequence
  derived and/or modified sequence opt4 from CD3Z__Homo_sapiens__AAH25703
augaaguggaaggcccuguucaccgccgccauccugcaggcccagcugcccaucaccgaggcccagagcuucggccugcuggaccccaagcugugcuaccugcuggacggcauccuguucaucuacggcgugauccugaccgcccuguuccugagagugaaguucagcagaagcgccgacgcccccgccuaccagcagggccagaaccagcuguacaacgagcugaaccugggcagaagagaggaguacgacgugcuggacaagagaagaggcagagaccccgagaugggcggcaagccccagagaagaaagaacccccaggagggccuguacaacgagcugcagaaggacaagauggccgaggccuacagcgagaucggcaugaagggcgagagaagaagaggcaagggccacgacggccuguaccagggccugagcaccgccaccaaggacaccuacgacgcccugcacaugcaggcccugccccccagauga

SEQ ID NO: 866 - RNA, 495 nt, Artificial Sequence
  derived and/or modified sequence opt5 from CD3Z__Homo_sapiens__AAH25703
augaaguggaaagcccuguucaccgcugccauccuccaggcgcaacugcccauuacagaggcucagagcuuuggccuucuggacccuaagcucugcuaccugcuugaugggauccuguucauuuauggagugauccucacggcccuguuucugagagucaaauucucccggucugccgacgcuccggccuaccagcagggccaaaaccagcucuauaaugaacugaaccuugggcgcagagaggaauacgauguucuggacaagcggcgcggaagagaucccgagaugggcgggaaaccucagcggcgcaagaauccccaggaaggacucuauaacgagcugcaaaaggacaaaauggcugaggccuacagcgaaauuggcaugaagggcgagagacggcgcgggaaaggacacgauggccuuuaucaggggcuguccaccgcgacaaaggacaccuacgaugcccuccauaugcaggcucugccucccagauga

SEQ ID NO: 867 - protein, 742 aa, Artificial Sequence
  CD44_Isoform_1__Homo_sapiens__P16070
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 868 - RNA, 2229 nt, Artificial Sequence
  CD44_Isoform_1__Homo_sapiens__CCDS7897.1
auggacaaguuuugguggcacgcagccuggggacucugccucgugccgcugagccuggcgcagaucgauuugaauauaaccugccgcuuugcagguguauuccacguggagaaaaauggucgcuacagcaucucucggacggaggccgcugaccucugcaaggcuuucaauagcaccuugcccacaauggcccagauggagaaagcucugagcaucggauuugagaccugcagguauggguucauagaagggcacguggugauuccccggauccaccccaacuccaucugugcagcaaacaacacagggguguacauccucacauccaacaccucccaguaugacacauauugcuucaaugcuucagcuccaccugaagaagauuguacaucagucacagaccugcccaaugccuuugauggaccaauuaccauaacuauuguuaaccgugauggcacccgcuauguccagaaaggagaauacagaacgaauccugaagacaucuaccccagcaacccuacugaugaugacgugagcagcggcuccuccagugaaaggagcagcacuucaggagguuacaucuuuuacaccuuuucuacuguacaccccaucccagacgaagacagucccuggaucaccgacagcacagacagaaucccugcuaccacuuugaugagcacuagugcuacagcaacugagacagcaaccaagaggcaagaaaccugggauugguuuucaugguuguuucuaccaucagagucaaagaaucaucuucacacaacaacacaaauggcugguacgucuucaaauaccaucucagcaggcugggagccaaaugaagaaaaugaagaugaaagagacagacaccucaguuuuucuggaucaggcauugaugaugaugaagauuuuaucuccagcaccauuucaaccacaccacgggcuuuugaccacacaaaacagaaccaggacuggacccaguggaacccaagccauucaaauccggaagugcuacuucagacaaccacaaggaugacugauguagacagaaauggcaccacugcuuaugaaggaaacuggaacccagaagcacacccuccccucauucaccaugagcaucaugaggaagaagagaccccacauucuacaagcacaauccaggcaacuccuaguaguacaacggaagaaacagcuacccagaaggaacagugguuuggcaacagauggcaugagggauaucgccaaacacccaaagaagacucccauucgacaacagggacagcugcagccucagcucauaccagccauccaaugcaaggaaggacaacaccaagcccagaggacaguuccuggacugauuucuucaacccaaucucacaccccaugggacgaggucaucaagcaggaagaaggauggauauggacuccagucauaguauaacgcuucagccuacugcaaauccaaacacagguuugguggaagauuuggacaggacaggaccucuuucaaugacaacgcagcagaguaauucucagagcuucucuacaucacaugaaggcuuggaagaagauaaagaccauccaacaacuucuacucugacaucaagcaauaggaaugaugucacagguggaagaagagacccaaaucauucugaaggcucaacuacuuuacuggaagguuauaccucucauuacccacacacgaaggaaagcaggaccuucaucccagugaccucagcuaagacuggguccuuuggaguuacugcaguuacuguuggagauuccaacucuaaugucaaucguuccuuaucaggagaccaagacacauuccaccccaguggggggucccauaccacucauggaucugaaucagauggacacucacaugggagucaagaagguggagcaaacacaaccucugguccuauaaggacaccccaaauuccagaauggcugaucaucuuggcaucccucuuggccuuggcuuugauucuugcaguuugcauugcagucaacagucgaagaaggugugggcagaagaaaaagcuagugaucaacaguggcaauggagcuguggaggacagaaagccaaguggacucaacggagaggccagcaagucucaggaaauggugcauuuggugaacaaggagucgucagaaacuccagaccaguuuaugacagcugaugagacaaggaaccugcagaauguggacaugaagauugggguguaa

SEQ ID NO: 869 - RNA, 2229 nt, Artificial Sequence
  derived and/or modified sequence opt1 from CD44_Isoform_1__Homo_sapiens__CCDS7897.1
auggacaaguucugguggcacgccgccuggggccugugccucgugccccugagccuggcgcagaucgaccucaacaucacgugccgcuucgccggggucuuccacguggagaagaacggccgguacuccaucagccgcaccgaggccgccgaccugugcaaggccuucaacuccacccugccgaccauggcgcagauggagaaggcccucagcaucggguucgagaccugccgguacggcuucaucgaggggcacguggucaucccccgcauccaccccaacuccaucugcgccgccaacaacaccggcguguacauccugacgagcaacaccucccaguacgacaccuacugcuucaacgcgagcgcgcccccggaggaggacugcaccuccgugacggaccugcccaacgccuucgacggccccaucaccaucaccaucgucaaccgggacgggacccgcuacgugcagaagggcgaguaccggacgaaccccgaggacaucuacccgagcaaccccaccgacgacgacguguccagcggguccagcuccgagcgcagcuccaccagcggcggguacaucuucuacaccuucuccacgguccaccccauccccgacgaggacagcccguggaucaccgacagcaccgaccggauccccgccaccacgcucauguccaccagcgccaccgccaccgagacggccaccaagcgccaggagaccugggacugguucuccuggcuguuccugcccagcgaguccaagaaccaccuccacaccacgacccagauggccggcaccagcuccaacaccaucagcgccggcugggagcccaacgaggagaacgaggacgagcgggaccgccaccuguccuucagcggguccggcaucgacgacgacgaggacuucaucagcuccacgaucagcaccaccccgcgggccuucgaccacaccaagcagaaccaggacuggacgcaguggaaccccucccacagcaaccccgaggugcugcuccagaccaccacccgcaugaccgacguggaccggaacgggacgaccgcguacgagggcaacuggaaccccgaggcccacccgccccugauccaccacgagcaccacgaggaggaggagacgccccacuccaccagcaccauccaggccacccccuccagcaccaccgaggagacggccacccagaaggagcagugguucggcaaccgcuggcacgagggguaccggcagaccccgaaggaggacagccacuccaccacgggcaccgccgcggccagcgcccacaccucccaccccaugcaggggcgcaccacgcccagccccgaggacuccagcuggaccgacuucuucaacccgaucucccaccccaugggccgggggcaccaggccggccgccggauggacauggacagcucccacagcaucacccugcagcccaccgccaacccgaacacgggccucgucgaggaccuggaccgcaccgggccccuguccaugaccacccagcagagcaacucccagagcuucuccacgagccacgagggccucgaggaggacaaggaccaccccaccaccuccacccugacgagcagcaaccgcaacgacgugaccgggggccggcgcgaccccaaccacuccgaggggagcaccacccugcucgagggcuacacgucccacuacccgcacaccaaggagagccggaccuucauccccgugaccuccgcgaagacgggcagcuucggggucaccgccgugaccgugggcgacuccaacagcaacgucaaccgcucccugagcggggaccaggacaccuuccaccccuccggcgggagccacaccacgcacggcuccgagagcgacggccacucccacgggagccaggagggcggggccaacaccaccuccggccccauccggaccccgcagauccccgaguggcugaucauccucgccagccugcuggcgcucgcccugauccuggccgugugcaucgccgugaacucccgccggcgcugcggccagaagaagaagcucgucaucaacagcgggaacggcgccguggaggaccggaagcccagcgggcugaacggcgaggcguccaagagccaggagauggugcaccuggucaacaaggaguccagcgagacgcccgaccaguucaugaccgccgacgagacccgcaaccuccagaacguggacaugaagaucggggucuga

SEQ ID NO: 870 - RNA, 2229 nt, Artificial Sequence
  derived and/or modified sequence opt2 from CD44_Isoform_1__Homo_sapiens__CCDS7897.1
auggacaaguucugguggcacgccgccuggggccucugccucgucccccucucccucgcccagaucgaccucaacaucaccugccgcuucgccggcgucuuccacgucgagaagaacggccgcuacuccaucucccgcaccgaggccgccgaccucugcaaggccuucaacuccacccuccccaccauggcccagauggagaaggcccucuccaucggcuucgagaccugccgcuacggcuucaucgagggccacgucgucaucccccgcauccaccccaacuccaucugcgccgccaacaacaccggcgucuacauccucaccuccaacaccucccaguacgacaccuacugcuucaacgccuccgccccccccgaggaggacugcaccuccgucaccgaccuccccaacgccuucgacggccccaucaccaucaccaucgucaaccgcgacggcacccgcuacguccagaagggcgaguaccgcaccaaccccgaggacaucuaccccuccaaccccaccgacgacgacgucuccuccggcuccuccuccgagcgcuccuccaccuccggcggcuacaucuucuacaccuucuccaccguccaccccauccccgacgaggacucccccuggaucaccgacuccaccgaccgcauccccgccaccacccucauguccaccuccgccaccgccaccgagaccgccaccaagcgccaggagaccugggacugguucuccuggcucuuccuccccuccgaguccaagaaccaccuccacaccaccacccagauggccggcaccuccuccaacaccaucuccgccggcugggagcccaacgaggagaacgaggacgagcgcgaccgccaccucuccuucuccggcuccggcaucgacgacgacgaggacuucaucuccuccaccaucuccaccaccccccgcgccuucgaccacaccaagcagaaccaggacuggacccaguggaaccccucccacuccaaccccgagguccuccuccagaccaccacccgcaugaccgacgucgaccgcaacggcaccaccgccuacgagggcaacuggaaccccgaggcccaccccccccucauccaccacgagcaccacgaggaggaggagaccccccacuccaccuccaccauccaggccacccccuccuccaccaccgaggagaccgccacccagaaggagcagugguucggcaaccgcuggcacgagggcuaccgccagacccccaaggaggacucccacuccaccaccggcaccgccgccgccuccgcccacaccucccaccccaugcagggccgcaccacccccucccccgaggacuccuccuggaccgacuucuucaaccccaucucccaccccaugggccgcggccaccaggccggccgccgcauggacauggacuccucccacuccaucacccuccagcccaccgccaaccccaacaccggccucgucgaggaccucgaccgcaccggcccccucuccaugaccacccagcaguccaacucccaguccuucuccaccucccacgagggccucgaggaggacaaggaccaccccaccaccuccacccucaccuccuccaaccgcaacgacgucaccggcggccgccgcgaccccaaccacuccgagggcuccaccacccuccucgagggcuacaccucccacuacccccacaccaaggagucccgcaccuucauccccgucaccuccgccaagaccggcuccuucggcgucaccgccgucaccgucggcgacuccaacuccaacgucaaccgcucccucuccggcgaccaggacaccuuccaccccuccggcggcucccacaccacccacggcuccgaguccgacggccacucccacggcucccaggagggcggcgccaacaccaccuccggccccauccgcaccccccagauccccgaguggcucaucauccucgccucccuccucgcccucgcccucauccucgccgucugcaucgccgucaacucccgccgccgcugcggccagaagaagaagcucgucaucaacuccggcaacggcgccgucgaggaccgcaagcccuccggccucaacggcgaggccuccaagucccaggagaugguccaccucgucaacaaggaguccuccgagacccccgaccaguucaugaccgccgacgagacccgcaaccuccagaacgucgacaugaagaucggcgucuga

SEQ ID NO: 871 - RNA, 2229 nt, Artificial Sequence
  derived and/or modified sequence opt3 from CD44_Isoform_1__Homo_sapiens__CCDS7897.1
auggacaaguucugguggcacgccgcuuggggccugugccucgugccccuuagccuggcacagaucgauuugaacauuaccuguagauuugccggggucuuccauguugagaaaaauggaagguacuccauaucucggacagaagcggcugacuuaugcaaggccuuuaacucaacucugccuacgauggcacaaauggagaaagcccuaaguaucgguuucgaaaccugucgcuauggcuuuauugaggggcacgugguaaucccacguauucauccgaauagcaucugcgcugcaaacaauacaggaguguacauacucacuuccaacaccucucaguaugauacauacuguuucaaugccucggcucccccugaagaggacugcaccucagucacugaucugccaaacgccuuugacggccccaucacaauuaccaucgugaaucgagaugguacgagauauguucagaagggggaguacaggacuaacccugaagacauuuauccaagcaaucccaccgaugacgaugugaguuccggaucuagcuccgagcggucaaguacaagcggcggcuacaucuucuacacuuuuucuaccguccacccuauaccagacgaagauuccccguggauuacagacucaaccgaccgcauccccgcgacgacucuuaugagcacaagugcaaccgccacugagacagcuaccaaaagacaggagacgugggauugguucucuuggcuguuuuugccuuccgaaagcaagaaccaucuccacaccacaacucaaauggccgggaccucgucuaauacaauuuccgcaggaugggagccaaacgaagagaaugaagacgagagggaucggcaccugucauucagugguagcggcaucgacgaugacgaggauuuuaucuccucuacuauuagcaccacaccccgcgcuuucgaccauaccaagcagaaccaggauuggacucaguggaacccuucacacaguaauccagaagugcugcuccaaacgacaacccgaaugacugacguagauagaaacgggaccacagccuaugagggaaauuggaaccccgaagcgcauccgccuuuaauacaccacgagcaucacgaagaggaggaaacuccccauuccacuagcacaauccaggccacgccaucuucaaccacugaggaaacagcaacccagaaagagcagugguucggcaauagguggcacgaagguuaccggcaaacaccuaaggaggacagucauagcacuaccgggacggcugccgcuuccgcccacaccucucaccccaugcagggacguacaacuccaucgcccgaggacagcuccuggaccgacuuuuucaacccuauuucacauccaaugggccgcggccaccaggcagggagaaggauggauauggauaguucucauagcaucacacugcaaccgacugccaaucccaacaccggacuuguugaagacuuggaucggacggguccucuguccaugacaacccagcagucaaauagccagucuuuuuccaccagucacgagggccuagaagaggacaaagaucacccaacaaccagcacucucaccucuuccaaccgaaaugacgugacagggggacgcagagaucccaaccauucagagggcaguacgacccugcuugaagguuauacuagccacuacccucauacaaaggagucgaggaccuucauaccagucacauccgcuaaaacugggucuuuuggcgugaccgcggugacggucggagacagcaauucaaacguuaaucggagucuguccggcgaucaagacacauuccaccccucugggggaagccauaccacucacgguuccgaaucagauggccacagccaugggagucaggagggaggcgcaaacaccacaucugguccgauucgcacuccucagaucccagaaugguugaucauucucgccucccuguuagcucuggcccucauccuugcaguguguauugccguaaacagcagaaggcguugcgggcagaagaagaaacuggugauaaauucgggcaacggagcugucgaggaccggaagcccucaggcuugaauggggaggccucuaaaagucaagaaauggugcaccuaguuaacaaggaguccagcgaaaccccugaccaguuuaugacagcagaugagacgcgaaaucugcagaacguggacaugaaaaucggagucuga

SEQ ID NO: 872 - RNA, 2229 nt, Artificial Sequence
  derived and/or modified sequence opt4 from CD44_Isoform_1__Homo_sapiens__CCDS7897.1
auggacaaguucugguggcacgccgccuggggccugugccuggugccccugagccuggcccagaucgaccugaacaucaccugcagauucgccggcguguuccacguggagaagaacggcagauacagcaucagcagaaccgaggccgccgaccugugcaaggccuucaacagcacccugcccaccauggcccagauggagaaggcccugagcaucggcuucgagaccugcagauacggcuucaucgagggccacguggugauccccagaauccaccccaacagcaucugcgccgccaacaacaccggcguguacauccugaccagcaacaccagccaguacgacaccuacugcuucaacgccagcgccccccccgaggaggacugcaccagcgugaccgaccugcccaacgccuucgacggccccaucaccaucaccaucgugaacagagacggcaccagauacgugcagaagggcgaguacagaaccaaccccgaggacaucuaccccagcaaccccaccgacgacgacgugagcagcggcagcagcagcgagagaagcagcaccagcggcggcuacaucuucuacaccuucagcaccgugcaccccauccccgacgaggacagccccuggaucaccgacagcaccgacagaauccccgccaccacccugaugagcaccagcgccaccgccaccgagaccgccaccaagagacaggagaccugggacugguucagcuggcuguuccugcccagcgagagcaagaaccaccugcacaccaccacccagauggccggcaccagcagcaacaccaucagcgccggcugggagcccaacgaggagaacgaggacgagagagacagacaccugagcuucagcggcagcggcaucgacgacgacgaggacuucaucagcagcaccaucagcaccacccccagagccuucgaccacaccaagcagaaccaggacuggacccaguggaaccccagccacagcaaccccgaggugcugcugcagaccaccaccagaaugaccgacguggacagaaacggcaccaccgccuacgagggcaacuggaaccccgaggcccaccccccccugauccaccacgagcaccacgaggaggaggagaccccccacagcaccagcaccauccaggccacccccagcagcaccaccgaggagaccgccacccagaaggagcagugguucggcaacagauggcacgagggcuacagacagacccccaaggaggacagccacagcaccaccggcaccgccgccgccagcgcccacaccagccaccccaugcagggcagaaccacccccagccccgaggacagcagcuggaccgacuucuucaaccccaucagccaccccaugggcagaggccaccaggccggcagaagaauggacauggacagcagccacagcaucacccugcagcccaccgccaaccccaacaccggccugguggaggaccuggacagaaccggcccccugagcaugaccacccagcagagcaacagccagagcuucagcaccagccacgagggccuggaggaggacaaggaccaccccaccaccagcacccugaccagcagcaacagaaacgacgugaccggcggcagaagagaccccaaccacagcgagggcagcaccacccugcuggagggcuacaccagccacuacccccacaccaaggagagcagaaccuucauccccgugaccagcgccaagaccggcagcuucggcgugaccgccgugaccgugggcgacagcaacagcaacgugaacagaagccugagcggcgaccaggacaccuuccaccccagcggcggcagccacaccacccacggcagcgagagcgacggccacagccacggcagccaggagggcggcgccaacaccaccagcggccccaucagaaccccccagauccccgaguggcugaucauccuggccagccugcuggcccuggcccugauccuggccgugugcaucgccgugaacagcagaagaagaugcggccagaagaagaagcuggugaucaacagcggcaacggcgccguggaggacagaaagcccagcggccugaacggcgaggccagcaagagccaggagauggugcaccuggugaacaaggagagcagcgagacccccgaccaguucaugaccgccgacgagaccagaaaccugcagaacguggacaugaagaucggcguguga

SEQ ID NO: 873 - RNA, 2229 nt, Artificial Sequence
  derived and/or modified sequence opt5 from CD44_Isoform_1__Homo_sapiens__CCDS7897.1
auggacaaguucugguggcacgccgcuuggggccugugccucgugccccugagccuugcccagaucgaucugaacauuaccuguagauuugcgggggucuuccauguugagaaaaauggacgguacuccaucucucgcacagaagcugccgaccucugcaaggccuuuaacagcacgcugccuaccauggcucaaauggagaaagcccuuuccauuggcuucgaaacauguagauauggguuuaucgagggacacguggugauuccgcggauccaucccaauucuaucugcgcugccaacaauaccggcgucuacauucugacaagcaacaccucccaguaugauacauacuguuucaaugcgucugccccucccgaagaggacugcaccagcgugacggaucucccuaacgcuuuugacgggcccaucaccauuacaaucguuaaucgcgauggaaccagauaugugcagaagggcgaguaccggacaaacccugaagacauuuauccguccaaucccaccgaugacgaugucagcucuggcuccagcucugagcgcuccagcacgucugggggauacaucuucuacacauuuuccaccgugcacccuauucccgacgaagauagcccuuggaucacagacuccaccgacagaauccccgccaccacacugaugucuacgagcgcuaccgccacagagaccgcgacaaaacggcaggagaccugggauugguucuccuggcuguuucucccgagcgaaucuaagaaccaucugcacacgacaacccaaauggccggcaccuccagcaauacaauuucugcugggugggagccuaacgaagagaaugaagacgagcgcgauagacaccuuagcuucuccggaucuggcaucgacgaugacgaggauuuuauuagcuccaccaucagcacaacgccccgggccuucgaccauaccaagcagaaccaggauuggacacaguggaacccuucucacuccaaucccgaaguucugcuccaaaccacaacccgcaugacggacguggauagaaacgggaccacagcuuaugagggaaauuggaaccccgaagcccauccuccgcugauucaccacgagcaucacgaagaggaggaaacaccccauagcaccucuaccauccaggccacgccuuccagcacaaccgaggaaacagcuacccagaaagagcagugguucggcaaucgguggcacgaaggcuaccgccaaacccccaaggaggacucccauucuacaacggggaccgcggccgcuagcgcccacacaucccacccuaugcagggaagaaccacacccucuccggaggacagcuccuggaccgacuuuuucaacccuaucagccaucccaugggccgggggcaccaggccggaagacgcauggauauggauucuucccauagcauuacgcuucaaccuacagcuaaucccaacaccggccuggucgaagaccucgaucggaccgggccucugucuaugacaacccagcaguccaauagccagucuuuuagcacaucccacgagggacuggaagaggacaaagaucaccccacgaccagcacacucaccucuuccaacagaaaugacgugacaggcggccgccgggauccgaaccauagcgagggguccaccacgcugcuugaaggauauaccucucacuacccucauacaaaggagagcagaaccuucauccccgugacauccgccaaaaccggcucuuuuggggucacagcgguuaccgugggagacagcaauuccaacgugaaucgcucucugagcggcgaucaagacacguuccaccccuccgggggcagccauacaacccacggaucugaauccgauggccacagccaugggucucaggagggaggcgcuaacaccacauccgggccuauucggaccccgcagauccccgaauggcucauuauccuggccagccuucuggcccucgcucugauccuggccgucuguauugcugugaacucuagacgccggugcggacagaagaagaaacucguuaucaauuccggcaacggggccguggaggacagaaagccuagcggccugaauggagaggcguccaaaagccaagaaaugguccaccuugugaacaaggagucuagcgaaacgcccgaccaguuuaugacagccgaugagacccgcaaucugcagaacguugacaugaaaauuggcguguga

SEQ ID NO: 874 - protein, 699 aa, Artificial Sequence
  CD44_Isoform_6__Homo_sapiens__P16070-6
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 875 - RNA, 2100 nt, Artificial Sequence
  CD44_Isoform_6__Homo_sapiens__XM_006718388.1
auggacaaguuuugguggcacgcagccuggggacucugccucgugccgcugagccuggcgcagaucgauuugaauauaaccugccgcuuugcagguguauuccacguggagaaaaauggucgcuacagcaucucucggacggaggccgcugaccucugcaaggcuuucaauagcaccuugcccacaauggcccagauggagaaagcucugagcaucggauuugagaccugcagguauggguucauagaagggcacguggugauuccccggauccaccccaacuccaucugugcagcaaacaacacagggguguacauccucacauccaacaccucccaguaugacacauauugcuucaaugcuucagcuccaccugaagaagauuguacaucagucacagaccugcccaaugccuuugauggaccaauuaccauaacuauuguuaaccgugauggcacccgcuauguccagaaaggagaauacagaacgaauccugaagacaucuaccccagcaacccuacugaugaugacgugagcagcggcuccuccagugaaaggagcagcacuucaggagguuacaucuuuuacaccuuuucuacuguacaccccaucccagacgaagacagucccuggaucaccgacagcacagacagaaucccugcuaccacuuugaugagcacuagugcuacagcaacugagacagcaaccaagaggcaagaaaccugggauugguuuucaugguuguuucuaccaucagagucaaagaaucaucuucacacaacaacacaaauggcugguacgucuucaaauaccaucucagcaggcugggagccaaaugaagaaaaugaagaugaaagagacagacaccucaguuuuucuggaucaggcauugaugaugaugaagauuuuaucuccagcaccauuucaaccacaccacgggcuuuugaccacacaaaacagaaccaggacuggacccaguggaacccaagccauucaaauccggaagugcuacuucagacaaccacaaggaugacugauguagacagaaauggcaccacugcuuaugaaggaaacuggaacccagaagcacacccuccccucauucaccaugagcaucaugaggaagaagagaccccacauucuacaagcacaacagcuucagcucauaccagccauccaaugcaaggaaggacaacaccaagcccagaggacaguuccuggacugauuucuucaacccaaucucacaccccaugggacgaggucaucaagcaggaagaaggauggauauggacuccagucauaguauaacgcuucagccuacugcaaauccaaacacagguuugguggaagauuuggacaggacaggaccucuuucaaugacaacgcagcagaguaauucucagagcuucucuacaucacaugaaggcuuggaagaagauaaagaccauccaacaacuucuacucugacaucaagcaauaggaaugaugucacagguggaagaagagacccaaaucauucugaaggcucaacuacuuuacuggaagguuauaccucucauuacccacacacgaaggaaagcaggaccuucaucccagugaccucagcuaagacuggguccuuuggaguuacugcaguuacuguuggagauuccaacucuaaugucaaucguuccuuaucaggagaccaagacacauuccaccccaguggggggucccauaccacucauggaucugaaucagauggacacucacaugggagucaagaagguggagcaaacacaaccucugguccuauaaggacaccccaaauuccagaauggcugaucaucuuggcaucccucuuggccuuggcuuugauucuugcaguuugcauugcagucaacagucgaagaaggugugggcagaagaaaaagcuagugaucaacaguggcaauggagcuguggaggacagaaagccaaguggacucaacggagaggccagcaagucucaggaaauggugcauuuggugaacaaggagucgucagaaacuccagaccaguuuaugacagcugaugagacaaggaaccugcagaauguggacaugaagauugggguguaa

SEQ ID NO: 876 - RNA, 2100 nt, Artificial Sequence
  derived and/or modified sequence opt1 from CD44_Isoform_6__Homo_sapiens__XM_006718388.1
auggacaaguucugguggcacgccgccuggggccugugccucgugccccugagccuggcgcagaucgaccucaacaucacgugccgcuucgccggggucuuccacguggagaagaacggccgguacuccaucagccgcaccgaggccgccgaccugugcaaggccuucaacuccacccugccgaccauggcgcagauggagaaggcccucagcaucggguucgagaccugccgguacggcuucaucgaggggcacguggucaucccccgcauccaccccaacuccaucugcgccgccaacaacaccggcguguacauccugacgagcaacaccucccaguacgacaccuacugcuucaacgcgagcgcgcccccggaggaggacugcaccuccgugacggaccugcccaacgccuucgacggccccaucaccaucaccaucgucaaccgggacgggacccgcuacgugcagaagggcgaguaccggacgaaccccgaggacaucuacccgagcaaccccaccgacgacgacguguccagcggguccagcuccgagcgcagcuccaccagcggcggguacaucuucuacaccuucuccacgguccaccccauccccgacgaggacagcccguggaucaccgacagcaccgaccggauccccgccaccacgcucauguccaccagcgccaccgccaccgagacggccaccaagcgccaggagaccugggacugguucuccuggcuguuccugcccagcgaguccaagaaccaccuccacaccacgacccagauggccggcaccagcuccaacaccaucagcgccggcugggagcccaacgaggagaacgaggacgagcgggaccgccaccuguccuucagcggguccggcaucgacgacgacgaggacuucaucagcuccacgaucagcaccaccccgcgggccuucgaccacaccaagcagaaccaggacuggacgcaguggaaccccucccacagcaaccccgaggugcugcuccagaccaccacccgcaugaccgacguggaccggaacgggacgaccgcguacgagggcaacuggaaccccgaggcccacccgccccugauccaccacgagcaccacgaggaggaggagacgccccacuccaccagcaccaccgccuccgcccacaccagccaccccaugcagggccgcaccacgccgagccccgaggacuccagcuggaccgacuucuucaaccccaucucccaccccauggggcggggccaccaggccgggcgccggauggacauggacagcucccacagcaucacccugcagccgaccgcgaaccccaacacgggccucgucgaggaccuggaccgcaccgggccccuguccaugaccacccagcagagcaacucccagagcuucuccacgagccacgagggccucgaggaggacaaggaccacccgaccaccuccacccugacgagcuccaaccggaacgacgugaccggcgggcgccgcgaccccaaccacagcgagggcuccaccacccugcucgagggguacacgagccacuacccccacaccaaggagagccggaccuucauccccgugaccuccgccaagacgggcagcuucggggucaccgccgugaccgugggcgacuccaacagcaacgucaaccgcucccugagcggcgaccaggacaccuuccacccguccgggggcagccacacgacccacggguccgagagcgacggccacucccacgggagccaggagggcggcgccaacaccaccuccgggcccauccggacgccccagauccccgaguggcugaucauccucgccagccugcuggcgcucgcccugauccuggccgugugcaucgccgugaacucccgccggcgcugcggccagaagaagaagcucgucaucaacagcgggaacggcgcgguggaggaccggaagccguccggccugaacggggaggccagcaagucccaggagauggugcaccuggucaacaaggagagcagcgagacccccgaccaguucaugaccgccgacgagacccgcaaccuccagaacguggacaugaagaucggcgucuga

SEQ ID NO: 877 - RNA, 2100 nt, Artificial Sequence
  derived and/or modified sequence opt2 from CD44_Isoform_6__Homo_sapiens__XM_006718388.1
auggacaaguucugguggcacgccgccuggggccucugccucgucccccucucccucgcccagaucgaccucaacaucaccugccgcuucgccggcgucuuccacgucgagaagaacggccgcuacuccaucucccgcaccgaggccgccgaccucugcaaggccuucaacuccacccuccccaccauggcccagauggagaaggcccucuccaucggcuucgagaccugccgcuacggcuucaucgagggccacgucgucaucccccgcauccaccccaacuccaucugcgccgccaacaacaccggcgucuacauccucaccuccaacaccucccaguacgacaccuacugcuucaacgccuccgccccccccgaggaggacugcaccuccgucaccgaccuccccaacgccuucgacggccccaucaccaucaccaucgucaaccgcgacggcacccgcuacguccagaagggcgaguaccgcaccaaccccgaggacaucuaccccuccaaccccaccgacgacgacgucuccuccggcuccuccuccgagcgcuccuccaccuccggcggcuacaucuucuacaccuucuccaccguccaccccauccccgacgaggacucccccuggaucaccgacuccaccgaccgcauccccgccaccacccucauguccaccuccgccaccgccaccgagaccgccaccaagcgccaggagaccugggacugguucuccuggcucuuccuccccuccgaguccaagaaccaccuccacaccaccacccagauggccggcaccuccuccaacaccaucuccgccggcugggagcccaacgaggagaacgaggacgagcgcgaccgccaccucuccuucuccggcuccggcaucgacgacgacgaggacuucaucuccuccaccaucuccaccaccccccgcgccuucgaccacaccaagcagaaccaggacuggacccaguggaaccccucccacuccaaccccgagguccuccuccagaccaccacccgcaugaccgacgucgaccgcaacggcaccaccgccuacgagggcaacuggaaccccgaggcccaccccccccucauccaccacgagcaccacgaggaggaggagaccccccacuccaccuccaccaccgccuccgcccacaccucccaccccaugcagggccgcaccacccccucccccgaggacuccuccuggaccgacuucuucaaccccaucucccaccccaugggccgcggccaccaggccggccgccgcauggacauggacuccucccacuccaucacccuccagcccaccgccaaccccaacaccggccucgucgaggaccucgaccgcaccggcccccucuccaugaccacccagcaguccaacucccaguccuucuccaccucccacgagggccucgaggaggacaaggaccaccccaccaccuccacccucaccuccuccaaccgcaacgacgucaccggcggccgccgcgaccccaaccacuccgagggcuccaccacccuccucgagggcuacaccucccacuacccccacaccaaggagucccgcaccuucauccccgucaccuccgccaagaccggcuccuucggcgucaccgccgucaccgucggcgacuccaacuccaacgucaaccgcucccucuccggcgaccaggacaccuuccaccccuccggcggcucccacaccacccacggcuccgaguccgacggccacucccacggcucccaggagggcggcgccaacaccaccuccggccccauccgcaccccccagauccccgaguggcucaucauccucgccucccuccucgcccucgcccucauccucgccgucugcaucgccgucaacucccgccgccgcugcggccagaagaagaagcucgucaucaacuccggcaacggcgccgucgaggaccgcaagcccuccggccucaacggcgaggccuccaagucccaggagaugguccaccucgucaacaaggaguccuccgagacccccgaccaguucaugaccgccgacgagacccgcaaccuccagaacgucgacaugaagaucggcgucuga

SEQ ID NO: 878 - RNA, 2100 nt, Artificial Sequence
  derived and/or modified sequence opt3 from CD44_Isoform_6__Homo_sapiens__XM_006718388.1
auggacaaguucugguggcacgccgcuuggggccugugccucgugccccuuagccuggcacagaucgauuugaacauuaccuguagauuugccggggucuuccauguugagaaaaauggaagguacuccauaucucggacagaagcggcugacuuaugcaaggccuuuaacucaacucugccuacgauggcacaaauggagaaagcccuaaguaucgguuucgaaaccugucgcuauggcuuuauugaggggcacgugguaaucccacguauucauccgaauagcaucugcgcugcaaacaauacaggaguguacauacucacuuccaacaccucucaguaugauacauacuguuucaaugccucggcucccccugaagaggacugcaccucagucacugaucugccaaacgccuuugacggccccaucacaauuaccaucgugaaucgagaugguacgagauauguucagaagggggaguacaggacuaacccugaagacauuuauccaagcaaucccaccgaugacgaugugaguuccggaucuagcuccgagcggucaaguacaagcggcggcuacaucuucuacacuuuuucuaccguccacccuauaccagacgaagauuccccguggauuacagacucaaccgaccgcauccccgcgacgacucuuaugagcacaagugcaaccgccacugagacagcuaccaaaagacaggagacgugggauugguucucuuggcuguuuuugccuuccgaaagcaagaaccaucuccacaccacaacucaaauggccgggaccucgucuaauacaauuuccgcaggaugggagccaaacgaagagaaugaagacgagagggaucggcaccugucauucagugguagcggcaucgacgaugacgaggauuuuaucuccucuacuauuagcaccacaccccgcgcuuucgaccauaccaagcagaaccaggauuggacucaguggaacccuucacacaguaauccagaagugcugcuccaaacgacaacccgaaugacugacguagauagaaacgggaccacagccuaugagggaaauuggaaccccgaagcgcauccgccuuuaauacaccacgagcaucacgaagaggaggaaacuccccauuccaccagcacaacggccucugcacacaccucacauccaaugcagggcaggacuacaccuagucccgaggacagcuccuggaccgacuucuuuaauccaaucucucaccccaugggucgggggcaccaggcuggacgucgcauggauauggacucgagccauuccauuacacugcagccuacugccaacccaaauaccggccuuguugaagauuuggacagaacgggcccgcugucaaugaccacacaacagaguaacucucagagcuucuccacuucacacgaggggcuagaagaggauaaagaccaucccaccacaagcacucucaccucuuccaauaggaacgaugugacgggaggucggcgagacccuaaucacagugagggcagcacaacccugcuugaaggguacacuucucacuauccacauacaaaggagucccgcaccuuuauccccgucacuucagcuaaaaccggaaguuucggcgugacagccgugacggucggugauagcaacucgaauguuaacagaucccugucuggggaccaagauaccuuucacccuagcggcggaucacauacuacacacggcagugaauccgacgggcauucucacggaagccaggaggguggcgcaaauaccacauccgggccaauaaggacuccccagauuccggagugguugaucauccucgccucacuguuagcucuggcgcucauucuugcaguguguaucgccguaaacagccggcgcagaugcggacagaagaaaaagcuggugauuaacaguggcaauggugcugucgaagauaggaagccuucuggguugaacggcgaggccuccaaaagccaagaaauggugcaccuaguuaauaaggagucgucagaaaccccagaccaguucaugacggcagacgagacacguaaccugcagaauguggauaugaaaauaggagucuga

SEQ ID NO: 879 - RNA, 2100 nt, Artificial Sequence
  derived and/or modified sequence opt4 from CD44_Isoform_6__Homo_sapiens__XM_006718388.1
auggacaaguucugguggcacgccgccuggggccugugccuggugccccugagccuggcccagaucgaccugaacaucaccugcagauucgccggcguguuccacguggagaagaacggcagauacagcaucagcagaaccgaggccgccgaccugugcaaggccuucaacagcacccugcccaccauggcccagauggagaaggcccugagcaucggcuucgagaccugcagauacggcuucaucgagggccacguggugauccccagaauccaccccaacagcaucugcgccgccaacaacaccggcguguacauccugaccagcaacaccagccaguacgacaccuacugcuucaacgccagcgccccccccgaggaggacugcaccagcgugaccgaccugcccaacgccuucgacggccccaucaccaucaccaucgugaacagagacggcaccagauacgugcagaagggcgaguacagaaccaaccccgaggacaucuaccccagcaaccccaccgacgacgacgugagcagcggcagcagcagcgagagaagcagcaccagcggcggcuacaucuucuacaccuucagcaccgugcaccccauccccgacgaggacagccccuggaucaccgacagcaccgacagaauccccgccaccacccugaugagcaccagcgccaccgccaccgagaccgccaccaagagacaggagaccugggacugguucagcuggcuguuccugcccagcgagagcaagaaccaccugcacaccaccacccagauggccggcaccagcagcaacaccaucagcgccggcugggagcccaacgaggagaacgaggacgagagagacagacaccugagcuucagcggcagcggcaucgacgacgacgaggacuucaucagcagcaccaucagcaccacccccagagccuucgaccacaccaagcagaaccaggacuggacccaguggaaccccagccacagcaaccccgaggugcugcugcagaccaccaccagaaugaccgacguggacagaaacggcaccaccgccuacgagggcaacuggaaccccgaggcccaccccccccugauccaccacgagcaccacgaggaggaggagaccccccacagcaccagcaccaccgccagcgcccacaccagccaccccaugcagggcagaaccacccccagccccgaggacagcagcuggaccgacuucuucaaccccaucagccaccccaugggcagaggccaccaggccggcagaagaauggacauggacagcagccacagcaucacccugcagcccaccgccaaccccaacaccggccugguggaggaccuggacagaaccggcccccugagcaugaccacccagcagagcaacagccagagcuucagcaccagccacgagggccuggaggaggacaaggaccaccccaccaccagcacccugaccagcagcaacagaaacgacgugaccggcggcagaagagaccccaaccacagcgagggcagcaccacccugcuggagggcuacaccagccacuacccccacaccaaggagagcagaaccuucauccccgugaccagcgccaagaccggcagcuucggcgugaccgccgugaccgugggcgacagcaacagcaacgugaacagaagccugagcggcgaccaggacaccuuccaccccagcggcggcagccacaccacccacggcagcgagagcgacggccacagccacggcagccaggagggcggcgccaacaccaccagcggccccaucagaaccccccagauccccgaguggcugaucauccuggccagccugcuggcccuggcccugauccuggccgugugcaucgccgugaacagcagaagaagaugcggccagaagaagaagcuggugaucaacagcggcaacggcgccguggaggacagaaagcccagcggccugaacggcgaggccagcaagagccaggagauggugcaccuggugaacaaggagagcagcgagacccccgaccaguucaugaccgccgacgagaccagaaaccugcagaacguggacaugaagaucggcguguga

SEQ ID NO: 880 - RNA, 2100 nt, Artificial Sequence
  derived and/or modified sequence opt5 from CD44_Isoform_6__Homo_sapiens__XM_006718388.1
auggacaaguucugguggcacgccgcuuggggccugugccucgugccccugagccuugcccagaucgaucugaacauuaccuguagauuugcgggggucuuccauguugagaaaaauggacgguacuccaucucucgcacagaagcugccgaccucugcaaggccuuuaacagcacgcugccuaccauggcucaaauggagaaagcccuuuccauuggcuucgaaacauguagauauggguuuaucgagggacacguggugauuccgcggauccaucccaauucuaucugcgcugccaacaauaccggcgucuacauucugacaagcaacaccucccaguaugauacauacuguuucaaugcgucugccccucccgaagaggacugcaccagcgugacggaucucccuaacgcuuuugacgggcccaucaccauuacaaucguuaaucgcgauggaaccagauaugugcagaagggcgaguaccggacaaacccugaagacauuuauccguccaaucccaccgaugacgaugucagcucuggcuccagcucugagcgcuccagcacgucugggggauacaucuucuacacauuuuccaccgugcacccuauucccgacgaagauagcccuuggaucacagacuccaccgacagaauccccgccaccacacugaugucuacgagcgcuaccgccacagagaccgcgacaaaacggcaggagaccugggauugguucuccuggcuguuucucccgagcgaaucuaagaaccaucugcacacgacaacccaaauggccggcaccuccagcaauacaauuucugcugggugggagccuaacgaagagaaugaagacgagcgcgauagacaccuuagcuucuccggaucuggcaucgacgaugacgaggauuuuauuagcuccaccaucagcacaacgccccgggccuucgaccauaccaagcagaaccaggauuggacacaguggaacccuucucacuccaaucccgaaguucugcuccaaaccacaacccgcaugacggacguggauagaaacgggaccacagcuuaugagggaaauuggaaccccgaagcccauccuccgcugauucaccacgagcaucacgaagaggaggaaacaccccauagcaccucuaccacggccuccgcucacacaagccauccuaugcagggccggaccacacccuccccugaggacucuagcuggaccgacuucuuuaaucccaucucccacccgaugggccgcgggcaccaggcgggaagacggauggauauggacucuagccauuccaucacccuucagccuacagccaaccccaauacgggccuggucgaagaucucgacagaaccgggccucugagcaugacaacccaacagucuaacucccagagcuucucuacaucccacgagggacuggaagaggauaaagaccaucccaccacgagcacacucaccucuagcaaucgcaacgaugugaccggcgggcggagagacccuaaucacuccgagggaagcacaacccugcuugaaggcuacacaucucacuauccccauacgaaggagucccgcaccuuuauuccggugacaagcgcuaaaaccggcuccuucggggucacagccguuaccgugggagauucuaacagcaaugugaaccggucccugucuggcgaccaagauacguuucacccuagcgggggaucccauaccacacacggcucugaaagcgacgggcauucccacggcagccaggagggaggcgccaauaccacaucugggcccaucagaacaccccagauuccugaguggcucaucauucuggcuucccuucuggcccucgcgcugauccuggcugucuguaucgccgugaacagccgccggagaugcggacagaagaaaaagcucguuauuaacucuggcaauggggccguggaagaucgcaagccguccggacugaacggcgaggcuagcaaaucucaagaaaugguccaccuugugaauaaggaguccagcgaaacccccgaccaguucaugaccgccgacgagacgcggaaccugcagaauguugauaugaaaaucgggguguga

SEQ ID NO: 881 - protein, 458 aa, Artificial Sequence
  CD4__Homo_sapiens__P01730
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 882 - RNA, 1377 nt, Artificial Sequence
  CD4__Homo_sapiens__AAA35572
augaaccggggagucccuuuuaggcacuugcuucuggugcugcaacuggcgcuccucccagcagccacucagggaaagaaaguggugcugggcaaaaaaggggauacaguggaacugaccuguacagcuucccagaagaagagcauacaauuccacuggaaaaacuccaaccagauaaagauucugggaaaucagggcuccuucuuaacuaaagguccauccaagcugaaugaucgcgcugacucaagaagaagccuuugggaccaaggaaacuucccccugaucaucaagaaucuuaagauagaagacucagauacuuacaucugugaaguggaggaccagaaggaggaggugcaauugcuaguguucggauugacugccaacucugacacccaccugcuucaggggcagagccugacccugaccuuggagagccccccugguaguagccccucagugcaauguaggaguccaagggguaaaaacauacagggggggaagacccucuccgugucucagcuggagcuccaggauaguggcaccuggacaugcacugucuugcagaaccagaagaagguggaguucaaaauagacaucguggugcuagcuuuccagaaggccuccagcauagucuauaagaaagagggggaacagguggaguucuccuucccacucgccuuuacaguugaaaagcugacgggcaguggcgagcugugguggcaggcggagagggcuuccuccuccaagucuuggaucaccuuugaccugaagaacaaggaagugucuguaaaacggguuacccaggacccuaagcuccagaugggcaagaagcucccgcuccaccucacccugccccaggccuugccucaguaugcuggcucuggaaaccucacccuggcccuugaagcgaaaacaggaaaguugcaucaggaagugaaccugguggugaugagagccacucagcuccagaaaaauuugaccugugagguguggggacccaccuccccuaagcugaugcugagcuugaaacuggagaacaaggaggcaaaggucucgaagcgggagaaggcggugugggugcugaacccugaggcggggauguggcagugucugcugagugacucgggacagguccugcuggaauccaacaucaagguucugcccacaugguccaccccggugcagccaauggcccugauugugcuggggggcgucgccggccuccugcuuuucauugggcuaggcaucuucuucugugucaggugccggcaccgaaggcgccaagcagagcggaugucucagaucaagagacuccucagugagaagaagaccugccagugcccucaccgguuucagaagacauguagccccauuuga

SEQ ID NO: 883 - RNA, 1377 nt, Artificial Sequence
  derived and/or modified sequence opt1 from CD4__Homo_sapiens__AAA35572
augaaccgcggcgugcccuuccggcaccuccuccugguccugcagcucgcccugcugccggccgcgacccaggggaagaagguggugcucggcaagaagggggacaccgucgagcugacgugcaccgccagccagaagaaguccauccaguuccacuggaagaacagcaaccagaucaagauccugggcaaccagggguccuuccucaccaagggccccagcaagcugaacgaccgcgccgacucccggcgcagccugugggaccagggcaacuucccccucaucaucaagaaccugaagaucgaggacuccgacaccuacaucugcgagguggaggaccagaaggaggaggugcagcugcucgucuucgggcugacggccaacagcgacacccaccuccugcagggccagucccugacccugacccucgagagcccgcccggguccagccccuccgugcagugccggagcccccgcggcaagaacauccagggcgggaagacgcuguccgugagccagcuggagcuccaggacuccggcaccuggaccugcaccguccugcagaaccagaagaagguggaguucaagaucgacaucgugguccuggccuuccagaaggcgagcuccaucguguacaagaaggagggggagcaggucgaguucagcuucccccucgccuucacgguggagaagcugaccggcagcggggagcugugguggcaggccgagcgggccuccagcuccaagagcuggaucaccuucgaccucaagaacaaggagguguccgugaagcgcgucacccaggacccgaagcugcagaugggcaagaagcugccccuccaccugacgcugccccaggcgcucccccaguacgccggcagcgggaaccugacccuggcccucgaggccaagaccggcaagcugcaccaggaggugaaccugguggucaugcgggccacccagcuccagaagaaccugacgugcgaggugugggggccgaccucccccaagcugaugcucagccugaagcuggagaacaaggaggcgaagguguccaagcgcgagaaggccgucugggugcucaaccccgaggccggcauguggcagugccugcugagcgacuccgggcagguccugcucgagagcaacaucaaggugcugcccaccugguccaccccggugcagcccauggcccugaucguccucggcggcguggccgggcugcugcuguucaucggccuggggaucuucuucugcgugcggugccgccaccggcgccggcaggcggagcgcaugagccagaucaagcggcugcucuccgagaagaagacgugccagugcccccaccgcuuccagaagaccugcagccccaucuga

SEQ ID NO: 884 - RNA, 1377 nt, Artificial Sequence
  derived and/or modified sequence opt2 from CD4__Homo_sapiens__AAA35572
augaaccgcggcguccccuuccgccaccuccuccucguccuccagcucgcccuccuccccgccgccacccagggcaagaaggucguccucggcaagaagggcgacaccgucgagcucaccugcaccgccucccagaagaaguccauccaguuccacuggaagaacuccaaccagaucaagauccucggcaaccagggcuccuuccucaccaagggccccuccaagcucaacgaccgcgccgacucccgccgcucccucugggaccagggcaacuucccccucaucaucaagaaccucaagaucgaggacuccgacaccuacaucugcgaggucgaggaccagaaggaggagguccagcuccucgucuucggccucaccgccaacuccgacacccaccuccuccagggccagucccucacccucacccucgaguccccccccggcuccucccccuccguccagugccgcuccccccgcggcaagaacauccagggcggcaagacccucuccgucucccagcucgagcuccaggacuccggcaccuggaccugcaccguccuccagaaccagaagaaggucgaguucaagaucgacaucgucguccucgccuuccagaaggccuccuccaucgucuacaagaaggagggcgagcaggucgaguucuccuucccccucgccuucaccgucgagaagcucaccggcuccggcgagcucugguggcaggccgagcgcgccuccuccuccaaguccuggaucaccuucgaccucaagaacaaggaggucuccgucaagcgcgucacccaggaccccaagcuccagaugggcaagaagcucccccuccaccucacccucccccaggcccucccccaguacgccggcuccggcaaccucacccucgcccucgaggccaagaccggcaagcuccaccaggaggucaaccucgucgucaugcgcgccacccagcuccagaagaaccucaccugcgaggucuggggccccaccucccccaagcucaugcucucccucaagcucgagaacaaggaggccaaggucuccaagcgcgagaaggccgucuggguccucaaccccgaggccggcauguggcagugccuccucuccgacuccggccagguccuccucgaguccaacaucaagguccuccccaccugguccacccccguccagcccauggcccucaucguccucggcggcgucgccggccuccuccucuucaucggccucggcaucuucuucugcguccgcugccgccaccgccgccgccaggccgagcgcaugucccagaucaagcgccuccucuccgagaagaagaccugccagugcccccaccgcuuccagaagaccugcucccccaucuga

SEQ ID NO: 885 - RNA, 1377 nt, Artificial Sequence
  derived and/or modified sequence opt3 from CD4__Homo_sapiens__AAA35572
augaacagaggcgugcccuucaggcaucugcuccuuguccugcaguuggccuuacugccugcugcaacccaagggaagaaaguugugcuaggaaagaaaggugacacaguagagcucacuugcacggccagccagaagaaauccauccaguuucacuggaaaaauucuaaccagauuaagauacugggcaaucaagggucauuccuuaccaaaggaccaaguaagcugaacgaucgggcggacagccgccgauccuugugggaucagggcaauuuuccgcucaucauuaaaaaccugaagaucgaagacucugauacauacauuugugagguggaagaccagaaagaggaaguccagcugcucguguucgguuuaacugcuaauucggauacccaucugcuucaagggcagucauugacacugacccuagagagucccccuggaagcuccccaucuguucagugccguagccccagaggcaagaacauccagggcgggaagacucucuccgugucacaacuggagcuucaggacaguggaacauggaccuguacgguccugcagaaucaaaagaagguggaauuuaaaauagauaucguaguuuuggccuuccagaaggcaagcucuauuguguauaaaaaggagggugaacaggucgaguuuuccuucccucucgccuuuacuguggagaaacugaccggcucaggggaauuaugguggcaggcugagagggcaagcaguucuaaguccuggaucacauucgaccugaagaacaaagaagugagcgucaagcggguuacucaagauccaaaacuccagaugggaaagaaacuuccccugcacuugacccuaccucaggcccugccacaguacgcuggcucggguaaucucacacuggcccuugaggcgaagaccgggaagcugcaccaagaagugaacuugguagugaugcgcgcaacgcagcuccagaaaaaucugacuugcgaggucuggggaccgacaucucccaaguuaaugcugucccuaaaacucgagaacaaggaagccaaagugucaaagagagagaaggcuguuugggugcugaauccugaagccggcauguggcagugucuuuugagugacagcggccaaguccugcucgaguccaacauuaaagugcugccaaccuggucuacucccguacagccuauggcacuuaucguucugggagggguggcugguuugcuccuguuuauaggcuuagggauuuucuuuugcgucaggugucggcaucgccgaagacaggccgaaaggaugagccagaucaagcggcugcuaucagagaaaaagacaugccaauguccacaccguuuccagaaaaccugcagucccauuuga

SEQ ID NO: 886 - RNA, 1377 nt, Artificial Sequence
  derived and/or modified sequence opt4 from CD4__Homo_sapiens__AAA35572
augaacagaggcgugcccuucagacaccugcugcuggugcugcagcuggcccugcugcccgccgccacccagggcaagaagguggugcugggcaagaagggcgacaccguggagcugaccugcaccgccagccagaagaagagcauccaguuccacuggaagaacagcaaccagaucaagauccugggcaaccagggcagcuuccugaccaagggccccagcaagcugaacgacagagccgacagcagaagaagccugugggaccagggcaacuucccccugaucaucaagaaccugaagaucgaggacagcgacaccuacaucugcgagguggaggaccagaaggaggaggugcagcugcugguguucggccugaccgccaacagcgacacccaccugcugcagggccagagccugacccugacccuggagagcccccccggcagcagccccagcgugcagugcagaagccccagaggcaagaacauccagggcggcaagacccugagcgugagccagcuggagcugcaggacagcggcaccuggaccugcaccgugcugcagaaccagaagaagguggaguucaagaucgacaucguggugcuggccuuccagaaggccagcagcaucguguacaagaaggagggcgagcagguggaguucagcuucccccuggccuucaccguggagaagcugaccggcagcggcgagcugugguggcaggccgagagagccagcagcagcaagagcuggaucaccuucgaccugaagaacaaggaggugagcgugaagagagugacccaggaccccaagcugcagaugggcaagaagcugccccugcaccugacccugccccaggcccugccccaguacgccggcagcggcaaccugacccuggcccuggaggccaagaccggcaagcugcaccaggaggugaaccugguggugaugagagccacccagcugcagaagaaccugaccugcgagguguggggccccaccagccccaagcugaugcugagccugaagcuggagaacaaggaggccaaggugagcaagagagagaaggccgugugggugcugaaccccgaggccggcauguggcagugccugcugagcgacagcggccaggugcugcuggagagcaacaucaaggugcugcccaccuggagcacccccgugcagcccauggcccugaucgugcugggcggcguggccggccugcugcuguucaucggccugggcaucuucuucugcgugagaugcagacacagaagaagacaggccgagagaaugagccagaucaagagacugcugagcgagaagaagaccugccagugcccccacagauuccagaagaccugcagccccaucuga

SEQ ID NO: 887 - RNA, 1377 nt, Artificial Sequence
  derived and/or modified sequence opt5 from CD4__Homo_sapiens__AAA35572
augaacagaggcgugcccuuccggcaucugcuccugguccuucagcuggcccuccugccugcugccacccaagggaagaaaguugugcuuggaaagaaaggcgacacaguggagcugacgugcaccgcgagccagaagaaauccauccaguuucacuggaaaaauucuaaccagauuaagauccucgggaaucaaggcagcuuccugacaaaaggaccguccaagcugaacgaucgcgcugacucuagacggagccucugggaucaggggaauuuuccccugauuaucaaaaaccuuaagauugaagacuccgauaccuacaucugugaggucgaagaccagaaagaggaagugcagcugcucguuuucggacugacagccaauucugauacccaccuucugcaaggccagagccucacacugacccuggaguccccucccggcagcucuccuuccgugcagugccgcagccccagagggaagaacauccagggaggcaagacgcucucugucucccaacuggagcuucaggacagcgggaccuggacauguaccgugcugcagaaucaaaagaagguugaauuuaaaauugauaucgugguccucgccuuccagaaggcuucuuccauuguguauaaaaaggagggagaacagguggaguuuagcuucccucuggccuuuacagucgagaaacuuaccggcuccggggaacugugguggcaggcugagcgggccucuagcuccaagagcuggaucacguucgaccucaagaacaaagaaguuucugugaagcgcgugacacaagauccgaaacugcagaugggaaagaaacugccccuccaucugacccuuccucaggcgcugccccaguacgccggcuccggcaaucucacacuggcucuugaggccaagaccgggaagcugcaccaagaagucaaccucgugguuaugagagcuacccagcugcagaaaaaucugacaugcgagguguggggaccuacgagccccaagcucaugcugucucuuaaacuggagaacaaggaagccaaagucagcaagcgggagaaggcgguguggguucucaauccggaagccggcauguggcagugucugcuguccgacucugggcaagugcuucucgagagcaacauuaaaguccugccuaccugguccacacccgugcagccuauggcucugaucguccucggaggcguggccgggcugcuucuguuuauuggacucggcaucuucuuuugcguucgcuguagacaucggcgcagacaggcugaacggaugagccagaucaagcgccugcugucugagaaaaagaccugccaauguccccacagauuccagaaaacaugcucccccauuuga

SEQ ID NO: 888 - protein, 61 aa, Artificial Sequence
  CD52__Homo_sapiens__P31358
MKRFLFLLLTISLLVMVQIQTGLSGQNDTSQTSSPSASSNISGGIFLFFVANAIIHLFCFS

SEQ ID NO: 889 - RNA, 186 nt, Artificial Sequence
  CD52__Homo_sapiens__CAA44323
augaagcgcuuccucuuccuccuacucaccaucagccuccugguuaugguacagauacaaacuggacucucaggacaaaacgacaccagccaaaccagcagccccucagcauccagcaacauaagcggaggcauuuuccuuuucuucguggccaaugccauaauccaccucuucugcuucaguuga

SEQ ID NO: 890 - RNA, 186 nt, Artificial Sequence
  derived and/or modified sequence opt1 from CD52__Homo_sapiens__CAA44323
augaagcgcuuccuguuccuccugcugaccaucagccuccuggugaugguccagauccagaccggccuguccgggcagaacgacacgagccagaccuccagccccuccgccagcuccaacaucagcggcgggaucuuccucuucuucguggccaacgcgaucauccaccuguucugcuucuccuga

SEQ ID NO: 891 - RNA, 186 nt, Artificial Sequence
  derived and/or modified sequence opt2 from CD52__Homo_sapiens__CAA44323
augaagcgcuuccucuuccuccuccucaccaucucccuccucgucaugguccagauccagaccggccucuccggccagaacgacaccucccagaccuccucccccuccgccuccuccaacaucuccggcggcaucuuccucuucuucgucgccaacgccaucauccaccucuucugcuucuccuga

SEQ ID NO: 892 - RNA, 186 nt, Artificial Sequence
  derived and/or modified sequence opt3 from CD52__Homo_sapiens__CAA44323
augaagagauuccuguuucuccuucugaccaucagcuuguuagugaugguccagauucaaacaggccuguccgggcagaacgacacuucucagacgucaagucccagcgccuccucuaauauaucgggagguaucuuccuauuuuucguugcuaacgcaauuauccaccucuuuugcuucucauga

SEQ ID NO: 893 - RNA, 186 nt, Artificial Sequence
  derived and/or modified sequence opt4 from CD52__Homo_sapiens__CAA44323
augaagagauuccuguuccugcugcugaccaucagccugcuggugauggugcagauccagaccggccugagcggccagaacgacaccagccagaccagcagccccagcgccagcagcaacaucagcggcggcaucuuccuguucuucguggccaacgccaucauccaccuguucugcuucagcuga

SEQ ID NO: 894 - RNA, 186 nt, Artificial Sequence
  derived and/or modified sequence opt5 from CD52__Homo_sapiens__CAA44323
augaagagauuccuguuucuccugcuuaccaucagccugcucgugaugguccagauucaaacaggccuguccgggcagaacgacacgucucagaccagcucccccucugccagcuccaauaucucuggaggcauuuuccuuuucuuuguugcuaacgccaucauucaccuguuuugcuucagcuga

SEQ ID NO: 895 - protein, 61 aa, Artificial Sequence
  CD52__Homo_sapiens__Q6IBD0
MKRFLFLLLTISLLVMVQIQTGLSGQNDTSQTSSPSASSSMSGGIFLFFVANAIIHLFCFS

SEQ ID NO: 896 - RNA, 186 nt, Artificial Sequence
  CD52__Homo_sapiens__AAP35780
augaagcgcuuccucuuccuccuacucaccaucagccuccugguuaugguacagauacaaacuggacucucaggacaaaacgacaccagccaaaccagcagccccucagcauccagcagcaugagcggaggcauuuuccuuuucuucguggccaaugccauaauccaccucuucugcuucaguuag

SEQ ID NO: 897 - RNA, 186 nt, Artificial Sequence
  derived and/or modified sequence opt1 from CD52__Homo_sapiens__AAP35780
augaagcgcuuccuguuccuccugcugaccaucagccuccuggugaugguccagauccagaccggccuguccgggcagaacgacacgagccagaccuccagccccuccgccagcuccagcauguccggcgggaucuuccucuucuucguggccaacgcgaucauccaccuguucugcuucagcuga

SEQ ID NO: 898 - RNA, 186 nt, Artificial Sequence
  derived and/or modified sequence opt2 from CD52__Homo_sapiens__AAP35780
augaagcgcuuccucuuccuccuccucaccaucucccuccucgucaugguccagauccagaccggccucuccggccagaacgacaccucccagaccuccucccccuccgccuccuccuccauguccggcggcaucuuccucuucuucgucgccaacgccaucauccaccucuucugcuucuccuga

SEQ ID NO: 899 - RNA, 186 nt, Artificial Sequence
  derived and/or modified sequence opt3 from CD52__Homo_sapiens__AAP35780
augaagagauuccuguuucuccuucugaccaucagcuuguuagugaugguccagauucaaacaggccuguccgggcagaacgacacuucucagacgucaagucccagcgccuccucuucgaugucaggagguauauuccuauuuuucguugcuaaugcaaucauucaccucuuuugcuucagcuga

SEQ ID NO: 900 - RNA, 186 nt, Artificial Sequence
  derived and/or modified sequence opt4 from CD52__Homo_sapiens__AAP35780
augaagagauuccuguuccugcugcugaccaucagccugcuggugauggugcagauccagaccggccugagcggccagaacgacaccagccagaccagcagccccagcgccagcagcagcaugagcggcggcaucuuccuguucuucguggccaacgccaucauccaccuguucugcuucagcuga

SEQ ID NO: 901 - RNA, 186 nt, Artificial Sequence
  derived and/or modified sequence opt5 from CD52__Homo_sapiens__AAP35780
augaagagauuccuguuucuccugcuuaccaucagccugcucgugaugguccagauucaaacaggccuguccgggcagaacgacacgucucagaccagcucccccucugccagcuccucuaugagcggaggcaucuuccuuuucuuuguugcuaaugccauuauccaccuguuuugcuucuccuga

SEQ ID NO: 902 - protein, 61 aa, Artificial Sequence; identical to SEQ ID NO: 888
  CD52__Homo_sapiens__V9HWN9

SEQ ID NO: 903 - RNA, 186 nt, Artificial Sequence; identical to SEQ ID NO: 889
  CD52__Homo_sapiens__ACS44650

SEQ ID NO: 904 - RNA, 186 nt, Artificial Sequence; identical to SEQ ID NO: 890
  derived and/or modified sequence opt1 from CD52__Homo_sapiens__ACS44650

SEQ ID NO: 905 - RNA, 186 nt, Artificial Sequence; identical to SEQ ID NO: 891
  derived and/or modified sequence opt2 from CD52__Homo_sapiens__ACS44650

SEQ ID NO: 906 - RNA, 186 nt, Artificial Sequence; identical to SEQ ID NO: 892
  derived and/or modified sequence opt3 from CD52__Homo_sapiens__ACS44650

SEQ ID NO: 907 - RNA, 186 nt, Artificial Sequence; identical to SEQ ID NO: 893
  derived and/or modified sequence opt4 from CD52__Homo_sapiens__ACS44650

SEQ ID NO: 908 - RNA, 186 nt, Artificial Sequence; identical to SEQ ID NO: 894
  derived and/or modified sequence opt5 from CD52__Homo_sapiens__ACS44650

SEQ ID NO: 909 - protein, 317 aa, Artificial Sequence
  CD55__Homo_sapiens__B1AP15
MTVARPSVPAALPLLGELPRLLLLVLLCLPAVWGDCGLPPDVPNAQPALEGRTSFPEDTVITYKCEESFVKIPGEKDSVICLKGSQWSDIEEFCNQKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 910 - RNA, 954 nt, Artificial Sequence
  CD55__Homo_sapiens__EAW93489
augaccgucgcgcggccgagcgugcccgcggcgcugccccuccucggggagcugccccggcugcugcugcuggugcuguugugccugccggccguguggggugacuguggccuucccccagauguaccuaaugcccagccagcuuuggaaggccguacaaguuuucccgaggauacuguaauaacguacaaaugugaagaaagcuuugugaaaauuccuggcgagaaggacucagugaucugccuuaagggcagucaauggucagauauugaagaguucugcaaucagaaaucaugcccuaauccgggagaaauacgaaauggucagauugauguaccagguggcauauuauuuggugcaaccaucuccuucucauguaacacaggguacaaauuauuuggcucgacuucuaguuuuugucuuauuucaggcagcucuguccaguggagugacccguugccagagugcagagaaauuuauuguccagcaccaccacaaauugacaauggaauaauucaaggggaacgugaccauuauggauauagacagucuguaacguaugcauguaauaaaggauucaccaugauuggagagcacucuauuuauuguacugugaauaaugaugaaggagaguggaguggcccaccaccugaaugcagaggaaaaucucuaacuuccaaggucccaccaacaguucagaaaccuaccacaguaaauguuccaacuacagaagucucaccaacuucucagaaaaccaccacaaaaaccaccacaccaaaugcucaagcaacacggaguacaccuguuuccaggacaaccaagcauuuucaugaaacaaccccaaauaaaggaaguggaaccacuucagguacuacccgucuucuaucugggcacacguguuucacguugacagguuugcuugggacgcuaguaaccaugggcuugcugacuuag

SEQ ID NO: 911 - RNA, 954 nt, Artificial Sequence
  derived and/or modified sequence opt1 from CD55__Homo_sapiens__EAW93489
augaccguggcccgccccagcgucccggccgcgcugccccuccugggcgagcugccccggcuccugcugcucgugcugcugugccuccccgccguguggggcgacugcgggcugccgcccgacguccccaacgcccagcccgcccuggaggggcgcaccuccuucccggaggacacggugaucaccuacaagugcgaggagagcuucgugaagauccccggcgagaaggacuccgucaucugccucaaggggagccagugguccgacaucgaggaguucugcaaccagaaguccugccccaaccccggcgagauccggaacggccagaucgacgugcccgggggcauccuguucggggccaccaucagcuucagcugcaacaccggcuacaagcuguucggguccacgagcuccuucugccucaucagcggcuccagcgugcagugguccgacccccugcccgagugccgcgagaucuacugccccgcgccgccccagaucgacaacggcaucauccagggggagcgggaccacuacggcuaccgccagagcgucaccuacgccugcaacaagggguucaccaugaucggcgagcacuccaucuacugcaccgugaacaacgacgagggcgaguggagcgggccgcccccggagugccggggcaagucccugacgagcaaggugccgcccaccguccagaagcccaccaccgugaacgugcccacgaccgaggucagccccaccucccagaagaccacgaccaagaccaccacgcccaacgcccaggccacccgcagcacccccgugucccggaccacgaagcacuuccacgagaccaccccgaacaaggggagcggcaccacguccgggaccacccgccuccugagcggccacacgugcuucacccugaccggccuccuggggacccuggugaccaugggccuccugacguga

SEQ ID NO: 912 - RNA, 954 nt, Artificial Sequence
  derived and/or modified sequence opt2 from CD55__Homo_sapiens__EAW93489
augaccgucgcccgccccuccguccccgccgcccucccccuccucggcgagcucccccgccuccuccuccucguccuccucugccuccccgccgucuggggcgacugcggccucccccccgacguccccaacgcccagcccgcccucgagggccgcaccuccuuccccgaggacaccgucaucaccuacaagugcgaggaguccuucgucaagauccccggcgagaaggacuccgucaucugccucaagggcucccagugguccgacaucgaggaguucugcaaccagaaguccugccccaaccccggcgagauccgcaacggccagaucgacguccccggcggcauccucuucggcgccaccaucuccuucuccugcaacaccggcuacaagcucuucggcuccaccuccuccuucugccucaucuccggcuccuccguccagugguccgacccccuccccgagugccgcgagaucuacugccccgcccccccccagaucgacaacggcaucauccagggcgagcgcgaccacuacggcuaccgccaguccgucaccuacgccugcaacaagggcuucaccaugaucggcgagcacuccaucuacugcaccgucaacaacgacgagggcgagugguccggccccccccccgagugccgcggcaagucccucaccuccaaggucccccccaccguccagaagcccaccaccgucaacguccccaccaccgaggucucccccaccucccagaagaccaccaccaagaccaccacccccaacgcccaggccacccgcuccacccccgucucccgcaccaccaagcacuuccacgagaccacccccaacaagggcuccggcaccaccuccggcaccacccgccuccucuccggccacaccugcuucacccucaccggccuccucggcacccucgucaccaugggccuccucaccuga

SEQ ID NO: 913 - RNA, 954 nt, Artificial Sequence
  derived and/or modified sequence opt3 from CD55__Homo_sapiens__EAW93489
augaccguggccagacccagcgucccugcugcacugccacuccuuggcgagcugccgagguuguuacugcuaguucuccugugccuucccgccguguggggagacugugggcugccuccagauguacccaacgcgcagccugcuuuggaaggucggacauccuucccagaggacacugugaucacguacaagugcgaagagucuuuugucaaaauucccggcgaaaaggauucagugauaugucucaaagggagucaauggagcgacaucgaggaguucugcaaucagaaguccuguccuaacccaggagaaauucgcaauggccagaucgauguuccgggugggauucuguuuggagccaccaucucuuucucgugcaacacaggcuauaaacuguuuggcucaacuagcaguuucugucucauauccgggucuagcgugcagugguccgaccccuuaccugagugccgagaaaucuacuguccagcacccccucaaauugauaauggaaucauucagggugagcgugaccacuauggcuacagacagucagucaccuaugccugcaacaagggguuuacaaugaucggagagcauaguauauacuguaccgugaauaacgaugaaggcgaguggagcgguccacccccggaaugcagggggaagucucugacuuccaaaguaccucccacaguucagaagccaaccacggugaaugucccuacuaccgaggugucacccacaagccagaaaacuaccacaaagaccacgacuccaaacgcucaagcaacacggaguacccccgugucucgcacuacaaaacacuuccaugaaaccacgccuaauaagggauccggcaccacaagcggcacuaccagacuuuugucggggcacacaugcuuuacucugaccggacuacucgguacacuggucaccaugggccuucugacuuga

SEQ ID NO: 914 - RNA, 954 nt, Artificial Sequence
  derived and/or modified sequence opt4 from CD55__Homo_sapiens__EAW93489
augaccguggccagacccagcgugcccgccgcccugccccugcugggcgagcugcccagacugcugcugcuggugcugcugugccugcccgccguguggggcgacugcggccugccccccgacgugcccaacgcccagcccgcccuggagggcagaaccagcuuccccgaggacaccgugaucaccuacaagugcgaggagagcuucgugaagauccccggcgagaaggacagcgugaucugccugaagggcagccaguggagcgacaucgaggaguucugcaaccagaagagcugccccaaccccggcgagaucagaaacggccagaucgacgugcccggcggcauccuguucggcgccaccaucagcuucagcugcaacaccggcuacaagcuguucggcagcaccagcagcuucugccugaucagcggcagcagcgugcaguggagcgacccccugcccgagugcagagagaucuacugccccgcccccccccagaucgacaacggcaucauccagggcgagagagaccacuacggcuacagacagagcgugaccuacgccugcaacaagggcuucaccaugaucggcgagcacagcaucuacugcaccgugaacaacgacgagggcgaguggagcggccccccccccgagugcagaggcaagagccugaccagcaaggugccccccaccgugcagaagcccaccaccgugaacgugcccaccaccgaggugagccccaccagccagaagaccaccaccaagaccaccacccccaacgcccaggccaccagaagcacccccgugagcagaaccaccaagcacuuccacgagaccacccccaacaagggcagcggcaccaccagcggcaccaccagacugcugagcggccacaccugcuucacccugaccggccugcugggcacccuggugaccaugggccugcugaccuga

SEQ ID NO: 915 - RNA, 954 nt, Artificial Sequence
  derived and/or modified sequence opt5 from CD55__Homo_sapiens__EAW93489
augaccguggccagacccagcgucccugcugcccugccgcuccugggcgagcuuccccggcugcuccugcuuguucugcucugccugccugcgguguggggcgacuguggacugcccccugaugugcccaacgcucagccugcccucgaaggccgcacauccuucccggaggacacggucaucaccuacaagugcgaagagucuuuugugaaaauucccggggaaaaggauagcguuaucugucugaaaggaucccaauggucugacauugaggaguucugcaaucaaaagagcuguccuaaccccggcgaaaucagaaaugggcagauugaugugccuggaggcauccuuuuuggcgccacaaucuccuucucuugcaacaccggguauaaacuguuuggaagcacauccagcuucugucucauuucuggcuccagcguccaguggucugacccccugccggagugccgggaaaucuacuguccugcucccccucaaauugauaaugggaucauucagggagagcgcgaccacuauggcuacagacaguccgugaccuaugccugcaacaagggguuuacaaugaucggagagcauagcauuuacuguaccguuaauaacgaugaaggcgaguggucugggcccccucccgaaugccgggggaagucccuuacgagcaaagugccgcccaccguccagaagccuacaaccgugaaugugcccacaaccgaggucuccccuacgucucagaaaacaaccacaaagaccaccacacccaacgcucaggccacgcgcagcaccccgguuuccagaacaaccaaacacuuccaugaaacaaccccuaauaagggaagcggcacgacaucugggaccacccggcugcucuccggacacacaugcuuuacccugacaggccugcucgggacgcuggugaccaugggacuucugacauga

SEQ ID NO: 916 - protein, 293 aa, Artificial Sequence [sequence omitted]

SEQ ID NO: 917 - RNA, 882 nt, Artificial Sequence
  CD55__Homo_sapiens__EAW93497
augauuggagagcacucuauuuauuguacugugaauaaugaugaaggagaguggaguggcccaccaccugaaugcagaggaaaaucucuaacuuccaaggucccaccaacaguucagaaaccuaccacaguaaauguuccaacuacagaagucucaccaacuucucagaaaaccaccacaaaaaccaccacaccaaaugcucaagguacagagacuccaucaguucuucaaaaacacaccacagaaaauguuucagcuacaagaaccccaccaacuccucagaaacccaccacaguaaaugucccagcuacaauagucacaccaacaccucagaaacccaccacaauaaauguuccagcuacaggagucucaucaacaccucaaagacacaccauaguaaauguuucagcuacaggaacccuaccaacucuucagaaacccaccagagcaaaugauucagccaccaaauccccagcagcagcucagacaucuuucauaucaaaaacccuaucuacaaagaccccuucugcagcucagaaucccaugaugacaaaugcuucugcuacacaggccacacuaacagcccaaaaauucaccacagcaaaaguugcauuuacgcagaguccuucagcagcacguaaguccacuaauguacauuccccagugacuaauggucucaagaguacacaaagauucccuucugcucauauuacagcaacacggaguacaccuguuuccaggacaaccaagcauuuucaugaaacaaccccaaauaaaggaaguggaaccacuucagguacuacccgucuucuaucugggcacacguguuucacguugacagguuugcuugggacgcuaguaaccaugggcuugcugacuuag

SEQ ID NO: 918 - RNA, 882 nt, Artificial Sequence
  derived and/or modified sequence opt1 from CD55__Homo_sapiens__EAW93497
augaucggcgagcacagcaucuacugcaccgugaacaacgacgagggggagugguccgggcccccgcccgagugccgcggcaagagccugaccuccaaggucccgcccacggugcagaagcccaccaccgugaacguccccaccacggaggugagccccaccucccagaagaccaccacgaagaccaccacccccaacgcccagggcacggagaccccgagcgugcuccagaagcacaccaccgagaacgucuccgccacgcggaccccgcccacgccccagaagcccaccaccgugaacgugcccgcgaccaucgucacccccacgccccagaagccgaccaccaucaacgugcccgccaccggggugagcuccacgccccagcgccacaccaucgucaacgugagcgccaccggcacccugcccacccugcagaagccgacgcgggccaacgacuccgccaccaagagccccgcggccgcccagaccuccuucaucagcaagacccucuccacgaagacccccagcgccgcgcagaaccccaugaugaccaacgccuccgccacccaggccacccugacggcccagaaguucaccaccgcgaagguggccuucacccagagcccguccgccgcccgcaagagcacgaacguccacagccccgugaccaacggccugaaguccacccagcgguuccccagcgcccacaucaccgcgacgcgcuccacccccgugagccggaccaccaagcacuuccacgagacgaccccgaacaagggguccggcaccaccagcgggacgacccgccuccuguccggccacacgugcuucacccugaccgggcuccugggcacccuggucaccaugggccuccugaccuga

SEQ ID NO: 919 - RNA, 882 nt, Artificial Sequence
  derived and/or modified sequence opt2 from CD55__Homo_sapiens__EAW93497
augaucggcgagcacuccaucuacugcaccgucaacaacgacgagggcgagugguccggccccccccccgagugccgcggcaagucccucaccuccaaggucccccccaccguccagaagcccaccaccgucaacguccccaccaccgaggucucccccaccucccagaagaccaccaccaagaccaccacccccaacgcccagggcaccgagacccccuccguccuccagaagcacaccaccgagaacgucuccgccacccgcaccccccccaccccccagaagcccaccaccgucaacguccccgccaccaucgucacccccaccccccagaagcccaccaccaucaacguccccgccaccggcgucuccuccaccccccagcgccacaccaucgucaacgucuccgccaccggcacccuccccacccuccagaagcccacccgcgccaacgacuccgccaccaagucccccgccgccgcccagaccuccuucaucuccaagacccucuccaccaagacccccuccgccgcccagaaccccaugaugaccaacgccuccgccacccaggccacccucaccgcccagaaguucaccaccgccaaggucgccuucacccagucccccuccgccgcccgcaaguccaccaacguccacucccccgucaccaacggccucaaguccacccagcgcuuccccuccgcccacaucaccgccacccgcuccacccccgucucccgcaccaccaagcacuuccacgagaccacccccaacaagggcuccggcaccaccuccggcaccacccgccuccucuccggccacaccugcuucacccucaccggccuccucggcacccucgucaccaugggccuccucaccuga

SEQ ID NO: 920 - RNA, 882 nt, Artificial Sequence
  derived and/or modified sequence opt3 from CD55__Homo_sapiens__EAW93497
augaucggcgagcacagcauuuacugcaccgugaacaaugacgaaggggagugguccggacccccuccagaauguagagguaagucucugacaucaaaagucccgcccacuguucagaagccuacgaccgugaacguaccaacaacugaggugagucccaccagccagaaaacaaccacuaagacaaccacgccuaaugcccaaggcacugaaaccccauccguccuccagaaacauacaacugagaacgugucugcuaccaggacacccccuaccccacagaagccgacgacuguuaaugugcccgcaacaauagucaccccuacuccacaaaagcccacaaccaucaacgugccugccacggggguaucgucaaccccacagcggcacacaauuguuaaugugagcgcgacuggaacccuucccacacugcagaaaccgacucgcgcuaacgauagugccaccaaguccccugcagccgcucagacaucuuucaucagcaaaaccuuguccacuaagacgcccucagcagcccaaaauccaaugaugacaaacgcuagugccacccaggcgacuuuaaccgcacagaaauuuacaaccgccaaggucgcuuucacucagagcccuucugccgcacgaaaguccacaaaugugcauucacccgugacgaacggccugaaaagcacccaacguuuuccaagugcucacauuacugccacaagaucuacccccgucuccaggacaacuaagcauuuccacgagaccacgccuaauaaagguagcgggaccacaucgggaacuacccggcuacucucuggccacacaugcuuuacucugaccggccuucuggggacguugguuacaaugggacuccugaccuga

SEQ ID NO: 921 - RNA, 882 nt, Artificial Sequence
  derived and/or modified sequence opt4 from CD55__Homo_sapiens__EAW93497
augaucggcgagcacagcaucuacugcaccgugaacaacgacgagggcgaguggagcggccccccccccgagugcagaggcaagagccugaccagcaaggugccccccaccgugcagaagcccaccaccgugaacgugcccaccaccgaggugagccccaccagccagaagaccaccaccaagaccaccacccccaacgcccagggcaccgagacccccagcgugcugcagaagcacaccaccgagaacgugagcgccaccagaaccccccccaccccccagaagcccaccaccgugaacgugcccgccaccaucgugacccccaccccccagaagcccaccaccaucaacgugcccgccaccggcgugagcagcaccccccagagacacaccaucgugaacgugagcgccaccggcacccugcccacccugcagaagcccaccagagccaacgacagcgccaccaagagccccgccgccgcccagaccagcuucaucagcaagacccugagcaccaagacccccagcgccgcccagaaccccaugaugaccaacgccagcgccacccaggccacccugaccgcccagaaguucaccaccgccaagguggccuucacccagagccccagcgccgccagaaagagcaccaacgugcacagccccgugaccaacggccugaagagcacccagagauuccccagcgcccacaucaccgccaccagaagcacccccgugagcagaaccaccaagcacuuccacgagaccacccccaacaagggcagcggcaccaccagcggcaccaccagacugcugagcggccacaccugcuucacccugaccggccugcugggcacccuggugaccaugggccugcugaccuga

SEQ ID NO: 922 - RNA, 882 nt, Artificial Sequence
  derived and/or modified sequence opt5 from CD55__Homo_sapiens__EAW93497
augaucggcgagcacagcauuuacugcaccgugaacaaugacgaaggggagugguccggacccccuccggaauguagaggcaagucucugacaagcaaaguucccccuacgguccagaagcccaccacagugaacgugccuaccacagaggucucccccaccucucaaaagacaaccacgaagaccacaaccccuaaugcccaggggacagaaaccccgagcgugcuccagaaacauacgacagagaacguuuccgcuacccggacacccccuacaccccagaagccuaccaccgugaauguccccgccacgaucgugaccccgacaccucaaaagcccaccacaauuaacguuccugcgaccggagugucuagcacgccccagcgccacacaaucgucaauguguccgcuaccggcacccugcccacacuucagaaaccuaccagagccaacgauagcgccacaaagucuccggcugccgcucagacguccuucauuagcaaaacccugucuacaaagacccccuccgccgcgcaaaauccuaugaugacaaacgccagcgcuacccaggccacgcucaccgcucagaaauuuacaaccgccaagguggcguucacacagucucccuccgccgcucggaaaagcaccaauguccauuccccuguuacgaacgggcugaaaucuacacaacgcuuucccagcgcccacaucaccgcuacaagauccaccccggugagccggaccacaaagcauuuccacgagacgaccccuaauaaaggaucuggcacaaccuccggcacaacccgccuucugagcgggcacacgugcuuuacacucaccggacugcugggcacccucgugacaauggggcugcuuaccuga

SEQ ID NO: 923 - protein, 267 aa, Artificial Sequence [sequence omitted]

SEQ ID NO: 924 - RNA, 804 nt, Artificial Sequence
  CD55__Homo_sapiens__EAW93493
augauuggagagcacucuauuuauuguacugugaauaaugaugaaggagaguggaguggcccaccaccugaaugcagaggaaaaucucuaacuuccaaggucccaccaacaguucagaaaccuaccacaguaaauguuccaacuacagaagucucaccaacuucucagaaaaccaccacaaaaaccaccacaccaaaugcucaagguacagagacuccaucaguucuucaaaaacacaccacagaaaauguuucagcuacaagaaccccaccaacuccucagaaacccaccacaguaaaugucccagcuacaauagucacaccaacaccucagaaacccaccacaauaaauguuccagcuacaggagucucaucaacaccucaaagacacaccauaguaaauguuucagcuacaggaacccuaccaacucuucagaaacccaccagagcaaaugauucagccaccaaauccccagcagcagcucagacaucuuucauaucaaaaacccuaucuacaaagaccccuucugcagcucagaaucccaugaugacaaaugcuucugcuacacaggccacacuaacagcccaaaaauucaccacagcaaaaguugcauuuacgcagaguccuucagcagcaccaacacggaguacaccuguuuccaggacaaccaagcauuuucaugaaacaaccccaaauaaaggaaguggaaccacuucagguacuacccgucuucuaucugggcacacguguuucacguugacagguuugcuugggacgcuaguaaccaugggcuugcugacuuag

SEQ ID NO: 925 - RNA, 804 nt, Artificial Sequence
  derived and/or modified sequence opt1 from CD55__Homo_sapiens__EAW93493
augaucggcgagcacagcaucuacugcaccgugaacaacgacgagggggagugguccgggcccccgcccgagugccgcggcaagagccugaccuccaaggucccgcccacggugcagaagcccaccaccgugaacguccccaccacggaggugagccccaccucccagaagaccaccacgaagaccaccacccccaacgcccagggcacggagaccccgagcgugcuccagaagcacaccaccgagaacgucuccgccacgcggaccccgcccacgccccagaagcccaccaccgugaacgugcccgcgaccaucgucacccccacgccccagaagccgaccaccaucaacgugcccgccaccggggugagcuccacgccccagcgccacaccaucgucaacgugagcgccaccggcacccugcccacccugcagaagccgacgcgggccaacgacuccgccaccaagagccccgcggccgcccagaccuccuucaucagcaagacccucuccacgaagacccccagcgccgcgcagaaccccaugaugaccaacgccuccgccacccaggccacccugacggcccagaaguucaccaccgcgaagguggccuucacccagagcccguccgccgcccccacgcgcagcacccccgucagccggaccaccaagcacuuccacgagacgacccccaacaagggcuccgggaccaccagcggcacgacccgccugcucuccgggcacacgugcuucacccugaccggccugcucgggacccuggugaccaugggccugcucaccuga

SEQ ID NO: 926 - RNA, 804 nt, Artificial Sequence
  derived and/or modified sequence opt2 from CD55__Homo_sapiens__EAW93493
augaucggcgagcacuccaucuacugcaccgucaacaacgacgagggcgagugguccggccccccccccgagugccgcggcaagucccucaccuccaaggucccccccaccguccagaagcccaccaccgucaacguccccaccaccgaggucucccccaccucccagaagaccaccaccaagaccaccacccccaacgcccagggcaccgagacccccuccguccuccagaagcacaccaccgagaacgucuccgccacccgcaccccccccaccccccagaagcccaccaccgucaacguccccgccaccaucgucacccccaccccccagaagcccaccaccaucaacguccccgccaccggcgucuccuccaccccccagcgccacaccaucgucaacgucuccgccaccggcacccuccccacccuccagaagcccacccgcgccaacgacuccgccaccaagucccccgccgccgcccagaccuccuucaucuccaagacccucuccaccaagacccccuccgccgcccagaaccccaugaugaccaacgccuccgccacccaggccacccucaccgcccagaaguucaccaccgccaaggucgccuucacccagucccccuccgccgcccccacccgcuccacccccgucucccgcaccaccaagcacuuccacgagaccacccccaacaagggcuccggcaccaccuccggcaccacccgccuccucuccggccacaccugcuucacccucaccggccuccucggcacccucgucaccaugggccuccucaccuga

SEQ ID NO: 927 - RNA, 804 nt, Artificial Sequence
  derived and/or modified sequence opt3 from CD55__Homo_sapiens__EAW93493
augaucggcgagcacagcauuuacugcaccgugaacaaugacgaaggggagugguccggacccccuccagaauguagagguaagucucugacaucaaaagucccgcccacuguucagaagccuacgaccgugaacguaccaacaacugaggugagucccaccagccagaaaacaaccacuaagacaaccacgccuaaugcccaaggcacugaaaccccauccguccuccagaaacauacaacugagaacgugucugcuaccaggacacccccuaccccacagaagccgacgacuguuaaugugcccgcaacaauagucaccccuacuccacaaaagcccacaaccaucaacgugccugccacggggguaucgucaaccccacagcggcacacaauuguuaaugugagcgcgacuggaacccuucccacacugcagaaaccgacucgcgcuaacgauagugccaccaaguccccugcagccgcucagacaucuuucaucagcaaaaccuuguccacuaagacgcccucagcagcccaaaauccaaugaugacaaacgcuagugccacccaggcgacuuuaaccgcacagaaauuuacaaccgccaaggucgcuuucacucagagcccuucugccgcacccacacgauccacgccagugucacguaccacuaagcauuuucacgagacaacccccaauaaaggcagcgguacaaccagugggacuacgagacugcuaucuggacauaccugcuucacacucacuggccugcuuggcacccuggugacaaugggguugcucacuuga

SEQ ID NO: 928 - RNA, 804 nt, Artificial Sequence
  derived and/or modified sequence opt4 from CD55__Homo_sapiens__EAW93493
augaucggcgagcacagcaucuacugcaccgugaacaacgacgagggcgaguggagcggccccccccccgagugcagaggcaagagccugaccagcaaggugccccccaccgugcagaagcccaccaccgugaacgugcccaccaccgaggugagccccaccagccagaagaccaccaccaagaccaccacccccaacgcccagggcaccgagacccccagcgugcugcagaagcacaccaccgagaacgugagcgccaccagaaccccccccaccccccagaagcccaccaccgugaacgugcccgccaccaucgugacccccaccccccagaagcccaccaccaucaacgugcccgccaccggcgugagcagcaccccccagagacacaccaucgugaacgugagcgccaccggcacccugcccacccugcagaagcccaccagagccaacgacagcgccaccaagagccccgccgccgcccagaccagcuucaucagcaagacccugagcaccaagacccccagcgccgcccagaaccccaugaugaccaacgccagcgccacccaggccacccugaccgcccagaaguucaccaccgccaagguggccuucacccagagccccagcgccgcccccaccagaagcacccccgugagcagaaccaccaagcacuuccacgagaccacccccaacaagggcagcggcaccaccagcggcaccaccagacugcugagcggccacaccugcuucacccugaccggccugcugggcacccuggugaccaugggccugcugaccuga

SEQ ID NO: 929 - RNA, 804 nt, Artificial Sequence
  derived and/or modified sequence opt5 from CD55__Homo_sapiens__EAW93493
augaucggcgagcacagcauuuacugcaccgugaacaaugacgaaggggagugguccggacccccuccggaauguagaggcaagucucugacaagcaaaguucccccuacgguccagaagcccaccacagugaacgugccuaccacagaggucucccccaccucucagaaaacaaccacgaagaccacaaccccuaaugcccaagggacagaaaccccgagcgugcuccagaaacauacgacagagaacguuuccgcuacccggacacccccuacaccccagaagccuaccaccgugaauguccccgccacgaucgugaccccgacaccucaaaagcccaccacaauuaacguuccugcgaccggagugucuagcacgccccagcgccacacaaucgucaauguguccgcuaccggcacccugcccacacuucagaaaccuaccagagccaacgauagcgccacaaagucuccggcugccgcucagacguccuucauuagcaaaacccugucuacaaagacccccuccgccgcgcaaaauccuaugaugacaaacgccagcgcuacccaggccacgcucaccgcucagaaauuuacaaccgccaagguggcguucacacagucucccuccgccgcuccuacccggagcacgcccgucucccgcacaaccaagcauuuucacgagacaaccccgaauaaagggucuggaaccacaagcggcacgaccagacugcuuuccggccauacaugcuucacccugacagggcuccugggaacccugguuacgaugggccuccugacauga

SEQ ID NO: 930 - protein, 381 aa, Artificial Sequence
  CD55__Homo_sapiens__P08174
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 931 - RNA, 1146 nt, Artificial Sequence
  CD55__Homo_sapiens__AAA52168
augaccgucgcgcggccgagcgugcccgcggcgcugccccuccucggggagcugccccggcugcugcugcuggugcuguugugccugccggccguguggggugacuguggccuucccccagauguaccuaaugcccagccagcuuuggaaggccguacaaguuuucccgaggauacuguaauaacguacaaaugugaagaaagcuuugugaaaauuccuggcgagaaggacucagugaucugccuuaagggcagucaauggucagauauugaagaguucugcaaucguagcugcgaggugccaacaaggcuaaauucugcaucccucaaacagccuuauaucacucagaauuauuuuccagucgguacuguuguggaauaugagugccguccagguuacagaagagaaccuucucuaucaccaaaacuaacuugccuucagaauuuaaaaugguccacagcagucgaauuuuguaaaaagaaaucaugcccuaauccgggagaaauacgaaauggucagauugauguaccagguggcauauuauuuggugcaaccaucuccuucucauguaacacaggguacaaauuauuuggcucgacuucuaguuuuugucuuauuucaggcagcucuguccaguggagugacccguugccagagugcagagaaauuuauuguccagcaccaccacaaauugacaauggaauaauucaaggggaacgugaccauuauggauauagacagucuguaacguaugcauguaauaaaggauucaccaugauuggagagcacucuauuuauuguacugugaauaaugaugaaggagaguggaguggcccaccaccugaaugcagaggaaaaucucuaacuuccaaggucccaccaacaguucagaaaccuaccacaguaaauguuccaacuacagaagucucaccaacuucucagaaaaccaccacaaaaaccaccacaccaaaugcucaagcaacacggaguacaccuguuuccaggacaaccaagcauuuucaugaaacaaccccaaauaaaggaaguggaaccacuucagguacuacccgucuucuaucugggcacacguguuucacguugacagguuugcuugggacgcuaguaaccaugggcuugcugacuuag

SEQ ID NO: 932 - RNA, 1146 nt, Artificial Sequence
  derived and/or modified sequence opt1 from CD55__Homo_sapiens__AAA52168
augaccguggcccgccccagcgucccggccgcgcugccccuccugggcgagcugccccggcuccugcugcucgugcugcugugccuccccgccguguggggcgacugcgggcugccgcccgacguccccaacgcccagcccgcccuggaggggcgcaccuccuucccggaggacacggugaucaccuacaagugcgaggagagcuucgugaagauccccggcgagaaggacuccgucaucugccucaaggggagccagugguccgacaucgaggaguucugcaaccggagcugcgaggugcccacccgccugaacuccgccagccugaagcagcccuacaucacccagaacuacuucccggugggcacggucguggaguacgagugccggcccggcuaccgccgggagcccucccucagccccaagcugaccugccugcagaaccucaagugguccaccgcgguggaguucugcaagaagaaguccugcccgaaccccggggagauccgcaacggccagaucgacguccccgggggcauccuguucggggccaccaucagcuucagcugcaacacgggcuacaagcuguucggcuccaccagcuccuucugccucaucagcggguccagcgugcaguggagcgacccccugccggagugccgggagaucuacugccccgccccgccccagaucgacaacggcaucauccagggggagcgcgaccacuacggcuaccggcaguccgugaccuacgccugcaacaagggcuucaccaugaucggggagcacagcaucuacugcacggucaacaacgacgagggcgagugguccgggcccccgcccgagugccgcggcaagagccugaccuccaaggugccgcccaccgugcagaagcccaccacggucaacgugcccaccaccgaggugagccccaccucccagaagacgaccaccaagaccacgacccccaacgcgcaggccacccggagcacccccgucucccgcacgaccaagcacuuccacgagaccacccccaacaaggggagcggcacgaccuccggcaccacccggcuccugagcgggcacacgugcuucacccugaccggccuccuggggacccuggugaccaugggccuccugacguga

SEQ ID NO: 933 - RNA, 1146 nt, Artificial Sequence
  derived and/or modified sequence opt2 from CD55__Homo_sapiens__AAA52168
augaccgucgcccgccccuccguccccgccgcccucccccuccucggcgagcucccccgccuccuccuccucguccuccucugccuccccgccgucuggggcgacugcggccucccccccgacguccccaacgcccagcccgcccucgagggccgcaccuccuuccccgaggacaccgucaucaccuacaagugcgaggaguccuucgucaagauccccggcgagaaggacuccgucaucugccucaagggcucccagugguccgacaucgaggaguucugcaaccgcuccugcgagguccccacccgccucaacuccgccucccucaagcagcccuacaucacccagaacuacuuccccgucggcaccgucgucgaguacgagugccgccccggcuaccgccgcgagcccucccucucccccaagcucaccugccuccagaaccucaagugguccaccgccgucgaguucugcaagaagaaguccugccccaaccccggcgagauccgcaacggccagaucgacguccccggcggcauccucuucggcgccaccaucuccuucuccugcaacaccggcuacaagcucuucggcuccaccuccuccuucugccucaucuccggcuccuccguccagugguccgacccccuccccgagugccgcgagaucuacugccccgcccccccccagaucgacaacggcaucauccagggcgagcgcgaccacuacggcuaccgccaguccgucaccuacgccugcaacaagggcuucaccaugaucggcgagcacuccaucuacugcaccgucaacaacgacgagggcgagugguccggccccccccccgagugccgcggcaagucccucaccuccaaggucccccccaccguccagaagcccaccaccgucaacguccccaccaccgaggucucccccaccucccagaagaccaccaccaagaccaccacccccaacgcccaggccacccgcuccacccccgucucccgcaccaccaagcacuuccacgagaccacccccaacaagggcuccggcaccaccuccggcaccacccgccuccucuccggccacaccugcuucacccucaccggccuccucggcacccucgucaccaugggccuccucaccuga

SEQ ID NO: 934 - RNA, 1146 nt, Artificial Sequence
  derived and/or modified sequence opt3 from CD55__Homo_sapiens__AAA52168
augaccguggccagacccagcgucccugcugcacugccacuccuuggcgagcugccgagguuguuacugcuaguucuccugugccuucccgccguguggggagacugugggcugccuccagauguacccaacgcgcagccugcuuuggaaggucggacauccuucccagaggacacugugaucacguacaagugcgaagagucuuuugucaaaauucccggcgaaaaggauucagugauaugucucaaagggagucaauggagcgacaucgaggaguucugcaaucgcuccugugaaguuccuacccgacugaacucugccucgcugaagcagccauauauuacacagaauuacuuuccggugggaacugucguggaguaugaaugccgucccggcuacagaagggagccuucacucagcccaaaauuaaccugucugcagaaccuuaaguggaguacagcaguagaguucugcaagaaaaaguccugucccaauccuggugaaauccggaacgggcaaauugauguuccaggaggcaucuuguuuggcgccaccauaucuuucagcugcaauacuggguauaaacuguuuggauccacaucaaguuucugucuaaucagcgguucuuccgugcaguggucagacccccucccggagugccgcgaaauuuacugcccugcucccccacagaucgauaacggcauuauccagggggagagagaccacuauggauacaggcaaagcgucaccuacgcauguaauaagggcuuuacgaugauaggugaacauaguauuuauugcacugugaacaaugaugagggggaguggucuggaccucccccagaaugucggggcaaaucccugaccagcaaggugcccccuacaguccagaagccaacuaccguuaacgugccgacaaccgagguaucgcccacgucucagaaaacuacaaccaagacuacaaccccuaaugcccaggcuacgcgcuccaccccagugucacgaacaacuaaacacuuccaugaaaccacacccaacaagggcagugggacuaccagcggaacaaccagacuucuguccggucacacuugcuuuacguugacaggccuccuggggaccuuagucacuaugggacugcucaccuga

SEQ ID NO: 935 - RNA, 1146 nt, Artificial Sequence
  derived and/or modified sequence opt4 from CD55__Homo_sapiens__AAA52168
augaccguggccagacccagcgugcccgccgcccugccccugcugggcgagcugcccagacugcugcugcuggugcugcugugccugcccgccguguggggcgacugcggccugccccccgacgugcccaacgcccagcccgcccuggagggcagaaccagcuuccccgaggacaccgugaucaccuacaagugcgaggagagcuucgugaagauccccggcgagaaggacagcgugaucugccugaagggcagccaguggagcgacaucgaggaguucugcaacagaagcugcgaggugcccaccagacugaacagcgccagccugaagcagcccuacaucacccagaacuacuuccccgugggcaccgugguggaguacgagugcagacccggcuacagaagagagcccagccugagccccaagcugaccugccugcagaaccugaaguggagcaccgccguggaguucugcaagaagaagagcugccccaaccccggcgagaucagaaacggccagaucgacgugcccggcggcauccuguucggcgccaccaucagcuucagcugcaacaccggcuacaagcuguucggcagcaccagcagcuucugccugaucagcggcagcagcgugcaguggagcgacccccugcccgagugcagagagaucuacugccccgcccccccccagaucgacaacggcaucauccagggcgagagagaccacuacggcuacagacagagcgugaccuacgccugcaacaagggcuucaccaugaucggcgagcacagcaucuacugcaccgugaacaacgacgagggcgaguggagcggccccccccccgagugcagaggcaagagccugaccagcaaggugccccccaccgugcagaagcccaccaccgugaacgugcccaccaccgaggugagccccaccagccagaagaccaccaccaagaccaccacccccaacgcccaggccaccagaagcacccccgugagcagaaccaccaagcacuuccacgagaccacccccaacaagggcagcggcaccaccagcggcaccaccagacugcugagcggccacaccugcuucacccugaccggccugcugggcacccuggugaccaugggccugcugaccuga

SEQ ID NO: 936 - RNA, 1146 nt, Artificial Sequence
  derived and/or modified sequence opt5 from CD55__Homo_sapiens__AAA52168
augaccguggccagacccagcgucccugcugcccugccgcuccugggcgagcuuccccggcugcuccugcuuguucugcucugccugccugcgguguggggagacugugggcugcccccugaugugcccaacgcucagccugcccucgaaggccgcacauccuucccggaggacacggucaucaccuacaagugcgaagagucuuuugugaaaauucccggggaaaaggauagcguuaucugucugaaaggaucccaauggucugacauugaggaguucugcaauagaagcugugaagugccuacacggcuuaacuccgccucucugaagcagcccuauaucacccagaauuacuuuccugucggcacagugguugaguaugaaugccgccccggguacagacgggagccgagccucuccccuaaacugaccugucuucagaaccugaaguggagcacagcuguggaguucugcaagaaaaagucuugucccaauccuggagaaauucgcaacggccaaaucgauguccccggcgggauccucuuuggagccaccauuuccuucagcugcaauacgggcuauaaacuguuugggucuaccuccagcuucugucugaucucuggauccagcgugcagugguccgacccccucccugagugcagagaaauuuacugcccggcucccccucagaucgauaacggcauuauccagggggagcgggaccacuauggauaccgccaaucugugacauacgccuguaauaagggcuuuaccaugauuggcgaacauagcaucuauugcacagucaacaaugaugagggggagugguccggacccccucccgaauguagaggcaaaagccugaccucuaagguuccgccuacggugcagaagcccacaaccgugaacgucccuacaaccgaggugucccccaccagccagaaaacaacgaccaagacaaccacaccuaaugcgcaggccacccggucuacgcccguuagccgcacaaccaaacacuuccaugaaaccacaccgaacaagggguccggaaccacaucuggcacgaccagacuucugagcgggcacacaugcuuuacccucacaggacugcuuggcacccuggugacgaugggccuccugaccuga

SEQ ID NO: 937 - protein, 858 aa, Artificial Sequence
  CD56__Homo_sapiens__P13591
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 938 - RNA, 2577 nt, Artificial Sequence
  CD56__Homo_sapiens__CCDS73385.1
augcugcaaacuaaggaucucaucuggacuuuguuuuuccugggaacugcaguuucucugcagguggauauuguucccagccagggggagaucagcguuggagaguccaaauucuucuuaugccaaguggcaggagaugccaaagauaaagacaucuccugguucucccccaauggagaaaagcucaccccaaaccagcagcggaucucagugguguggaaugaugauuccuccuccacccucaccaucuauaacgccaacaucgacgacgccggcauuuacaagugugugguuacaggcgaggauggcagugagucagaggccaccgucaacgugaagaucuuucagaagcucauguucaagaaugcgccaaccccacaggaguuccgggagggggaagaugccgugauugugugugauguggucagcucccucccaccaaccaucaucuggaaacacaaaggccgagaugucauccugaaaaaagauguccgauucauaguccuguccaacaacuaccugcagauccggggcaucaagaaaacagaugagggcacuuaucgcugugagggcagaauccuggcacggggggagaucaacuucaaggacauucaggucauugugaaugugccaccuaccauccaggccaggcagaauauugugaaugccaccgccaaccucggccaguccgucacccuggugugcgaugccgaaggcuucccagagcccaccaugagcuggacaaaggauggggaacagauagagcaagaggaagacgaugagaaguacaucuucagcgacgauaguucccagcugaccaucaaaaagguggauaagaacgacgaggcugaguacaucugcauugcugagaacaaggcuggcgagcaggaugcgaccauccaccucaaagucuuugcaaaacccaaaaucacauauguagagaaccagacugccauggaauuagaggagcaggucacucuuaccugugaagccuccggagaccccauucccuccaucaccuggaggacuucuacccggaacaucagcagcgaagaaaaggcuucguggacucgaccagagaagcaagagacucuggaugggcacaugguggugcguagccaugcccgugugucgucgcugacccugaagagcauccaguacacugaugccggagaguacaucugcaccgccagcaacaccaucggccaggacucccaguccauguaccuugaagugcaauaugccccaaagcuacagggcccuguggcuguguacacuugggaggggaaccaggugaacaucaccugcgagguauuugccuaucccagugccacgaucucaugguuucgggauggccagcugcugccaagcuccaauuacagcaauaucaagaucuacaacacccccucugccagcuaucuggaggugaccccagacucugagaaugauuuugggaacuacaacuguacugcagugaaccgcauugggcaggaguccuuggaauucauccuuguucaagcagacacccccucuucaccauccaucgaccagguggagccauacuccagcacagcccaggugcaguuugaugaaccagaggccacagguggggugcccauccucaaauacaaagcugaguggagagcaguuggugaagaaguauggcauuccaagugguaugaugccaaggaagccagcauggagggcaucgucaccaucgugggccugaagcccgaaacaacguacgccguaaggcuggcggcgcucaauggcaaagggcugggugagaucagcgcggccuccgaguucaagacgcagccaguccaaggggaacccagugcaccuaagcucgaagggcagaugggagaggauggaaacucuauuaaagugaaccugaucaagcaggaugacggcggcucccccaucagacacuaucuggucagguaccgagcgcucuccuccgaguggaaaccagagaucaggcucccgucuggcagugaccacgucaugcugaagucccuggacuggaaugcugaguaugaggucuacgugguggcugagaaccagcaaggaaaauccaaggcggcucauuuuguguucaggaccucggcccagcccacagccaucccagccaacggcagccccaccucaggccugagcaccggggccaucgugggcauccucaucgucaucuucguccugcuccuggugguuguggacaucaccugcuacuuccugaacaaguguggccuguucaugugcauugcggucaaccuguguggaaaagccgggcccggggccaagggcaaggacauggaggagggcaaggccgccuucucgaaagaugaguccaaggagcccaucguggagguucgaacggaggaggagaggaccccaaaccaugauggagggaaacacacagagcccaacgagaccacgccacugacggagcccgagaagggccccguagaagcaaagccagagugccaggagacagaaacgaagccagcgccagccgaagucaagacgguccccaaugacgccacacagacaaaggagaacgagagcaaagcauga

SEQ ID NO: 939 - RNA, 2577 nt, Artificial Sequence
  derived and/or modified sequence opt1 from CD56__Homo_sapiens__CCDS73385.1
augcugcagaccaaggaccucaucuggacccuguucuuccugggcacggccgugagccuccaggucgacaucgugcccucccagggggagaucagcgugggcgaguccaaguucuuccugugccaggucgccggggacgcgaaggacaaggacaucagcugguucuccccgaacggcgagaagcugacccccaaccagcagcgcaucagcgugguguggaacgacgacuccagcuccacccucaccaucuacaacgccaacaucgacgacgccgggaucuacaagugcgucgugacgggcgaggacggcagcgaguccgaggccaccgugaacgucaagaucuuccagaagcugauguucaagaacgcccccacgccccaggaguuccgggagggggaggacgcggugaucgugugcgacgucgugagcucccugccgcccaccaucaucuggaagcacaagggccgcgacgugauccucaagaaggacguccgguucaucgugcugagcaacaacuaccugcagauccgcgggaucaagaagaccgacgagggcaccuaccggugcgaggggcgcauccucgcccggggcgagaucaacuucaaggacauccaggugaucgucaacgugccgcccaccauccaggcccgccagaacaucgugaacgccaccgcgaaccugggccaguccgucacgcuggugugcgacgccgagggguuccccgagcccaccaugagcuggaccaaggacggcgagcagaucgagcaggaggaggacgacgagaaguacaucuucuccgacgacagcucccagcucaccaucaagaagguggacaagaacgacgaggccgaguacaucugcaucgccgagaacaaggccggggagcaggacgcgacgauccaccugaaggucuucgccaagcccaagaucaccuacguggagaaccagaccgccauggagcuggaggagcaggucacccucacgugcgaggccagcggcgaccccaucccgagcaucaccuggcggaccuccacccgcaacaucagcuccgaggagaaggccagcuggacgcggcccgagaagcaggagacccuggacggccacaugguggugcgcucccacgcgcgggucagcucccugacccucaagagcauccaguacaccgacgccggggaguacaucugcacggccuccaacaccaucggccaggacagccaguccauguaccuggaggugcaguacgcccccaagcugcaggggcccguggccgucuacaccugggagggcaaccaggugaacaucacgugcgagguguucgcguacccgagcgccaccaucuccugguuccgcgacgggcagcuccugcccagcuccaacuacagcaacaucaagaucuacaacacccccuccgccagcuaccuggaggucacccccgacuccgagaacgacuucggcaacuacaacugcaccgccgugaaccggaucggccaggagagccucgaguucauccuggugcaggccgacacgccgagcucccccagcaucgaccaggucgagcccuacuccagcaccgcccaggugcaguucgacgagcccgaggcgaccgggggcgugccgauccugaaguacaaggccgaguggcgcgccgucggggaggagguguggcacuccaagugguacgacgcgaaggaggccagcauggagggcaucgugaccaucgucgggcucaagcccgagaccacguacgccgugcggcuggccgcccugaacggcaagggccucggggagaucuccgcggccagcgaguucaagacccagcccgugcagggcgagcccuccgccccgaagcuggaggggcagaugggcgaggacgggaacagcaucaaggucaaccugaucaagcaggacgacggcggcucccccauccgccacuaccucgugcgguaccgcgcccugagcuccgaguggaagcccgagauccggcugccgagcggguccgaccacgugaugcucaagagccuggacuggaacgccgaguacgaggucuacgugguggcggagaaccagcagggcaaguccaaggccgcccacuucgucuuccgcaccagcgcccagcccaccgccauccccgcgaacgggagccccacguccggccugagcaccggcgccaucguggggauccucaucgugaucuucguccugcugcucgugguggucgacaucacgugcuacuuccugaacaagugcggccuguucaugugcaucgccgugaaccucugcgggaaggccggcccgggggcgaagggcaaggacauggaggagggcaaggccgccuucuccaaggacgagagcaaggagcccaucguggagguccgcaccgaggaggagcggacccccaaccacgacgggggcaagcacaccgagcccaacgagaccaccccgcugacggagcccgagaaggggcccguggaggccaagcccgagugccaggagaccgagaccaagccggcccccgcggaggugaagaccguccccaacgacgccacgcagaccaaggagaacgaguccaaggccuga

SEQ ID NO: 940 - RNA, 2577 nt, Artificial Sequence
  derived and/or modified sequence opt2 from CD56__Homo_sapiens__CCDS73385.1
augcuccagaccaaggaccucaucuggacccucuucuuccucggcaccgccgucucccuccaggucgacaucguccccucccagggcgagaucuccgucggcgaguccaaguucuuccucugccaggucgccggcgacgccaaggacaaggacaucuccugguucucccccaacggcgagaagcucacccccaaccagcagcgcaucuccgucgucuggaacgacgacuccuccuccacccucaccaucuacaacgccaacaucgacgacgccggcaucuacaagugcgucgucaccggcgaggacggcuccgaguccgaggccaccgucaacgucaagaucuuccagaagcucauguucaagaacgcccccaccccccaggaguuccgcgagggcgaggacgccgucaucgucugcgacgucgucuccucccucccccccaccaucaucuggaagcacaagggccgcgacgucauccucaagaaggacguccgcuucaucguccucuccaacaacuaccuccagauccgcggcaucaagaagaccgacgagggcaccuaccgcugcgagggccgcauccucgcccgcggcgagaucaacuucaaggacauccaggucaucgucaacgucccccccaccauccaggcccgccagaacaucgucaacgccaccgccaaccucggccaguccgucacccucgucugcgacgccgagggcuuccccgagcccaccauguccuggaccaaggacggcgagcagaucgagcaggaggaggacgacgagaaguacaucuucuccgacgacuccucccagcucaccaucaagaaggucgacaagaacgacgaggccgaguacaucugcaucgccgagaacaaggccggcgagcaggacgccaccauccaccucaaggucuucgccaagcccaagaucaccuacgucgagaaccagaccgccauggagcucgaggagcaggucacccucaccugcgaggccuccggcgaccccauccccuccaucaccuggcgcaccuccacccgcaacaucuccuccgaggagaaggccuccuggacccgccccgagaagcaggagacccucgacggccacauggucguccgcucccacgcccgcgucuccucccucacccucaaguccauccaguacaccgacgccggcgaguacaucugcaccgccuccaacaccaucggccaggacucccaguccauguaccucgagguccaguacgcccccaagcuccagggccccgucgccgucuacaccugggagggcaaccaggucaacaucaccugcgaggucuucgccuaccccuccgccaccaucuccugguuccgcgacggccagcuccuccccuccuccaacuacuccaacaucaagaucuacaacacccccuccgccuccuaccucgaggucacccccgacuccgagaacgacuucggcaacuacaacugcaccgccgucaaccgcaucggccaggagucccucgaguucauccucguccaggccgacacccccuccucccccuccaucgaccaggucgagcccuacuccuccaccgcccagguccaguucgacgagcccgaggccaccggcggcguccccauccucaaguacaaggccgaguggcgcgccgucggcgaggaggucuggcacuccaagugguacgacgccaaggaggccuccauggagggcaucgucaccaucgucggccucaagcccgagaccaccuacgccguccgccucgccgcccucaacggcaagggccucggcgagaucuccgccgccuccgaguucaagacccagcccguccagggcgagcccuccgcccccaagcucgagggccagaugggcgaggacggcaacuccaucaaggucaaccucaucaagcaggacgacggcggcucccccauccgccacuaccucguccgcuaccgcgcccucuccuccgaguggaagcccgagauccgccuccccuccggcuccgaccacgucaugcucaagucccucgacuggaacgccgaguacgaggucuacgucgucgccgagaaccagcagggcaaguccaaggccgcccacuucgucuuccgcaccuccgcccagcccaccgccauccccgccaacggcucccccaccuccggccucuccaccggcgccaucgucggcauccucaucgucaucuucguccuccuccucgucgucgucgacaucaccugcuacuuccucaacaagugcggccucuucaugugcaucgccgucaaccucugcggcaaggccggccccggcgccaagggcaaggacauggaggagggcaaggccgccuucuccaaggacgaguccaaggagcccaucgucgagguccgcaccgaggaggagcgcacccccaaccacgacggcggcaagcacaccgagcccaacgagaccaccccccucaccgagcccgagaagggccccgucgaggccaagcccgagugccaggagaccgagaccaagcccgcccccgccgaggucaagaccguccccaacgacgccacccagaccaaggagaacgaguccaaggccuga

SEQ ID NO: 941 - RNA, 2577 nt, Artificial Sequence
  derived and/or modified sequence opt3 from CD56__Homo_sapiens__CCDS73385.1
augcugcagaccaaggaccucaucuggacacuuuucuuucugggcacugccgugagcuugcaagucgauauuguucccucccagggggagauaucugugggagaaucaaaauucuuuuuaugccagguagcuggugacgcaaaggauaaagacaucaguugguucagcccuaacggcgagaagcugacgccaaaucagcaaagaauuuccguggucuggaacgaugacucuucgucaacccuaacaaucuacaaugccaacauugaugacgcggggaucuauaaaugugugguuacuggagaagauggcagcgagagugaagcuaccgugaaugucaagauauuucagaagcucauguucaaaaacgccccgacaccccaggaguuuagggagggugaagacgcagugaucguaugcgauguuguguccucucugccuccaaccauuaucuggaagcacaaagggcgggacgucauucuuaagaaagaugugcgcuucaucgugcugagcaauaacuacuugcagauacgaggaauuaagaagacugacgagggcacauaucguugugaaggcagaauccucgcccgcggggagauuaauuuuaaagacauccaagucaucguuaacgugcccccuaccauucaggcucggcagaauauaguaaacgcaacggccaaucugggacaguccgugacucuggucugcgaugcugaggguuucccagaacccaccaugucauggacaaaggacggcgagcaaaucgaacaggaggaagaugacgagaaauacauuuuuagugaugacagcucucagcucacuaucaagaaaguggauaagaacgacgaggccgaauauauauguauugcggagaauaaagcaggggaacaagaugccaccauccauuuaaagguuuucgcuaagccuaaaaucacauacguggagaaccagaccgccauggaacuggaggagcaggucacgcuuacuugcgaagcauccggagacccaauuccgucaaucacauggcgcaccagcacuagaaacauuaguucugaggaaaaggcuuccuggacaaggcccgagaaacaggaaaccuuggauggccacauggugguacggagccaugcccgcguuucgucucugacgcuaaaguccauacaauauaccgacgcgggugaguacaucuguacagccucaaauacuauugggcaggacagucagagcauguaccucgaggugcaguaugcaccuaaacugcaaggaccagucgcuguguacaccugggaaggcaaccaggucaauaucacaugcgagguguuugccuaucccuccgcuacuaucucuugguuccgagauggccagcuucugccuagcucaaacuacaguaauauuaagauauauaacaccccauccgccagcuacuuggaaguuacacccgacucugagaaugauuucgggaacuauaauuguaccgcagugaacagaaucggacaggagucacucgaauuuauucugguacaagccgacacuccgaguagcccuuccaucgaucaggucgagcccuacucuucgacggcucaggugcaguucgacgaaccagaggcgacagguggcguuccuauuuuaaaguacaaagcagaauggagggccgugggggaggaggucuggcacagcaagugguaugaugcuaaagaagccuccauggagggaaucgugaccauaguaggccugaagcccgaaacuaccuacgcagugcggcucgccgcucuuaaugguaaagggcugggcgagaucucagccgcaagugaauuuaagacacaaccaguucagggagagcccucugcgccuaaguuggagggccagaugggggaagacggaaacagcauuaaagucaaucuaaucaagcaagaugacgguggcuccccaauucgucauuaucuggugcgcuacagagcucucucaagcgaguggaaaccggaaaucaggcugcccucuggguccgaucacgugaugcuuaagagucuggacuggaacgccgaguaugaagucuacguuguggcagagaaucagcagggaaaaagcaaggccgcucacuucguguuucggaccucugcccagccuacugcaauaccagcuaacggcucccccacaucagguuugaguacgggggccauuguaggcauccucauugucaucuucgugcuguuacugguuguggucgauauaaccugcuauuuucuaaacaaguguggacucuucaugugcaucgcggugaaucugugcggcaaagccgggccuggagcuaaggguaaagacauggaggaaggcaaggcagccuuuagcaaagacgagucgaaggaaccaauuguugaggugcgaacugaggaagagaggacacccaaccaugaugggggaaaacacaccgaaccgaaugagacaacuccucuuaccgaaccagagaagggccccguagaggcuaagccugaaugucaagagacggaaaccaaacccgccccagcagaggucaagacagugccuaacgacgcgacucagaccaaagaaaaugaguccaaggccuga

SEQ ID NO: 942 - RNA, 2577 nt, Artificial Sequence
  derived and/or modified sequence opt4 from CD56__Homo_sapiens__CCDS73385.1
augcugcagaccaaggaccugaucuggacccuguucuuccugggcaccgccgugagccugcagguggacaucgugcccagccagggcgagaucagcgugggcgagagcaaguucuuccugugccagguggccggcgacgccaaggacaaggacaucagcugguucagccccaacggcgagaagcugacccccaaccagcagagaaucagcgugguguggaacgacgacagcagcagcacccugaccaucuacaacgccaacaucgacgacgccggcaucuacaagugcguggugaccggcgaggacggcagcgagagcgaggccaccgugaacgugaagaucuuccagaagcugauguucaagaacgcccccaccccccaggaguucagagagggcgaggacgccgugaucgugugcgacguggugagcagccugccccccaccaucaucuggaagcacaagggcagagacgugauccugaagaaggacgugagauucaucgugcugagcaacaacuaccugcagaucagaggcaucaagaagaccgacgagggcaccuacagaugcgagggcagaauccuggccagaggcgagaucaacuucaaggacauccaggugaucgugaacgugccccccaccauccaggccagacagaacaucgugaacgccaccgccaaccugggccagagcgugacccuggugugcgacgccgagggcuuccccgagcccaccaugagcuggaccaaggacggcgagcagaucgagcaggaggaggacgacgagaaguacaucuucagcgacgacagcagccagcugaccaucaagaagguggacaagaacgacgaggccgaguacaucugcaucgccgagaacaaggccggcgagcaggacgccaccauccaccugaagguguucgccaagcccaagaucaccuacguggagaaccagaccgccauggagcuggaggagcaggugacccugaccugcgaggccagcggcgaccccauccccagcaucaccuggagaaccagcaccagaaacaucagcagcgaggagaaggccagcuggaccagacccgagaagcaggagacccuggacggccacaugguggugagaagccacgccagagugagcagccugacccugaagagcauccaguacaccgacgccggcgaguacaucugcaccgccagcaacaccaucggccaggacagccagagcauguaccuggaggugcaguacgcccccaagcugcagggccccguggccguguacaccugggagggcaaccaggugaacaucaccugcgagguguucgccuaccccagcgccaccaucagcugguucagagacggccagcugcugcccagcagcaacuacagcaacaucaagaucuacaacacccccagcgccagcuaccuggaggugacccccgacagcgagaacgacuucggcaacuacaacugcaccgccgugaacagaaucggccaggagagccuggaguucauccuggugcaggccgacacccccagcagccccagcaucgaccagguggagcccuacagcagcaccgcccaggugcaguucgacgagcccgaggccaccggcggcgugcccauccugaaguacaaggccgaguggagagccgugggcgaggagguguggcacagcaagugguacgacgccaaggaggccagcauggagggcaucgugaccaucgugggccugaagcccgagaccaccuacgccgugagacuggccgcccugaacggcaagggccugggcgagaucagcgccgccagcgaguucaagacccagcccgugcagggcgagcccagcgcccccaagcuggagggccagaugggcgaggacggcaacagcaucaaggugaaccugaucaagcaggacgacggcggcagccccaucagacacuaccuggugagauacagagcccugagcagcgaguggaagcccgagaucagacugcccagcggcagcgaccacgugaugcugaagagccuggacuggaacgccgaguacgagguguacgugguggccgagaaccagcagggcaagagcaaggccgcccacuucguguucagaaccagcgcccagcccaccgccauccccgccaacggcagccccaccagcggccugagcaccggcgccaucgugggcauccugaucgugaucuucgugcugcugcugguggugguggacaucaccugcuacuuccugaacaagugcggccuguucaugugcaucgccgugaaccugugcggcaaggccggccccggcgccaagggcaaggacauggaggagggcaaggccgccuucagcaaggacgagagcaaggagcccaucguggaggugagaaccgaggaggagagaacccccaaccacgacggcggcaagcacaccgagcccaacgagaccaccccccugaccgagcccgagaagggccccguggaggccaagcccgagugccaggagaccgagaccaagcccgcccccgccgaggugaagaccgugcccaacgacgccacccagaccaaggagaacgagagcaaggccuga

SEQ ID NO: 943 - RNA, 2577 nt, Artificial Sequence
  derived and/or modified sequence opt5 from CD56__Homo_sapiens__CCDS73385.1
augcugcagaccaaggaccucaucuggacacuguucuuucuuggcacggccgugagccugcaagucgauauuguucccucccagggggagaucucugugggagaaagcaaauucuuucucugccagguggcuggcgacgccaaggauaaagacauuuccugguucucuccuaacggggagaagcugaccccgaaucagcaaagaaucagcgucguguggaacgaugacuccucuagcacacuuaccauuuacaaugcgaacaucgaugacgcuggaaucuauaaauguguugugacaggcgaagauggguccgagagcgaagccaccgucaaugugaagauuuuucagaagcugauguucaaaaacgcccccacaccucaggaguuucgggagggagaagacgcuguuaucgugugcgaugucgugucuucccugcccccuaccauuaucuggaagcacaaaggccgcgacgugauucucaagaaagaugucagauucaucguucugagcaauaacuaccuccagauucggggcaucaagaagacggacgaggggaccuaucgcugugaaggaagaauccuggcccggggcgagauuaauuuuaaagacauccaagugauugugaacgugcccccuacaauccaggcucgccagaauauugugaacgccaccgcgaaucuugggcagucuguuacacuggugugcgaugccgagggauucccggaacccaccauguccuggacgaaggacggcgagcaaaucgaacaggaggaagaugacgagaaauacaucuuuagcgaugacucuucccagcucacaauuaagaaagucgauaagaacgacgaggcugaauauaucuguauugccgagaauaaagcuggggaacaagaugccaccauccaucugaagguguucgcgaagccuaaaauuacauacguugagaaccagaccgccauggaacuugaggagcaggucacccugacaugcgaagcuagcggagaccccaucccuuccaucacguggagaaccucuacacggaacauuagcuccgaggaaaaggccagcuggacccgccccgagaaacaggaaacacucgauggccacauggucgugagaucucaugcucgggucuccagccugacccugaagucuauccaauauacggacgccggcgaguacauuuguacagccagcaauaccaucgggcaggacucccagucuauguaccucgaggugcaguaugcuccgaaacugcaaggaccuguugcgguguacaccugggaaggcaaccaggucaauauuacaugcgagguguuugccuaucccagcgcuaccaucuccugguuccgcgaugggcagcuucugccuagcucuaacuacuccaauauuaagaucuauaacacacccagcgccucuuaccucgaaguuacgcccgacuccgagaaugauuucggaaacuauaauuguaccgccgugaacagaaucggccaggagagccuggaauuuauucuuguccaagcugacacaccuuccucuccgagcaucgaucagguggagcccuacuccucuaccgcccaggugcaguucgacgaaccugaggcgacagggggaguucccauucugaaguacaaagcugaauggcgggccgucggcgaggagguguggcacagcaagugguaugaugccaaagaggcuuccauggagggcaucgugaccauugucgggcucaagccugaaacgaccuacgccgugcgccuggcugcccugaauggaaaaggccucggggagaucagcgcggccucugaauuuaagacacaacccguucagggagagccguccgcuccuaagcuggagggccagaugggggaagacggcaacagcaucaaagugaaucuuauuaagcaagaugacggaggcucucccaucagacauuaucugguccgguacagagcccucuccagcgaguggaaaccugaaauucgccugcccucugggagcgaucacgugaugcuuaagucccuggacuggaacgcugaguaugaaguuuacguggucgccgagaaucagcagggaaaaagcaaggcggcccacuucguguuucggaccucugcucagccuacagccauccccgcuaacggcuccccgaccagcgggcucuccacgggagccauuguuggcauccugaucgugauuuucguccugcuccuggugguggucgauaucacaugcuauuuucuuaacaagugugggcuguucaugugcauugccguuaaucucugcggcaaagcuggaccuggcgcgaaggggaaagacauggaggaaggaaaggccgcuuuuucuaaagacgagagcaaggaacccaucguggaggugagaaccgaggaagaacgcacacccaaccaugauggcgggaaacacaccgaaccuaaugagaccacaccgcugacggaacccgagaagggaccugucgaggccaagcccgaaugucaagagaccgaaacaaaaccugcccccgcugaggugaagaccguuccuaacgacgccacacagaccaaagaaaaugaguccaaggcguga

SEQ ID NO: 944 - protein, 288 aa, Artificial Sequence
  CD80__Homo_sapiens__A0N0P2
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 945 - RNA, 867 nt, Artificial Sequence
  CD80__Homo_sapiens__ABK41933
augggccacacacggaggcagggaacaucaccauccaaguguccauaccucaauuucuuucagcucuuggugcuggcuggucuuucucacuucuguucagguguuauccacgugaccaaggaagugaaagaaguggcaacgcuguccuguggucacaauguuucuguugaagagcuggcacaaacucgcaucuacuggcaaaaggagaagaaaauggugcugacuaugaugucuggggacaugaauauauggcccgaguacaagaaccggaccaucuuugauaucacuaauaaccucuccauugugauccuggcucugcgcccaucugacgagggcacauacgaguguguuguucugaaguaugaaaaagacgcuuucaagcgggaacaccuggcugaagugacguuaucagucaaagcugacuucccuacaccuaguauaucugacuuugaaauuccaacuucuaauauuagaaggauaauuugcucaaccucuggagguuuuccagagccucaccucuccugguuggaaaauggagaagaauuaaaugccaucaacacaacaguuucccaagauccugaaacugagcucuaugcuguuagcagcaaacuggauuucaauaugacaaccaaccacagcuucaugugucucaucaaguauggacauuuaagagugaaucagaccuucaacuggaauacaaccaagcaagagcauuuuccugauaaccugcucccauccugggccauuaccuuaaucucaguaaauggaauuuuugugauaugcugccugaccuacugcuuugccccaagaugcagagagagaaggaggaaugagagauugagaagggaaaguguacgcccuguauaa

SEQ ID NO: 946 - RNA, 867 nt, Artificial Sequence
  derived and/or modified sequence opt1 from CD80__Homo_sapiens__ABK41933
augggccacacccgccggcaggggaccagccccuccaagugcccguaccugaacuucuuccagcuccuggugcuggccggccucagccacuucugcuccggggucauccacgugacgaaggaggugaaggaggucgccacccugagcugcggccacaacguguccguggaggagcuggcccagacccgcaucuacuggcagaaggagaagaagaugguccucaccaugaugagcggggacaugaacaucuggcccgaguacaagaaccggacgaucuucgacaucaccaacaaccuguccaucgugauccuggcccuccgccccagcgacgagggcaccuacgagugcgugguccugaaguacgagaaggacgccuucaagcgggagcaccuggccgaggugacccucuccgugaaggccgacuuccccacgccgagcaucuccgacuucgagauccccaccagcaacauccgccggaucaucugcuccaccagcggcggguuccccgagccccaccuguccuggcuggagaacggcgaggagcucaacgcgaucaacaccacggucagccaggacccggagaccgagcuguacgccguguccagcaagcuggacuucaacaugaccaccaaccacuccuucaugugccucaucaaguacgggcaccuccgcgugaaccagacguucaacuggaacaccaccaagcaggagcacuuccccgacaaccugcugcccagcugggccaucacccugaucagcgucaacggcaucuucgugaucugcugccugacguacugcuucgcgccccggugccgcgagcggcgccggaacgagcgccuccggcgcgaguccgugcggccggucuga

SEQ ID NO: 947 - RNA, 867 nt, Artificial Sequence
  derived and/or modified sequence opt2 from CD80__Homo_sapiens__ABK41933
augggccacacccgccgccagggcaccucccccuccaagugccccuaccucaacuucuuccagcuccucguccucgccggccucucccacuucugcuccggcgucauccacgucaccaaggaggucaaggaggucgccacccucuccugcggccacaacgucuccgucgaggagcucgcccagacccgcaucuacuggcagaaggagaagaagaugguccucaccaugauguccggcgacaugaacaucuggcccgaguacaagaaccgcaccaucuucgacaucaccaacaaccucuccaucgucauccucgcccuccgccccuccgacgagggcaccuacgagugcgucguccucaaguacgagaaggacgccuucaagcgcgagcaccucgccgaggucacccucuccgucaaggccgacuuccccacccccuccaucuccgacuucgagauccccaccuccaacauccgccgcaucaucugcuccaccuccggcggcuuccccgagccccaccucuccuggcucgagaacggcgaggagcucaacgccaucaacaccaccgucucccaggaccccgagaccgagcucuacgccgucuccuccaagcucgacuucaacaugaccaccaaccacuccuucaugugccucaucaaguacggccaccuccgcgucaaccagaccuucaacuggaacaccaccaagcaggagcacuuccccgacaaccuccuccccuccugggccaucacccucaucuccgucaacggcaucuucgucaucugcugccucaccuacugcuucgccccccgcugccgcgagcgccgccgcaacgagcgccuccgccgcgaguccguccgccccgucuga

SEQ ID NO: 948 - RNA, 867 nt, Artificial Sequence
  derived and/or modified sequence opt3 from CD80__Homo_sapiens__ABK41933
augggccacaccagaaggcaggggacaagccccuccaagugcccuuaccugaacuucuuucaacuccuugugcuggccggauugucucauuucuguucaggugucauccacguuacuaaagaggugaaggaaguagcuacguuaaguugcggccauaaugugagcgucgaggaacuggcacagacccggauuuauuggcagaaagagaagaaaauggugcuaacaaugauguccggggacaugaacauauggccagaauacaagaaucgcacuaucuuugauauuaccaacaaucucucuaucguuauucuggcccuucgaccgucggacgagggaacauaugagugugugguccugaaguacgaaaaagaugcguucaagcgugagcacuuggcugaagugacccucucaguaaaagccgacuuucccacuccuagcaucagugauuucgagauaccaacauccaacaucagaaggauuaucugcucuaccagcggcgguuuucccgagccucaucuguccuggcuggaaaauggggaggaacucaacgcaauuaauacgacuguuucacaggacccagagaccgaauuauaugccgugaguagcaagcuggauuucaacaugacaacuaaucacucuuuuaugugucuuaucaaauacggacacuugcgggucaaccaaaccuucaauuggaacacaaccaagcaggagcauuuucccgacaaucugcuaccuuccugggcuauaacgcucauuucagugaacggcaucuucgugauuugcugucugacuuauugcuuugcaccacgcuguagagagaggcggcgcaacgaacgacuuagaagggagagcguccggccgguuuga

SEQ ID NO: 949 - RNA, 867 nt, Artificial Sequence
  derived and/or modified sequence opt4 from CD80__Homo_sapiens__ABK41933
augggccacaccagaagacagggcaccagccccagcaagugccccuaccugaacuucuuccagcugcuggugcuggccggccugagccacuucugcagcggcgugauccacgugaccaaggaggugaaggagguggccacccugagcugcggccacaacgugagcguggaggagcuggcccagaccagaaucuacuggcagaaggagaagaagauggugcugaccaugaugagcggcgacaugaacaucuggcccgaguacaagaacagaaccaucuucgacaucaccaacaaccugagcaucgugauccuggcccugagacccagcgacgagggcaccuacgagugcguggugcugaaguacgagaaggacgccuucaagagagagcaccuggccgaggugacccugagcgugaaggccgacuuccccacccccagcaucagcgacuucgagauccccaccagcaacaucagaagaaucaucugcagcaccagcggcggcuuccccgagccccaccugagcuggcuggagaacggcgaggagcugaacgccaucaacaccaccgugagccaggaccccgagaccgagcuguacgccgugagcagcaagcuggacuucaacaugaccaccaaccacagcuucaugugccugaucaaguacggccaccugagagugaaccagaccuucaacuggaacaccaccaagcaggagcacuuccccgacaaccugcugcccagcugggccaucacccugaucagcgugaacggcaucuucgugaucugcugccugaccuacugcuucgcccccagaugcagagagagaagaagaaacgagagacugagaagagagagcgugagacccguguga

SEQ ID NO: 950 - RNA, 867 nt, Artificial Sequence
  derived and/or modified sequence opt5 from CD80__Homo_sapiens__ABK41933
augggccacaccagacggcaggggacaagccccuccaagugcccuuaccugaacuucuuucaacuccuggugcuugccggacugucucauuucuguagcggcgucauccacguuacgaaagaggugaaggaaguggcuacccucuccugcgggcauaaugucucuguggaggaacuggcccagacacgcauuuauuggcagaaagagaagaaaaugguucuuaccaugaugagcggagacaugaacaucuggccggaauacaagaauagaacaauuuuugauaucaccaacaaucuguccauugugauccucgcgcugcggcccucugacgagggcacauaugagugugucgugcugaaguacgaaaaagaugcuuucaagcgcgagcaccucgccgaaguuacccugagcgugaaagccgacuuuccuacgcccuccaucagcgauuucgagauuccuaccucuaacaucagacggauuaucugcuccacaagcgggggauuucccgagccucaucuuucuuggcuggaaaauggcgaggaacucaacgcuauuaauaccacagucucccaggacccggagaccgaacuguaugccgugagcucuaaacuugauuucaacaugacgacaaaucacuccuuuaugugucugaucaaguacggccaccuccgcgugaaccaaaccuucaauuggaacacaaccaagcaggagcauuuucccgacaaucugcugccuagcugggcuauuacccucaucuccgucaacgggaucuucguuauuugcugucugacauauugcuuugcccccagaugucgggagcgcagacggaacgaacgccuuagacgggagucugugcgcccuguguga

SEQ ID NO: 951 - protein, 288 aa, Artificial Sequence; identical to SEQ ID NO: 944
  CD80__Homo_sapiens__P33681

SEQ ID NO: 952 - RNA, 867 nt, Artificial Sequence; identical to SEQ ID NO: 945
  CD80__Homo_sapiens__AAA36045

SEQ ID NO: 953 - RNA, 867 nt, Artificial Sequence; identical to SEQ ID NO: 946
  derived and/or modified sequence opt1 from CD80__Homo_sapiens__AAA36045

SEQ ID NO: 954 - RNA, 867 nt, Artificial Sequence; identical to SEQ ID NO: 947
  derived and/or modified sequence opt2 from CD80__Homo_sapiens__AAA36045

SEQ ID NO: 955 - RNA, 867 nt, Artificial Sequence; identical to SEQ ID NO: 948
  derived and/or modified sequence opt3 from CD80__Homo_sapiens__AAA36045

SEQ ID NO: 956 - RNA, 867 nt, Artificial Sequence; identical to SEQ ID NO: 949
  derived and/or modified sequence opt4 from CD80__Homo_sapiens__AAA36045

SEQ ID NO: 957 - RNA, 867 nt, Artificial Sequence; identical to SEQ ID NO: 950
  derived and/or modified sequence opt5 from CD80__Homo_sapiens__AAA36045

SEQ ID NO: 958 - protein, 329 aa, Artificial Sequence
  CD86__Homo_sapiens__P42081
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 959 - RNA, 990 nt, Artificial Sequence
  CD86__Homo_sapiens__CCDS3009.1
auggauccccagugcacuaugggacugaguaacauucucuuugugauggccuuccugcucucuggugcugcuccucugaagauucaagcuuauuucaaugagacugcagaccugccaugccaauuugcaaacucucaaaaccaaagccugagugagcuaguaguauuuuggcaggaccaggaaaacuugguucugaaugagguauacuuaggcaaagagaaauuugacaguguucauuccaaguauaugggccgcacaaguuuugauucggacaguuggacccugagacuucacaaucuucagaucaaggacaagggcuuguaucaauguaucauccaucacaaaaagcccacaggaaugauucgcauccaccagaugaauucugaacugucagugcuugcuaacuucagucaaccugaaauaguaccaauuucuaauauaacagaaaauguguacauaaauuugaccugcucaucuauacacgguuacccagaaccuaagaagaugaguguuuugcuaagaaccaagaauucaacuaucgaguaugaugguguuaugcagaaaucucaagauaaugucacagaacuguacgacguuuccaucagcuugucuguuucauucccugauguuacgagcaauaugaccaucuucuguauucuggaaacugacaagacgcggcuuuuaucuucaccuuucucuauagagcuugaggacccucagccucccccagaccacauuccuuggauuacagcuguacuuccaacaguuauuauaugugugaugguuuucugucuaauucuauggaaauggaagaagaagaagcggccucgcaacucuuauaaauguggaaccaacacaauggagagggaagagagugaacagaccaagaaaagagaaaaaauccauauaccugaaagaucugaugaagcccagcguguuuuuaaaaguucgaagacaucuucaugcgacaaaagugauacauguuuuuaa

SEQ ID NO: 960 - RNA, 990 nt, Artificial Sequence
  derived and/or modified sequence opt1 from CD86__Homo_sapiens__CCDS3009.1
auggacccccagugcaccaugggccugagcaacauccucuucgugauggccuuccugcuguccggggccgcgccgcucaagauccaggccuacuucaacgagaccgccgaccugcccugccaguucgccaacagccagaaccagucccugagcgagcucgucguguucuggcaggaccaggagaaccuggugcugaacgaggucuaccucggcaaggagaaguucgacuccgugcacagcaaguacauggggcgcaccuccuucgacagcgacuccuggacccugcggcugcacaaccuccagaucaaggacaagggccuguaccagugcaucauccaccacaagaagcccaccgggaugauccgcauccaccagaugaacagcgagcuguccgugcucgccaacuucagccagcccgagaucgucccgaucuccaacaucaccgagaacguguacaucaaccugacgugcagcuccauccacggcuaccccgagcccaagaagaugagcgugcugcuccggaccaagaacuccaccaucgaguacgacggcgucaugcagaagucccaggacaacgugaccgagcuguacgacgugagcaucagccugagcgucuccuuccccgacgugacgagcaacaugaccaucuucugcauccucgagaccgacaagacccgccugcuguccagcccguucuccaucgagcucgaggacccccagcccccgcccgaccacauccccuggaucacggcggugcugcccaccgucaucaucugcgugaugguguucugccugauccucuggaaguggaagaagaagaagcggccccgcaacagcuacaagugcgggaccaacaccauggagcgggaggaguccgagcagacgaagaagcgcgagaagauccacaucccggagcggagcgacgaggcccagcgcgucuucaaguccagcaagaccuccagcugcgacaaguccgacacgugcuucuga

SEQ ID NO: 961 - RNA, 990 nt, Artificial Sequence
  derived and/or modified sequence opt2 from CD86__Homo_sapiens__CCDS3009.1
auggacccccagugcaccaugggccucuccaacauccucuucgucauggccuuccuccucuccggcgccgccccccucaagauccaggccuacuucaacgagaccgccgaccuccccugccaguucgccaacucccagaaccagucccucuccgagcucgucgucuucuggcaggaccaggagaaccucguccucaacgaggucuaccucggcaaggagaaguucgacuccguccacuccaaguacaugggccgcaccuccuucgacuccgacuccuggacccuccgccuccacaaccuccagaucaaggacaagggccucuaccagugcaucauccaccacaagaagcccaccggcaugauccgcauccaccagaugaacuccgagcucuccguccucgccaacuucucccagcccgagaucguccccaucuccaacaucaccgagaacgucuacaucaaccucaccugcuccuccauccacggcuaccccgagcccaagaagauguccguccuccuccgcaccaagaacuccaccaucgaguacgacggcgucaugcagaagucccaggacaacgucaccgagcucuacgacgucuccaucucccucuccgucuccuuccccgacgucaccuccaacaugaccaucuucugcauccucgagaccgacaagacccgccuccucuccucccccuucuccaucgagcucgaggacccccagcccccccccgaccacauccccuggaucaccgccguccuccccaccgucaucaucugcgucauggucuucugccucauccucuggaaguggaagaagaagaagcgcccccgcaacuccuacaagugcggcaccaacaccauggagcgcgaggaguccgagcagaccaagaagcgcgagaagauccacauccccgagcgcuccgacgaggcccagcgcgucuucaaguccuccaagaccuccuccugcgacaaguccgacaccugcuucuga

SEQ ID NO: 962 - RNA, 990 nt, Artificial Sequence
  derived and/or modified sequence opt3 from CD86__Homo_sapiens__CCDS3009.1
auggacccccagugcaccaugggccugagcaacauccucuucgugauggccuuucuucuguccggggcugcaccuuugaagauucaagccuacuucaaugagacagcggauuuaccaugucaguuugcuaacucucagaaucagucacugagugagcuagucguuuucuggcaagaccaggaaaaccucgugcugaaugaaguauaucuuggaaaagagaaguuugauagcgugcacuccaaauacauggguagaacuucuuucgacucggauucauggacgcugagguugcauaaccuccagauaaaggacaaaggccuguaucagugcaucauucaccauaagaagccgaccgggaugauccggauucaccaaaugaauagcgaacugaguguccucgccaacuuuucccagcccgagaucgugccuauaucuaauaucacagagaacguuuacauuaauuuaacuuguagcuccauccauggauauccagaacccaaaaagaugucagugcugcuucgcaccaaaaacaguacaauugaguacgauggcgucaugcagaagagucaggacaaugugaccgaauuguaugauguaucuaucucccugucaguuagcuucccugacgugacuagcaacaugacaauauuuugcauucuagagaccgauaaaacgcgacuccugucuuccccauucagcaucgagcuugaagacccccaaccuccaccggaucacauucccuggaucacugcaguccugccuaccgugaucauuugugugauggucuuuugcuugauacucuggaaguggaagaaaaagaaacguccaagaaauucguacaagugugguacaaacacuauggagagggaagagucugaacagaccaaaaagcgggagaaaauccacauucccgagcgcuccgacgaagcccagagaguuuucaagucaaguaagacaagcuccugcgacaaaucugauaccuguuuuuga

SEQ ID NO: 963 - RNA, 990 nt, Artificial Sequence
  derived and/or modified sequence opt4 from CD86__Homo_sapiens__CCDS3009.1
auggacccccagugcaccaugggccugagcaacauccuguucgugauggccuuccugcugagcggcgccgccccccugaagauccaggccuacuucaacgagaccgccgaccugcccugccaguucgccaacagccagaaccagagccugagcgagcuggugguguucuggcaggaccaggagaaccuggugcugaacgagguguaccugggcaaggagaaguucgacagcgugcacagcaaguacaugggcagaaccagcuucgacagcgacagcuggacccugagacugcacaaccugcagaucaaggacaagggccuguaccagugcaucauccaccacaagaagcccaccggcaugaucagaauccaccagaugaacagcgagcugagcgugcuggccaacuucagccagcccgagaucgugcccaucagcaacaucaccgagaacguguacaucaaccugaccugcagcagcauccacggcuaccccgagcccaagaagaugagcgugcugcugagaaccaagaacagcaccaucgaguacgacggcgugaugcagaagagccaggacaacgugaccgagcuguacgacgugagcaucagccugagcgugagcuuccccgacgugaccagcaacaugaccaucuucugcauccuggagaccgacaagaccagacugcugagcagccccuucagcaucgagcuggaggacccccagcccccccccgaccacauccccuggaucaccgccgugcugcccaccgugaucaucugcgugaugguguucugccugauccuguggaaguggaagaagaagaagagacccagaaacagcuacaagugcggcaccaacaccauggagagagaggagagcgagcagaccaagaagagagagaagauccacauccccgagagaagcgacgaggcccagagaguguucaagagcagcaagaccagcagcugcgacaagagcgacaccugcuucuga

SEQ ID NO: 964 - RNA, 990 nt, Artificial Sequence
  derived and/or modified sequence opt5 from CD86__Homo_sapiens__CCDS3009.1
auggacccccagugcaccaugggccugagcaacauccucuucgugauggccuuucugcuuuccggggcugccccucugaagauucaagcguacuucaaugagacagcugaucucccgugucaguuugccaacucucagaaucagagccuguccgaacuugucguuuucuggcaagaccaggagaaccuggugcucaaugaaguguaucugggaaaagagaaguuugauucuguccacagcaaauacaugggcagaacguccuucgacucugauagcuggacccugcggcuccauaaccugcagaucaaggacaaagggcuuuaucagugcauuauccaccauaagaagcccacaggaaugauucgcauccaccaaaugaacuccgaacugagcgugcucgccaauuuuucucagccugagaucguucccauuuccaauaucaccgagaacguguacauuaaucugacauguagcucuauccauggcuauccugaacccaaaaagauguccguccuucugagaaccaaaaacagcacaauugaguacgauggggugaugcagaagucucaggacaauguuaccgaacucuaugauguguccaucagccuguccgucucuuucccugacgugacgagcaacaugaccaucuuuugcauucuggagacagauaaaacccggcuccuguccagcccguucucuaucgagcuugaagacccccaaccucccccugaucacauucccuggaucacagcugugcugccgaccgucauuaucuguguuaugguguuuugccucauucuguggaaguggaagaaaaagaaacgcccuagaaauuccuacaaguguggaacgaacacaauggagcgggaagagagcgaacagaccaaaaagcgcgagaaaauccacauccccgagagaucugacgaagcccagcggguguucaagagcuccaagacaucuagcugcgacaaauccgauaccuguuuuuga

SEQ ID NO: 965 - protein, 235 aa, Artificial Sequence
  CD8A__Homo_sapiens__P01732
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 966 - RNA, 708 nt, Artificial Sequence
  CD8A__Homo_sapiens__AAA59674
auggccuuaccagugaccgccuugcuccugccgcuggccuugcugcuccacgccgccaggccgagccaguuccgggugucgccgcuggaucggaccuggaaccugggcgagacaguggagcugaagugccaggugcugcuguccaacccgacgucgggcugcucguggcucuuccagccgcgcggcgccgccgccagucccaccuuccuccuauaccucucccaaaacaagcccaaggcggccgaggggcuggacacccagcgguucucgggcaagagguugggggacaccuucguccucacccugagcgacuuccgccgagagaacgagggcuacuauuucugcucggcccugagcaacuccaucauguacuucagccacuucgugccggucuuccugccagcgaagcccaccacgacgccagcgccgcgaccaccaacaccggcgcccaccaucgcgucgcagccccugucccugcgcccagaggcgugccggccagcggcggggggcgcagugcacacgagggggcuggacuucgccugugauaucuacaucugggcgccccuggccgggacuugugggguccuucuccugucacugguuaucacccuuuacugcaaccacaggaaccgaagacguguuugcaaauguccccggccuguggucaaaucgggagacaagcccagccuuucggcgagauacgucuaa

SEQ ID NO: 967 - RNA, 708 nt, Artificial Sequence
  derived and/or modified sequence opt1 from CD8A__Homo_sapiens__AAA59674
auggcccugcccgugaccgcccuccugcugccgcucgcgcugcugcuccacgccgcccgccccagccaguuccgggucagcccccuggaccgcaccuggaaccugggcgagacgguggagcucaagugccaggugcugcugagcaaccccaccuccgggugcagcuggcuguuccagccgcggggcgccgccgcgucccccaccuuccuccuguaccucagccagaacaagcccaaggccgccgaggggcuggacacccagcgcuucuccggcaagcggcugggggacacguucguccucacccugagcgacuuccgccgggagaacgagggcuacuacuucugcuccgcccugagcaacuccaucauguacuucagccacuucgugcccguguuccucccggcgaagcccaccaccacgcccgcgccccgcccgcccacccccgcccccaccaucgccucccagccgcugagccugcggcccgaggccugccgccccgccgccggcggggccguccacacccggggccucgacuucgccugcgacaucuacaucugggcgccccuggccgggacgugcggcgugcugcuccugucccuggugaucacccucuacugcaaccaccgcaaccggcgccgggucugcaagugcccgcgccccguggugaaguccggggacaagcccucccugagcgcccgguacgucuga

SEQ ID NO: 968 - RNA, 708 nt, Artificial Sequence
  derived and/or modified sequence opt2 from CD8A__Homo_sapiens__AAA59674
auggcccuccccgucaccgcccuccuccucccccucgcccuccuccuccacgccgcccgccccucccaguuccgcgucuccccccucgaccgcaccuggaaccucggcgagaccgucgagcucaagugccagguccuccucuccaaccccaccuccggcugcuccuggcucuuccagccccgcggcgccgccgccucccccaccuuccuccucuaccucucccagaacaagcccaaggccgccgagggccucgacacccagcgcuucuccggcaagcgccucggcgacaccuucguccucacccucuccgacuuccgccgcgagaacgagggcuacuacuucugcuccgcccucuccaacuccaucauguacuucucccacuucguccccgucuuccuccccgccaagcccaccaccacccccgccccccgcccccccacccccgcccccaccaucgccucccagccccucucccuccgccccgaggccugccgccccgccgccggcggcgccguccacacccgcggccucgacuucgccugcgacaucuacaucugggccccccucgccggcaccugcggcguccuccuccucucccucgucaucacccucuacugcaaccaccgcaaccgccgccgcgucugcaagugcccccgccccgucgucaaguccggcgacaagcccucccucuccgcccgcuacgucuga

SEQ ID NO: 969 - RNA, 708 nt, Artificial Sequence
  derived and/or modified sequence opt3 from CD8A__Homo_sapiens__AAA59674
auggcccugcccgugaccgcucuccuucugccuuuggcauuacugcuacacgccgcgagaccaagccaguucagggucuccccgcucgaccggacauggaaccugggcgagacuguugaacuuaagugccaagugcuguugucuaaucccacgucaggguguaguuggcucuuucagccucgcggagcugccgcaagcccaaccuuccugcuguaccucucccagaacaaacccaaggccgcugaggguuuagauacacagcgauuuucuggcaaacgucugggggacacuuucguacuuaccuugucggauuuuagaagggaaaaugagggauauuacuucugcucagcacugagcaacaguaucauguauuuuucccauuucgugccugucuuucuaccagccaagcccacaaccacuccugcuccacggccgcccaccccugccccaacaauugcgucucaaccccucagccugcgcccugaagcauguagaccagccgcuggcggugccgugcacacgagggggcuugacuucgcaugcgauauauacaucugggcuccccuggccggaacuuguggcguuuugcuccuguccuuagugauuacccuguauugcaaucaucggaaccgccgaagagucuguaaaugcccgaggccugugguaaagucaggcgacaagcccagucucagcgcgcgguacguuuga

SEQ ID NO: 970 - RNA, 708 nt, Artificial Sequence
  derived and/or modified sequence opt4 from CD8A__Homo_sapiens__AAA59674
auggcccugcccgugaccgcccugcugcugccccuggcccugcugcugcacgccgccagacccagccaguucagagugagcccccuggacagaaccuggaaccugggcgagaccguggagcugaagugccaggugcugcugagcaaccccaccagcggcugcagcuggcuguuccagcccagaggcgccgccgccagccccaccuuccugcuguaccugagccagaacaagcccaaggccgccgagggccuggacacccagagauucagcggcaagagacugggcgacaccuucgugcugacccugagcgacuucagaagagagaacgagggcuacuacuucugcagcgcccugagcaacagcaucauguacuucagccacuucgugcccguguuccugcccgccaagcccaccaccacccccgcccccagaccccccacccccgcccccaccaucgccagccagccccugagccugagacccgaggccugcagacccgccgccggcggcgccgugcacaccagaggccuggacuucgccugcgacaucuacaucugggccccccuggccggcaccugcggcgugcugcugcugagccuggugaucacccuguacugcaaccacagaaacagaagaagagugugcaagugccccagacccguggugaagagcggcgacaagcccagccugagcgccagauacguguga

SEQ ID NO: 971 - RNA, 708 nt, Artificial Sequence
  derived and/or modified sequence opt5 from CD8A__Homo_sapiens__AAA59674
auggcccugcccgugaccgcucuccugcuuccucuggcccuccugcuucacgcggcuagaccgagccaguuccgggucucuccccuggaccgcacauggaaccucggcgagacgguugaacugaagugccaagugcugcucuccaauccuaccagcggguguuccuggcuguuucagcccagaggagccgccgcuucuccuacauuccuucuguaccucagccagaacaaacccaaggccgcugagggccuggauacccagcgguuuuccgggaaacgccuuggagacacauucgugcugacccucucugauuuuagacgggaaaaugagggcuauuacuucugcagcgcccuguccaacagcaucauguauuuuucucauuucgucccuguguuucugccggcgaagcccacaaccacgccugcgccccgcccucccaccccggcuccuacaauugccucccaaccccucagccugagaccugaagccugucggcccgccgccgggggagccguucacacccgcggccuugacuucgcuugcgauaucuacauuugggcuccccuggcuggcacauguggggugcuccugcuuucucuggucaucacccucuauugcaaucauagaaaccggcgcagaguguguaaaugcccucggccgguugugaaguccggagacaagcccagccugucugcccgcuacgucuga

SEQ ID NO: 972 - protein, 823 aa, Artificial Sequence
  CDC27/m__Homo_sapiens__G5EA36
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 973 - RNA, 2472 nt, Artificial Sequence
  CDC27/m__Homo_sapiens__EAW57688
augacggugcugcaggaacccguccaggcugcuauauggcaagcacuaaaccacuaugcuuaccgagaugcgguuuuccucgcagaacgccuuuaugcagaaguacacucagaagaagccuuguuuuuacuggcaaccuguuauuaccgcucaggaaaggcauauaaagcauauagacucuugaaaggacacaguuguacuacaccgcaaugcaaauaccugcuugcaaaauguuguguugaucucagcaagcuugcagaaggggaacaaaucuuaucugguggaguguuuaauaagcagaaaagccaugaugauauuguuacugaguuuggugauucagcuugcuuuacucuuucauuguugggacauguauauugcaagacagaucggcuugccaaaggaucagaauguuaccaaaagagccuuaguuuaaauccuuuccucuggucucccuuugaaucauuaugugaaauaggugaaaagccagauccugaccaaacauuuaaauucacaucuuuacagaacuuuagcaacugucugcccaacucuugcacaacacaaguaccuaaucauaguuuaucucacagacagccugagacaguucuuacggaaacaccccaggacacaauugaauuaaacagauugaauuuagaaucuuccaauucaaaguacuccuugaauacagauuccucagugucuuauauugauucagcuguaauuucaccugauacugucccacugggaacaggaacuuccauauuaucuaaacagguucaaaauaaaccaaaaacuggucgaaguuuauuaggaggaccagcagcucuuaguccauuaaccccaaguuuugggauuuugccauuagaaaccccaaguccuggagauggauccuauuuacaaaacuacacuaauacaccuccuguaauugaugugccauccaccggagccccuucaaaaaagucuguugccagaaucggccaaacuggaacaaagucugucuucucacagaguggaaauagccgagagguaacuccaauucuugcacaaacacaaaguucugguccacaaacaaguacaacaccucagguauugagccccacuauuacaucucccccaaacgcacugccucgaagaaguucacgacucuuuacuagugacagcuccacaaccaaggagaauagcaaaaaauuaaaaaugaaguuuccaccuaaaaucccaaacagaaaaacaaaaaguaaaacuaauaaaggaggaauaacucaaccuaacauaaaugauagccuggaaauuacaaaauuggacucuuccaucauuucagaagggaaaauauccacaaucacaccucagauucaggccuuuaaucuacaaaaagcagcagcagguuugaugagccuucuucgugaaauggggaaagguuauuuagcuuuguguucauacaacugcaaagaagcuauaaauauuuugagccaucuaccuucucaccacuacaauacugguuggguacugugccaaauuggaagggccuauuuugaacuuucagaguacaugcaagcugaaagaauauucucagagguuagaaggauugagaauuauagaguugaaggcauggagaucuacucuacaacacuuuggcaucuucaaaaagauguugcucuuucaguucugucaaaagacuuaacagacauggauaaaaauucgccagaggccuggugugcugcagggaacuguuucagucugcaacgggaacaugauauugcaauuaaauucuuccagagagcuauccaaguugauccaaauuacgcuuaugccuauacucuauuagggcaugaguuugucuuaacugaagaauuggacaaagcauuagcuuguuuucgaaaugcuaucagagucaauccuagacauuauaaugcaugguaugguuuaggaaugauuuauuacaagcaagaaaaauucagccuugcagaaaugcauuuccaaaaagcgcuugauaucaacccucaaaguucaguuuuacuuugccacauuggaguaguucaacaugcacugaaaaaaucagagaaggcuuuggauacccuaaacaaagccauugucauugaucccaagaacccucuaugcaaauuucacagagccucaguuuuauuugcaaaugaaaaauauaagucugcuuuacaagaacuugaagaauugaaacaaauuguucccaaagaaucccucguuuacuucuuaauaggaaagguuuacaagaaguuaggucaaacgcaccucgcccugaugaauuucucuugggcuauggauuuagauccuaaaggagccaauaaccagauuaaagaggcaauugauaagcguuaucuuccagaugaugaggagccaauaacccaagaagaacagaucaugggaacagaugaaucccaggagagcagcaugacagaugcggaugacacacaacuucaugcagcugaaagugaugaauuuuaa

SEQ ID NO: 974 - RNA, 2472 nt, Artificial Sequence
  derived and/or modified sequence opt1 from CDC27/m__Homo_sapiens__EAW57688
augaccgugcugcaggagcccguccaggccgccaucuggcaggcgcucaaccacuacgccuaccgcgacgccguguuccuggccgagcggcuguacgccgaggugcacagcgaggaggcccucuuccugcuggcgaccugcuacuaccgcuccggcaaggccuacaaggccuaccggcuccugaaggggcacagcugcacgaccccgcagugcaaguaccugcucgcgaagugcugcgucgaccuguccaagcuggccgagggcgagcagauccucagcgggggcguguucaacaagcagaagucccacgacgacaucgugaccgaguucggggacagcgccugcuucacccugucccugcucggccacgucuacugcaagacggaccgccuggccaagggcagcgagugcuaccagaagucccugagccucaaccccuuccuguggucccccuucgagagccugugcgagaucggggagaagcccgacccggaccagaccuucaaguucaccucccuccagaacuucagcaacugccugcccaacuccugcaccacccaggugcccaaccacagccugucccaccggcagcccgagaccgugcucaccgagaccccgcaggacacgaucgagcugaaccgccugaaccucgagagcuccaacagcaaguacagccugaacaccgacuccagcgucuccuacaucgacagcgccgugaucucccccgacaccgugccccugggcaccgggacgagcauccucuccaagcagguccagaacaagcccaagaccggccggagccugcucgggggcccggcggcccugagcccccugacgcccuccuucggcauccugccccucgagaccccgucccccggggacggcagcuaccugcagaacuacacgaacaccccgcccgugaucgacgugcccuccaccggggcgcccagcaagaaguccgucgcccgcaucggccagaccggcaccaagagcguguucucccagagcgggaacucccgggaggugacgcccauccuggcccagacccagagcagcggcccccagaccuccacgaccccgcagguccucagccccaccaucaccuccccgcccaacgcccugccccgccggagcucccgccuguucacgagcgacuccagcaccaccaaggagaacuccaagaagcucaagaugaaguucccgcccaagauccccaaccggaagaccaagagcaagacgaacaagggcgggaucacccagcccaacaucaacgacucccuggagaucaccaagcuggacagcuccaucaucagcgaggggaagaucuccaccaucacgccccagauccaggccuucaaccuccagaaggccgccgccggccugaugagccugcuccgcgagaugggcaagggguaccuggcgcugugcuccuacaacugcaaggaggccaucaacauccugagccaccuccccagccaccacuacaacaccggcugggugcugugccagaucgggcgggccuacuucgagcuguccgaguacaugcaggccgagcgcaucuucagcgaggugcggcgcaucgagaacuaccgggucgagggcauggagaucuacuccaccacccucuggcaccuccagaaggacguggcccugagcgugcuguccaaggaccugaccgacauggacaagaacagcccggaggcguggugcgccgccgggaacugcuucucccugcagcgcgagcacgacaucgccaucaaguucuuccagcgggcgauccaggucgaccccaacuacgccuacgccuacacgcuccugggccacgaguucgugcugaccgaggagcucgacaaggcccuggccugcuuccgcaacgcgauccgcgucaacccccggcacuacaacgccugguacggccuggggaugaucuacuacaagcaggagaaguucagccucgccgagaugcacuuccagaaggcccuggacaucaacccccaguccagcgugcugcucugccacaucggcgugguccagcacgcccugaagaaguccgagaaggcgcuggacacccucaacaaggccaucgugaucgacccgaagaacccccugugcaaguuccaccgcgccagcgugcuguucgccaacgagaaguacaaguccgcccuccaggagcuggaggagcugaagcagaucguccccaaggagagccucguguacuuccugaucgggaagguguacaagaagcugggccagacccaccucgcgcugaugaacuucuccugggccauggaccuggaccccaagggggccaacaaccagaucaaggaggccaucgacaagcgguaccucccggacgacgaggagcccaucacgcaggaggagcagaucaugggcaccgacgagagccaggaguccagcaugaccgacgcggacgacacccagcugcacgccgccgaguccgacgaguucuga

SEQ ID NO: 975 - RNA, 2472 nt, Artificial Sequence
  derived and/or modified sequence opt2 from CDC27/m__Homo_sapiens__EAW57688
augaccguccuccaggagcccguccaggccgccaucuggcaggcccucaaccacuacgccuaccgcgacgccgucuuccucgccgagcgccucuacgccgagguccacuccgaggaggcccucuuccuccucgccaccugcuacuaccgcuccggcaaggccuacaaggccuaccgccuccucaagggccacuccugcaccaccccccagugcaaguaccuccucgccaagugcugcgucgaccucuccaagcucgccgagggcgagcagauccucuccggcggcgucuucaacaagcagaagucccacgacgacaucgucaccgaguucggcgacuccgccugcuucacccucucccuccucggccacgucuacugcaagaccgaccgccucgccaagggcuccgagugcuaccagaagucccucucccucaaccccuuccucuggucccccuucgagucccucugcgagaucggcgagaagcccgaccccgaccagaccuucaaguucaccucccuccagaacuucuccaacugccuccccaacuccugcaccacccagguccccaaccacucccucucccaccgccagcccgagaccguccucaccgagaccccccaggacaccaucgagcucaaccgccucaaccucgaguccuccaacuccaaguacucccucaacaccgacuccuccgucuccuacaucgacuccgccgucaucucccccgacaccgucccccucggcaccggcaccuccauccucuccaagcagguccagaacaagcccaagaccggccgcucccuccucggcggccccgccgcccucuccccccucacccccuccuucggcauccucccccucgagacccccucccccggcgacggcuccuaccuccagaacuacaccaacaccccccccgucaucgacguccccuccaccggcgcccccuccaagaaguccgucgcccgcaucggccagaccggcaccaaguccgucuucucccaguccggcaacucccgcgaggucacccccauccucgcccagacccaguccuccggcccccagaccuccaccaccccccagguccucucccccaccaucaccuccccccccaacgcccucccccgccgcuccucccgccucuucaccuccgacuccuccaccaccaaggagaacuccaagaagcucaagaugaaguucccccccaagauccccaaccgcaagaccaaguccaagaccaacaagggcggcaucacccagcccaacaucaacgacucccucgagaucaccaagcucgacuccuccaucaucuccgagggcaagaucuccaccaucaccccccagauccaggccuucaaccuccagaaggccgccgccggccucaugucccuccuccgcgagaugggcaagggcuaccucgcccucugcuccuacaacugcaaggaggccaucaacauccucucccaccuccccucccaccacuacaacaccggcuggguccucugccagaucggccgcgccuacuucgagcucuccgaguacaugcaggccgagcgcaucuucuccgagguccgccgcaucgagaacuaccgcgucgagggcauggagaucuacuccaccacccucuggcaccuccagaaggacgucgcccucuccguccucuccaaggaccucaccgacauggacaagaacucccccgaggccuggugcgccgccggcaacugcuucucccuccagcgcgagcacgacaucgccaucaaguucuuccagcgcgccauccaggucgaccccaacuacgccuacgccuacacccuccucggccacgaguucguccucaccgaggagcucgacaaggcccucgccugcuuccgcaacgccauccgcgucaacccccgccacuacaacgccugguacggccucggcaugaucuacuacaagcaggagaaguucucccucgccgagaugcacuuccagaaggcccucgacaucaacccccaguccuccguccuccucugccacaucggcgucguccagcacgcccucaagaaguccgagaaggcccucgacacccucaacaaggccaucgucaucgaccccaagaacccccucugcaaguuccaccgcgccuccguccucuucgccaacgagaaguacaaguccgcccuccaggagcucgaggagcucaagcagaucguccccaaggagucccucgucuacuuccucaucggcaaggucuacaagaagcucggccagacccaccucgcccucaugaacuucuccugggccauggaccucgaccccaagggcgccaacaaccagaucaaggaggccaucgacaagcgcuaccuccccgacgacgaggagcccaucacccaggaggagcagaucaugggcaccgacgagucccaggaguccuccaugaccgacgccgacgacacccagcuccacgccgccgaguccgacgaguucuga

SEQ ID NO: 976 - RNA, 2472 nt, Artificial Sequence
  derived and/or modified sequence opt3 from CDC27/m__Homo_sapiens__EAW57688
augaccgugcugcaggagcccguccaagccgcuaucuggcaggcacucaaccacuacgccuauagagacgcgguuuuccuugcugaaaggcuguacgccgaggugcauagcgaagaggcauuguuuuuacuggccacaugcuauuaccgguccggcaaggcuuauaaagcauaccgccuacucaaggggcacucuuguacuacgccucagugcaaauaucugcuugccaaguguugcguagaucugucaaaauuggcugaaggagagcagauucucagugguggcguguucaauaagcaaaagagccaugacgauauagucaccgaguuuggggacuccgccuguuucacacugucucugcucggacacguguacugcaaaacugaucgauuagcgaagggcucggaauguuaccagaaaucacugagccuuaacccauuuuuguggaguccguucgagucccugugcgaaaucggugagaagcccgacccugaucagaccuuuaaauucacaucucuacagaauuuuagcaacugucucccaaauuccugcaccacucaaguucccaaccauucacugagucaccgucagccugagacagugcuuaccgaaacgccacaggacacuauugagcugaauagauugaaccucgaaagcucuaauuccaaguauucacugaacaccgauagcagugucucuuacaucgacuccgcagugauuagccccgauacaguaccuuuagggacuggaaccucgauccugucuaagcagguucaaaauaaaccaaagacaggcaggucccuccuuggcgggccggccgcucugucacccuugaccccuaguuucggaauacuaccacuggagacgcccagcccuggugacggcuccuaucuccagaacuacacuaauacaccacccgugaucgaugucccgucuaccggggccccuagcaaaaagucaguggcacggauuggacagacuggcacaaaaaguguguuuucccaaagcgguaacucucgcgaagucacccccauccuggcucagacgcagucaagugggccacagaccagcacaacuccucaaguucuuucccccaccauuacaucuccacccaaugcccugccuagaaggucgagccgguuguucacuuccgacucaaguaccacaaaggagaacucuaaaaagcucaagaugaaauuuccaccgaagauccccaaccgcaaaaccaagagcaaaacuaauaagggaggcauaacgcagccuaacauuaaugacucccuggagaucacaaaguuagauucaagcauuaucucugaaggcaaaaucuccaccauuacuccacagauacaggcguucaaccugcaaaaggccgcagcugggcuaaugagucuccugcgagagaugggaaaagguuaucuugccuuguguagcuacaauugcaaggaagcuaucaacauucugucucaccuccccucccaucacuauaauaccggcugggugcugugccagaucgggagagccuacuucgagcuuucagaauacaugcaggcagagaggauauuuagugagguacggcguauugaaaacuaucgcguggagggaauggaaaucuacagcacaacccuguggcauuugcagaaagacgucgcccucucggugcuguccaaggauuuaacugacauggauaaaaauucuccugaggcuuggugugcggcaggcaacugcuucagccugcaaagagaacacgacaucgccauuaaguuuuuccagagggcuauccagguugauccaaauuaugccuacgcauauacacuacucggucacgaguuugugcugacggaggaacuugacaaggccuuggcuuguuuccggaacgccauucgagucaauccccgccauuacaacgcaugguaugggcugggcaugauauacuacaaacaggagaaguuuucacucgcggaaaugcacuuccaaaaagcucuggauaucaauccgcagaguuccguguuacugugccauauuggaguaguucagcacgcccuuaagaagucugagaaagcauuggacacccucaacaaggccaucgugaucgauccuaaaaacccacuguguaaguuucauagagcuagcguccuauucgccaaugagaaauauaaguccgcacugcaagaacucgaggaacugaaacagauugugcccaaggagucacuugucuacuuuuugauaggcaagguguauaaaaagcuggggcagacucacuuagcucucaugaacuucagcugggccauggaccuggacccuaaaggagcgaauaaccagaucaaggaagccauugauaaaagguaccuucccgacgaugaggagccaaucacacaagaggaacagauuauggguaccgacgaaagucaggagucuuccaugacagaugcugacgauacucagcugcacgcagccgaaagcgacgaguuuuga

SEQ ID NO: 977 - RNA, 2472 nt, Artificial Sequence
  derived and/or modified sequence opt4 from CDC27/m__Homo_sapiens__EAW57688
augaccgugcugcaggagcccgugcaggccgccaucuggcaggcccugaaccacuacgccuacagagacgccguguuccuggccgagagacuguacgccgaggugcacagcgaggaggcccuguuccugcuggccaccugcuacuacagaagcggcaaggccuacaaggccuacagacugcugaagggccacagcugcaccaccccccagugcaaguaccugcuggccaagugcugcguggaccugagcaagcuggccgagggcgagcagauccugagcggcggcguguucaacaagcagaagagccacgacgacaucgugaccgaguucggcgacagcgccugcuucacccugagccugcugggccacguguacugcaagaccgacagacuggccaagggcagcgagugcuaccagaagagccugagccugaaccccuuccuguggagccccuucgagagccugugcgagaucggcgagaagcccgaccccgaccagaccuucaaguucaccagccugcagaacuucagcaacugccugcccaacagcugcaccacccaggugcccaaccacagccugagccacagacagcccgagaccgugcugaccgagaccccccaggacaccaucgagcugaacagacugaaccuggagagcagcaacagcaaguacagccugaacaccgacagcagcgugagcuacaucgacagcgccgugaucagccccgacaccgugccccugggcaccggcaccagcauccugagcaagcaggugcagaacaagcccaagaccggcagaagccugcugggcggccccgccgcccugagcccccugacccccagcuucggcauccugccccuggagacccccagccccggcgacggcagcuaccugcagaacuacaccaacaccccccccgugaucgacgugcccagcaccggcgcccccagcaagaagagcguggccagaaucggccagaccggcaccaagagcguguucagccagagcggcaacagcagagaggugacccccauccuggcccagacccagagcagcggcccccagaccagcaccaccccccaggugcugagccccaccaucaccagcccccccaacgcccugcccagaagaagcagcagacuguucaccagcgacagcagcaccaccaaggagaacagcaagaagcugaagaugaaguucccccccaagauccccaacagaaagaccaagagcaagaccaacaagggcggcaucacccagcccaacaucaacgacagccuggagaucaccaagcuggacagcagcaucaucagcgagggcaagaucagcaccaucaccccccagauccaggccuucaaccugcagaaggccgccgccggccugaugagccugcugagagagaugggcaagggcuaccuggcccugugcagcuacaacugcaaggaggccaucaacauccugagccaccugcccagccaccacuacaacaccggcugggugcugugccagaucggcagagccuacuucgagcugagcgaguacaugcaggccgagagaaucuucagcgaggugagaagaaucgagaacuacagaguggagggcauggagaucuacagcaccacccuguggcaccugcagaaggacguggcccugagcgugcugagcaaggaccugaccgacauggacaagaacagccccgaggccuggugcgccgccggcaacugcuucagccugcagagagagcacgacaucgccaucaaguucuuccagagagccauccagguggaccccaacuacgccuacgccuacacccugcugggccacgaguucgugcugaccgaggagcuggacaaggcccuggccugcuucagaaacgccaucagagugaaccccagacacuacaacgccugguacggccugggcaugaucuacuacaagcaggagaaguucagccuggccgagaugcacuuccagaaggcccuggacaucaacccccagagcagcgugcugcugugccacaucggcguggugcagcacgcccugaagaagagcgagaaggcccuggacacccugaacaaggccaucgugaucgaccccaagaacccccugugcaaguuccacagagccagcgugcuguucgccaacgagaaguacaagagcgcccugcaggagcuggaggagcugaagcagaucgugcccaaggagagccugguguacuuccugaucggcaagguguacaagaagcugggccagacccaccuggcccugaugaacuucagcugggccauggaccuggaccccaagggcgccaacaaccagaucaaggaggccaucgacaagagauaccugcccgacgacgaggagcccaucacccaggaggagcagaucaugggcaccgacgagagccaggagagcagcaugaccgacgccgacgacacccagcugcacgccgccgagagcgacgaguucuga

SEQ ID NO: 978 - RNA, 2472 nt, Artificial Sequence
  derived and/or modified sequence opt5 from CDC27/m__Homo_sapiens__EAW57688
augaccgugcugcaggagcccguccaagccgcuaucuggcaggcccucaaccacuacgcguauagagacgcuguuuuccuggccgaacggcuuuacgccgaggugcauagcgaagaggcucuguuucuccuggccacaugcuauuaccgcuccggcaaggcuuauaaagccuacagacuucugaaggggcacucuuguacgaccccucagugcaaauaucuccuggcgaaguguugcguggaucugagcaaacucgccgaaggagagcagauucuguccggcggggucuucaauaagcaaaagucucaugacgauaucgugacagaguuuggagacagcgcuuguuucacccuuucccugcucggccacguuuacugcaaaacagaucggcuggccaaggggucugaauguuaccagaaaagccuuucccugaacccguuucucuggagccccuucgagucucugugcgaaauuggagagaagccugaccccgaucagaccuuuaaauucacaucccugcagaauuuuagcaacugucucccuaauucuugcaccacgcaagugcccaaccauucccugagccaccgccagccugagaccguccuuacagaaaccccgcaggacacaaucgagcugaauagacucaaccuggaaucuuccaauagcaaguauucccuuaacaccgauucuagcguguccuacauugacagcgcuguuaucucucccgauacggugccucugggcacaggcaccuccauccucagcaagcagguccaaaauaaacccaagacagggcggucucugcugggaggcccugccgcgcucagcccccugaccccguccuucgggauucuuccucuggagacccccucuccuggagacggcagcuaucuccagaacuacacaaauacgccucccgugaucgaugugcccuccaccggggccccgagcaaaaagucugucgcucgcauuggacagacaggcaccaaauccguuuuuagccaaucuggcaacuccagagaagugacacccauccuggcccagacccagagcuccgggccucagacgucuacaacaccccaagugcuuagcccuaccauuaccucucccccgaaugcucugccucggcgcuccagcagacucuucaccuccgacagcucuacaacgaaggagaacuccaaaaagcugaagaugaaauuucccccuaagauccccaaccggaaaaccaagagcaaaacaaauaagggaggcauuacccagccuaacaucaaugacucucuggagaucacaaagcucgauuccagcauuaucucugaagggaaaauuagcaccaucacgccccagauucaggccuucaaccugcaaaaggccgcugcgggacuuaugucccugcuccgcgagaugggcaaaggguaucuggcccuguguagcuacaauugcaaggaagcuaucaacauccuuucucaccucccgucccaucacuauaauaccggauggguccugugccagauuggcagagccuacuucgagcugagcgaauacaugcaggccgagcggaucuuuuccgaggugcgcagaauugaaaacuaucggguugagggcauggaaaucuacucuacaacccucuggcaucugcagaaagacguggcucuuagcguccuguccaaggaucucacagacauggauaaaaauucuccugaggccuggugugcggcugggaacugcuucagccugcaaagagaacacgacauugccaucaaguuuuuccagcgcgccauccagguggaucccaauuaugcuuacgccuauacccugcuuggacacgaguuuguucucacggaggaacuggacaaggcucuggccuguuuccggaacgcgauuagagugaauccccgccauuacaacgccugguauggccucgggaugaucuacuacaaacaggagaaguuuucccuggcugaaaugcacuuccaaaaagcccuugauauuaauccucagucuagcguccugcucugccauaucggagugguccagcacgcucugaagaaguccgagaaagcccuggacacacuuaacaaggcgauugugaucgauccgaaaaacccccucuguaaguuucaucgggccagcguucuguucgcuaaugagaaauauaagucugcccugcaagaacucgaggaacugaaacagauugugccuaaggagucccuugucuacuuucugaucggcaagguguauaaaaagcucgggcagacccaccuggcucugaugaacuucagcugggccauggaccuugaccccaaaggcgccaauaaccagaucaaggaagcuauugauaaaagauaccucccugacgaugaggagcccaucacacaagaggaacagauuaugggaaccgacgaaucucaggaguccagcaugaccgaugcggacgauacacagcugcacgccgcugaaucugacgaguuuuga

SEQ ID NO: 979 - protein, 824 aa, Artificial Sequence
  CDC27/m__Homo_sapiens__P30260
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 980 - RNA, 2475 nt, Artificial Sequence
  CDC27/m__Homo_sapiens__AAB34378
augacggugcugcaggaacccguccaggcugcuauauggcaagcacuaaaccacuaugcuuaccgagaugcgguuuuccucgcagaacgccuuuaugcagaaguacacucagaagaagccuuguuuuuacuggcaaccuguuauuaccgcucaggaaaggcauauaaagcauauagacucuugaaaggacacaguuguacuacaccgcaaugcaaauaccugcuugcaaaauguuguguugaucucagcaagcuugcagaaggggaacaaaucuuaucugguggaguguuuaauaagcagaaaagccaugaugauauuguuacugaguuuggugauucagcuugcuuuacucuuucauuguugggacauguauauugcaagacagaucggcuugccaaaggaucagaauguuaccaaaagagccuuaguuuaaauccuuuccucuggucucccuuugaaucauuaugugaaauaggugaaaagccagauccugaccaaacauuuaaauucacaucuuuacagaacuuuagcaacugucugcccaacucuugcacaacacaaguaccuaaucauaguuuaucucacagacagccugagacaguucuuacggaaacaccccaggacacaauugaauuaaacagauugaauuuagaaucuuccaauucaaaguacuccuugaauacagauuccucagugucuuauauugauucagcuguaauuucaccugauacugucccacugggaacaggaacuuccauauuaucuaaacagguucaaaauaaaccaaaaacuggucgaaguuuauuaggaggaccagcagcucuuaguccauuaaccccaaguuuugggauuuugccauuagaaaccccaaguccuggagauggauccuauuuacaaaacuacacuaauacaccuccuguaauugaugugccauccaccggagccccuucaaaaaagucuguugccagaaucggccaaacuggaacaaagucugucuucucacagaguggaaauagccgagagguaacuccaauucuugcacaaacacaaaguucugguccacaaacaaguacaacaccucagguauugagccccacuauuacaucucccccaaacgcacugccucgaagaaguucacgacucuuuacuagugacagcuccacaaccaaggagaauagcaaaaaauuaaaaaugaaguuuccaccuaaaaucccaaacagaaaaacaaaaaguaaaacuaauaaaggaggaauaacucaaccuaacauaaaugauagccuggaaauuacaaaauuggacucuuccaucauuucagaagggaaaauauccacaaucacaccucagauucaggccuuuaaucuacaaaaagcagcagcagaagguuugaugagccuucuucgugaaauggggaaagguuauuuagcuuuguguucauacaacugcaaagaagcuauaaauauuuugagccaucuaccuucucaccacuacaauacugguuggguacugugccaaauuggaagggccuauuuugaacuuucagaguacaugcaagcugaaagaauauucucagagguuagaaggauugagaauuauagaguugaaggcauggagaucuacucuacaacacuuuggcaucuucaaaaagauguugcucuuucaguucugucaaaagacuuaacagacauggauaaaaauucgccagaggccuggugugcugcagggaacuguuucagucugcaacgggaacaugauauugcaauuaaauucuuccagagagcuauccaaguugauccaaauuacgcuuaugccuauacucuauuagggcaugaguuugucuuaacugaagaauuggacaaagcauuagcuuguuuucgaaaugcuaucagagucaauccuagacauuauaaugcaugguaugguuuaggaaugauuuauuacaagcaagaaaaauucagccuugcagaaaugcauuuccaaaaagcgcuugauaucaacccucaaaguucaguuuuacuuugccacauuggaguaguucaacaugcacugaaaaaaucagagaaggcuuuggauacccuaaacaaagccauugucauugaucccaagaacccucuaugcaaauuucacagagccucaguuuuauuugcaaaugaaaaauauaagucugcuuuacaagaacuugaagaauugaaacaaauuguucccaaagaaucccucguuuacuucuuaauaggaaagguuuacaagaaguuaggucaaacgcaccucgcccugaugaauuucucuugggcuauggauuuagauccuaaaggagccaauaaccagauuaaagaggcaauugauaagcguuaucuuccagaugaugaggagccaauaacccaagaagaacagaucaugggaacagaugaaucccaggagagcagcaugacagaugcggaugacacacaacuucaugcagcugaaagugaugaauuuuaa

SEQ ID NO: 981 - RNA, 2475 nt, Artificial Sequence
  derived and/or modified sequence opt1 from CDC27/m__Homo_sapiens__AAB34378
augaccgugcugcaggagcccguccaggccgccaucuggcaggcgcucaaccacuacgccuaccgcgacgccguguuccuggccgagcggcuguacgccgaggugcacagcgaggaggcccucuuccugcuggcgaccugcuacuaccgcuccggcaaggccuacaaggccuaccggcuccugaaggggcacagcugcacgaccccgcagugcaaguaccugcucgcgaagugcugcgucgaccuguccaagcuggccgagggcgagcagauccucagcgggggcguguucaacaagcagaagucccacgacgacaucgugaccgaguucggggacagcgccugcuucacccugucccugcucggccacgucuacugcaagacggaccgccuggccaagggcagcgagugcuaccagaagucccugagccucaaccccuuccuguggucccccuucgagagccugugcgagaucggggagaagcccgacccggaccagaccuucaaguucaccucccuccagaacuucagcaacugccugcccaacuccugcaccacccaggugcccaaccacagccugucccaccggcagcccgagaccgugcucaccgagaccccgcaggacacgaucgagcugaaccgccugaaccucgagagcuccaacagcaaguacagccugaacaccgacuccagcgucuccuacaucgacagcgccgugaucucccccgacaccgugccccugggcaccgggacgagcauccucuccaagcagguccagaacaagcccaagaccggccggagccugcucgggggcccggcggcccugagcccccugacgcccuccuucggcauccugccccucgagaccccgucccccggggacggcagcuaccugcagaacuacacgaacaccccgcccgugaucgacgugcccuccaccggggcgcccagcaagaaguccgucgcccgcaucggccagaccggcaccaagagcguguucucccagagcgggaacucccgggaggugacgcccauccuggcccagacccagagcagcggcccccagaccuccacgaccccgcagguccucagccccaccaucaccuccccgcccaacgcccugccccgccggagcucccgccuguucacgagcgacuccagcaccaccaaggagaacuccaagaagcucaagaugaaguucccgcccaagauccccaaccggaagaccaagagcaagacgaacaagggcgggaucacccagcccaacaucaacgacucccuggagaucaccaagcuggacagcuccaucaucagcgaggggaagaucuccaccaucacgccccagauccaggccuucaaccuccagaaggccgccgccgagggccugaugagccugcuccgcgagaugggcaagggguaccuggcgcugugcuccuacaacugcaaggaggccaucaacauccugagccaccuccccagccaccacuacaacaccggcugggugcugugccagaucgggcgggccuacuucgagcuguccgaguacaugcaggccgagcgcaucuucagcgaggugcggcgcaucgagaacuaccgggucgagggcauggagaucuacuccaccacccucuggcaccuccagaaggacguggcccugagcgugcuguccaaggaccugaccgacauggacaagaacagcccggaggcguggugcgccgccgggaacugcuucucccugcagcgcgagcacgacaucgccaucaaguucuuccagcgggcgauccaggucgaccccaacuacgccuacgccuacacgcuccugggccacgaguucgugcugaccgaggagcucgacaaggcccuggccugcuuccgcaacgcgauccgcgucaacccccggcacuacaacgccugguacggccuggggaugaucuacuacaagcaggagaaguucagccucgccgagaugcacuuccagaaggcccuggacaucaacccccaguccagcgugcugcucugccacaucggcgugguccagcacgcccugaagaaguccgagaaggcgcuggacacccucaacaaggccaucgugaucgacccgaagaacccccugugcaaguuccaccgcgccagcgugcuguucgccaacgagaaguacaaguccgcccuccaggagcuggaggagcugaagcagaucguccccaaggagagccucguguacuuccugaucgggaagguguacaagaagcugggccagacccaccucgcgcugaugaacuucuccugggccauggaccuggaccccaagggggccaacaaccagaucaaggaggccaucgacaagcgguaccucccggacgacgaggagcccaucacgcaggaggagcagaucaugggcaccgacgagagccaggaguccagcaugaccgacgcggacgacacccagcugcacgccgccgaguccgacgaguucuga

SEQ ID NO: 982 - RNA, 2475 nt, Artificial Sequence
  derived and/or modified sequence opt2 from CDC27/m__Homo_sapiens__AAB34378
augaccguccuccaggagcccguccaggccgccaucuggcaggcccucaaccacuacgccuaccgcgacgccgucuuccucgccgagcgccucuacgccgagguccacuccgaggaggcccucuuccuccucgccaccugcuacuaccgcuccggcaaggccuacaaggccuaccgccuccucaagggccacuccugcaccaccccccagugcaaguaccuccucgccaagugcugcgucgaccucuccaagcucgccgagggcgagcagauccucuccggcggcgucuucaacaagcagaagucccacgacgacaucgucaccgaguucggcgacuccgccugcuucacccucucccuccucggccacgucuacugcaagaccgaccgccucgccaagggcuccgagugcuaccagaagucccucucccucaaccccuuccucuggucccccuucgagucccucugcgagaucggcgagaagcccgaccccgaccagaccuucaaguucaccucccuccagaacuucuccaacugccuccccaacuccugcaccacccagguccccaaccacucccucucccaccgccagcccgagaccguccucaccgagaccccccaggacaccaucgagcucaaccgccucaaccucgaguccuccaacuccaaguacucccucaacaccgacuccuccgucuccuacaucgacuccgccgucaucucccccgacaccgucccccucggcaccggcaccuccauccucuccaagcagguccagaacaagcccaagaccggccgcucccuccucggcggccccgccgcccucuccccccucacccccuccuucggcauccucccccucgagacccccucccccggcgacggcuccuaccuccagaacuacaccaacaccccccccgucaucgacguccccuccaccggcgcccccuccaagaaguccgucgcccgcaucggccagaccggcaccaaguccgucuucucccaguccggcaacucccgcgaggucacccccauccucgcccagacccaguccuccggcccccagaccuccaccaccccccagguccucucccccaccaucaccuccccccccaacgcccucccccgccgcuccucccgccucuucaccuccgacuccuccaccaccaaggagaacuccaagaagcucaagaugaaguucccccccaagauccccaaccgcaagaccaaguccaagaccaacaagggcggcaucacccagcccaacaucaacgacucccucgagaucaccaagcucgacuccuccaucaucuccgagggcaagaucuccaccaucaccccccagauccaggccuucaaccuccagaaggccgccgccgagggccucaugucccuccuccgcgagaugggcaagggcuaccucgcccucugcuccuacaacugcaaggaggccaucaacauccucucccaccuccccucccaccacuacaacaccggcuggguccucugccagaucggccgcgccuacuucgagcucuccgaguacaugcaggccgagcgcaucuucuccgagguccgccgcaucgagaacuaccgcgucgagggcauggagaucuacuccaccacccucuggcaccuccagaaggacgucgcccucuccguccucuccaaggaccucaccgacauggacaagaacucccccgaggccuggugcgccgccggcaacugcuucucccuccagcgcgagcacgacaucgccaucaaguucuuccagcgcgccauccaggucgaccccaacuacgccuacgccuacacccuccucggccacgaguucguccucaccgaggagcucgacaaggcccucgccugcuuccgcaacgccauccgcgucaacccccgccacuacaacgccugguacggccucggcaugaucuacuacaagcaggagaaguucucccucgccgagaugcacuuccagaaggcccucgacaucaacccccaguccuccguccuccucugccacaucggcgucguccagcacgcccucaagaaguccgagaaggcccucgacacccucaacaaggccaucgucaucgaccccaagaacccccucugcaaguuccaccgcgccuccguccucuucgccaacgagaaguacaaguccgcccuccaggagcucgaggagcucaagcagaucguccccaaggagucccucgucuacuuccucaucggcaaggucuacaagaagcucggccagacccaccucgcccucaugaacuucuccugggccauggaccucgaccccaagggcgccaacaaccagaucaaggaggccaucgacaagcgcuaccuccccgacgacgaggagcccaucacccaggaggagcagaucaugggcaccgacgagucccaggaguccuccaugaccgacgccgacgacacccagcuccacgccgccgaguccgacgaguucuga

SEQ ID NO: 983 - RNA, 2475 nt, Artificial Sequence
  derived and/or modified sequence opt3 from CDC27/m__Homo_sapiens__AAB34378
augaccgugcugcaggagcccguccaagccgcuaucuggcaggcacucaaccacuacgccuauagagacgcgguuuuccuugcugaaaggcuguacgccgaggugcauagcgaagaggcauuguuuuuacuggccacaugcuauuaccgguccggcaaggcuuauaaagcauaccgccuacucaaggggcacucuuguacuacgccucagugcaaauaucugcuugccaaguguugcguagaucugucaaaauuggcugaaggagagcagauucucagugguggcguguucaauaagcaaaagagccaugacgauauagucaccgaguuuggggacuccgccuguuucacacugucucugcucggacacguguacugcaaaacugaucgauuagcgaagggcucggaauguuaccagaaaucacugagccuuaacccauuuuuguggaguccguucgagucccugugcgaaaucggugagaagcccgacccugaucagaccuuuaaauucacaucucuacagaauuuuagcaacugucucccaaauuccugcaccacucaaguucccaaccauucacugagucaccgucagccugagacagugcuuaccgaaacgccacaggacacuauugagcugaauagauugaaccucgaaagcucuaauuccaaguauucacugaacaccgauagcagugucucuuacaucgacuccgcagugauuagccccgauacaguaccuuuagggacuggaaccucgauccugucuaagcagguucaaaauaaaccaaagacaggcaggucccuccuuggcgggccggccgcucugucacccuugaccccuaguuucggaauacuaccacuggagacgcccagcccuggugacggcuccuaucuccagaacuacacuaauacaccacccgugaucgaugucccgucuaccggggccccuagcaaaaagucaguggcacggauuggacagacuggcacaaaaaguguguuuucccaaagcgguaacucucgcgaagucacccccauccuggcucagacgcagucaagugggccacagaccagcacaacuccucaaguucuuucccccaccauuacaucuccacccaaugcccugccuagaaggucgagccgguuguucacuuccgacucaaguaccacaaaggagaacucuaaaaagcucaagaugaaauuuccaccgaagauccccaaccgcaaaaccaagagcaaaacuaauaagggaggcauaacgcagccuaacauuaaugacucccuggagaucacaaaguuagauucaagcauuaucucugaaggcaaaaucuccaccauuacuccacagauacaggcguucaaccugcaaaaggccgcagcugaggggcuaaugagucuccugcgagaaaugggaaaagguuaucuugccuuguguagcuacaauugcaaggaggcuaucaacauucugucucaccuccccucccaucacuauaauaccggcugggugcugugccagaucgggagagccuacuucgaacuuucagaguacaugcaggcagagaggauauuuagugaaguacggcguauugagaacuaucgcguggaaggaauggagaucuacagcacaacccuguggcauuugcagaaagacgucgcccucucggugcuguccaaggauuuaacugacauggauaaaaauucuccugaggcuuggugugcggcaggcaacugcuucagccugcaaagagagcacgacaucgccauuaaguuuuuccagagggcuauccagguugauccaaauuaugccuacgcauauacacuacucggucacgaguuugugcugacggaagaacuugacaaggccuuggcuuguuuccggaacgccauucgagucaauccccgccauuacaacgcaugguaugggcugggcaugauauacuacaaacaggaaaaguuuucacucgcggagaugcacuuccaaaaagcucuggauaucaauccgcagaguuccguguuacugugccauauuggaguaguucagcacgcccuuaagaagucugagaaagcauuggacacccucaacaaggccaucgugaucgauccuaaaaacccacuguguaaguuucauagagcuagcguccuauucgccaaugaaaaauauaaguccgcacugcaagagcucgaggaacugaaacagauugugcccaaggaaucacuugucuacuuuuugauaggcaagguguauaaaaagcuggggcagacucacuuagcucucaugaacuucagcugggccauggaccuggacccuaaaggagcgaauaaccagaucaaggaggccauugauaaaagguaccuucccgacgaugaggaaccaaucacacaagaggaacagauuauggguaccgacgagagucaggaaucuuccaugacagaugcugacgauacucagcugcacgcagccgagagcgacgaguuuuga

SEQ ID NO: 984 - RNA, 2475 nt, Artificial Sequence
  derived and/or modified sequence opt4 from CDC27/m__Homo_sapiens__AAB34378
augaccgugcugcaggagcccgugcaggccgccaucuggcaggcccugaaccacuacgccuacagagacgccguguuccuggccgagagacuguacgccgaggugcacagcgaggaggcccuguuccugcuggccaccugcuacuacagaagcggcaaggccuacaaggccuacagacugcugaagggccacagcugcaccaccccccagugcaaguaccugcuggccaagugcugcguggaccugagcaagcuggccgagggcgagcagauccugagcggcggcguguucaacaagcagaagagccacgacgacaucgugaccgaguucggcgacagcgccugcuucacccugagccugcugggccacguguacugcaagaccgacagacuggccaagggcagcgagugcuaccagaagagccugagccugaaccccuuccuguggagccccuucgagagccugugcgagaucggcgagaagcccgaccccgaccagaccuucaaguucaccagccugcagaacuucagcaacugccugcccaacagcugcaccacccaggugcccaaccacagccugagccacagacagcccgagaccgugcugaccgagaccccccaggacaccaucgagcugaacagacugaaccuggagagcagcaacagcaaguacagccugaacaccgacagcagcgugagcuacaucgacagcgccgugaucagccccgacaccgugccccugggcaccggcaccagcauccugagcaagcaggugcagaacaagcccaagaccggcagaagccugcugggcggccccgccgcccugagcccccugacccccagcuucggcauccugccccuggagacccccagccccggcgacggcagcuaccugcagaacuacaccaacaccccccccgugaucgacgugcccagcaccggcgcccccagcaagaagagcguggccagaaucggccagaccggcaccaagagcguguucagccagagcggcaacagcagagaggugacccccauccuggcccagacccagagcagcggcccccagaccagcaccaccccccaggugcugagccccaccaucaccagcccccccaacgcccugcccagaagaagcagcagacuguucaccagcgacagcagcaccaccaaggagaacagcaagaagcugaagaugaaguucccccccaagauccccaacagaaagaccaagagcaagaccaacaagggcggcaucacccagcccaacaucaacgacagccuggagaucaccaagcuggacagcagcaucaucagcgagggcaagaucagcaccaucaccccccagauccaggccuucaaccugcagaaggccgccgccgagggccugaugagccugcugagagagaugggcaagggcuaccuggcccugugcagcuacaacugcaaggaggccaucaacauccugagccaccugcccagccaccacuacaacaccggcugggugcugugccagaucggcagagccuacuucgagcugagcgaguacaugcaggccgagagaaucuucagcgaggugagaagaaucgagaacuacagaguggagggcauggagaucuacagcaccacccuguggcaccugcagaaggacguggcccugagcgugcugagcaaggaccugaccgacauggacaagaacagccccgaggccuggugcgccgccggcaacugcuucagccugcagagagagcacgacaucgccaucaaguucuuccagagagccauccagguggaccccaacuacgccuacgccuacacccugcugggccacgaguucgugcugaccgaggagcuggacaaggcccuggccugcuucagaaacgccaucagagugaaccccagacacuacaacgccugguacggccugggcaugaucuacuacaagcaggagaaguucagccuggccgagaugcacuuccagaaggcccuggacaucaacccccagagcagcgugcugcugugccacaucggcguggugcagcacgcccugaagaagagcgagaaggcccuggacacccugaacaaggccaucgugaucgaccccaagaacccccugugcaaguuccacagagccagcgugcuguucgccaacgagaaguacaagagcgcccugcaggagcuggaggagcugaagcagaucgugcccaaggagagccugguguacuuccugaucggcaagguguacaagaagcugggccagacccaccuggcccugaugaacuucagcugggccauggaccuggaccccaagggcgccaacaaccagaucaaggaggccaucgacaagagauaccugcccgacgacgaggagcccaucacccaggaggagcagaucaugggcaccgacgagagccaggagagcagcaugaccgacgccgacgacacccagcugcacgccgccgagagcgacgaguucuga

SEQ ID NO: 985 - RNA, 2475 nt, Artificial Sequence
  derived and/or modified sequence opt5 from CDC27/m__Homo_sapiens__AAB34378
augaccgugcugcaggagcccguccaagccgcuaucuggcaggcccucaaccacuacgcguauagagacgcuguuuuccuggccgaacggcuuuacgccgaggugcauagcgaagaggcucuguuucuccuggccacaugcuauuaccgcuccggcaaggcuuauaaagccuacagacuucugaaggggcacucuuguacgaccccucagugcaaauaucuccuggcgaaguguugcguggaucugagcaaacucgccgaaggagagcagauucuguccggcggggucuucaauaagcaaaagucucaugacgauaucgugacagaguuuggagacagcgcuuguuucacccuuucccugcucggccacguuuacugcaaaacagaucggcuggccaaggggucugaauguuaccagaaaagccuuucccugaacccguuucucuggagccccuucgagucucugugcgaaauuggagagaagccugaccccgaucagaccuuuaaauucacaucccugcagaauuuuagcaacugucucccuaauucuugcaccacgcaagugcccaaccauucccugagccaccgccagccugagaccguccuuacagaaaccccgcaggacacaaucgagcugaauagacucaaccuggaaucuuccaauagcaaguauucccuuaacaccgauucuagcguguccuacauugacagcgcuguuaucucucccgauacggugccucugggcacaggcaccuccauccucagcaagcagguccaaaauaaacccaagacagggcggucucugcugggaggcccugccgcgcucagcccccugaccccguccuucgggauucuuccucuggagacccccucuccuggagacggcagcuaucuccagaacuacacaaauacgccucccgugaucgaugugcccuccaccggggccccgagcaaaaagucugucgcucgcauuggacagacaggcaccaaauccguuuuuagccaaucuggcaacuccagagaagugacacccauccuggcccagacccagagcuccgggccucagacgucuacaacaccccaagugcuuagcccuaccauuaccucucccccgaaugcucugccucggcgcuccagcagacucuucaccuccgacagcucuacaacgaaggagaacuccaaaaagcugaagaugaaauuucccccuaagauccccaaccggaaaaccaagagcaaaacaaauaagggaggcauuacccagccuaacaucaaugacucucuggagaucacaaagcucgauuccagcauuaucucugaagggaaaauuagcaccaucacgccccagauucaggccuucaaccugcaaaaggccgcugcggagggacuuaugucccugcuccgcgaaaugggcaaaggguaucuggcccuguguagcuacaauugcaaggaggcuaucaacauccuuucucaccucccgucccaucacuauaauaccggauggguccugugccagauuggcagagccuacuucgaacugagcgaguacaugcaggccgagcggaucuuuuccgaagugcgcagaauugagaacuaucggguugaaggcauggagaucuacucuacaacccucuggcaucugcagaaagacguggcucuuagcguccuguccaaggaucucacagacauggauaaaaauucuccugaagccuggugugcggcugggaacugcuucagccugcaaagagagcacgacauugccaucaaguuuuuccagcgcgccauccagguggaucccaauuaugcuuacgccuauacccugcuuggacacgaguuuguucucacggaagaacuggacaaggcucuggccuguuuccggaacgcgauuagagugaauccccgccauuacaacgccugguauggccucgggaugaucuacuacaaacaggaaaaguuuucccuggcugagaugcacuuccaaaaagcccuugauauuaauccucagucuagcguccugcucugccauaucggagugguccagcacgcucugaagaaguccgagaaagcccuggacacacuuaacaaggcgauugugaucgauccgaaaaacccccucuguaaguuucaucgggccagcguucuguucgcuaaugaaaaauauaagucugcccugcaagagcucgaggagcugaaacagauugugccuaaggaaucccuugucuacuuucugaucggcaagguguauaaaaagcucgggcagacccaccuggcucugaugaacuucagcugggccauggaccuugaccccaaaggcgccaauaaccagaucaaggaggcuauugauaaaagauaccucccugacgaugaggaacccaucacacaagaggaacagauuaugggaaccgacgagucucaggaauccagcaugaccgaugcggacgauacacagcugcacgccgcugagucugacgaguuuuga

SEQ ID NO: 986 - protein, 595 aa, Artificial Sequence
  CDE30__Homo_sapiens__P28908
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 987 - RNA, 1788 nt, Artificial Sequence
  CDE30__Homo_sapiens__AAA51947
augcgcguccuccucgccgcgcugggacugcuguuccugggggcgcuacgagccuucccacaggaucgacccuucgaggacaccugucauggaaaccccagccacuacuaugacaaggcugucaggaggugcuguuaccgcugccccauggggcuguucccgacacagcagugcccacagaggccuacugacugcaggaagcagugugagccugacuacuaccuggaugaggccgaccgcuguacagccugcgugacuuguucucgagaugaccucguggagaagacgccgugugcauggaacuccucccgugucugcgaaugucgacccggcauguucuguuccacgucugccgucaacuccugugcccgcugcuucuuccauucugucuguccggcagggaugauugucaaguucccaggcacggcgcagaagaacacggucugugagccggcuuccccaggggucagcccugccugugccagcccagagaacugcaaggaacccuccaguggcaccaucccccaggccaagcccaccccgguguccccagcaaccuccagugccagcaccaugccuguaagagggggcacccgccucgcccaggaagcugcuucuaaacugacgagggcucccgacucucccuccucugugggaaggccuaguucagauccaggucuguccccaacacagccaugcccagaggggucuggugauugcagaaagcagugugagcccgacuacuaccuggacgaggccggccgcugcacagccugcgugagcuguucucgagaugaccuuguggagaagacgccaugugcauggaacuccucccgcaccugcgaaugucgaccuggcaugaucugugccacaucagccaccaacuccugugcccgcuguguccccuacccaaucugugcagcagagacggucaccaagccccaggauauggcugagaaggacaccaccuuugaggcgccaccccuggggacccagccggacugcaaccccaccccagagaauggcgaggcgccugccagcaccagccccacucagagcuugcugguggacucccaggccaguaagacgcugcccaucccaaccagcgcucccgucgcucucuccuccacggggaagcccguucuggaugcagggccagugcucuucugggugauccugguguugguugugguggucggcuccagcgccuuccuccugugccaccggagggccugcaggaagcgaauucggcagaagcuccaccugugcuacccgguccagaccucccagcccaagcuagagcuuguggauuccagacccaggaggagcucaacgcagcugaggaguggugcgucggugacagaacccgucgcggaagagcgaggguuaaugagccagccacugauggagaccugccacagcgugggggcagccuaccuggagagccugccgcugcaggaugccagcccggccgggggccccucgucccccagggaccuuccugagccccggguguccacggagcacaccaauaacaagauugagaaaaucuacaucaugaaggcugacaccgugaucguggggaccgugaaggcugagcugccggagggccggggccuggcggggccagcagagcccgaguuggaggaggagcuggaggcggaccauaccccccacuaccccgagcaggagacagaaccgccucugggcagcugcagcgaugucaugcucucaguggaagaggaagggaaagaagaccccuugcccacagcugccucuggaaaguga

SEQ ID NO: 988 - RNA, 1788 nt, Artificial Sequence
  derived and/or modified sequence opt1 from CDE30__Homo_sapiens__AAA51947
augcgcgugcugcucgccgcccugggccuccucuuccugggggcgcugcgggccuucccccaggaccgcccguucgaggacacgugccacggcaaccccagccacuacuacgacaaggccguccggcgcugcugcuaccggugccccauggggcuguuccccacccagcagugcccgcagcgccccaccgacugccggaagcagugcgagcccgacuacuaccuggacgaggccgaccgcugcaccgccugcgugaccugcucccgggacgaccugguggagaagacccccugcgcguggaacagcucccgcgucugcgagugccggccgggcauguucugcagcaccuccgccgugaacagcugcgcccgcugcuucuuccacuccgugugccccgccgggaugaucgucaaguuccccggcaccgcgcagaagaacaccgugugcgagcccgccagcccgggcgugucccccgccugcgccagccccgagaacugcaaggagcccuccagcgggaccaucccgcaggccaagcccacgcccgucucccccgcgaccagcuccgccagcaccaugccggugcggggcgggacccgccucgcccaggaggccgccuccaagcugacgcgggcgcccgacagccccuccagcgugggccgccccagcuccgacccggggcugagccccacccagcccugccccgagggcuccggcgacugccggaagcagugcgagccggacuacuaccucgacgaggccgggcgcugcaccgccugcgucagcugcucccgggacgaccugguggagaagacccccugcgccuggaacagcucccgcacgugcgagugccggcccggcaugaucugcgccaccagcgcgaccaacuccugcgcccgcugcgugccguaccccaucugcgccgccgagaccgucacgaagccccaggacauggccgagaaggacaccaccuucgaggcgcccccgcuggggacccagcccgacugcaaccccacgcccgagaacggcgaggccccggccagcaccucccccacccagagccuccugguggacucccaggccagcaagacccugcccauccccacguccgcgccgguggcccucagcuccaccggcaagcccguccuggacgccgggcccgugcuguucugggugauccucguccuggugguggucgugggcagcuccgccuuccugcucugccaccgccgggccugccgcaagcggauccgccagaagcugcaccugugcuaccccguccagaccagccagccgaagcucgagcugguggacagccggccccgccgguccagcacccagcugcgcuccggggcgagcgugacggagcccgucgccgaggagcggggccucaugucccagccccugauggagaccugccacagcgugggggccgccuaccuggagucccucccgcugcaggacgccagccccgcgggcggccccuccagcccccgcgaccugccggagccccggguguccaccgagcacaccaacaacaagaucgagaagaucuacaucaugaaggccgacacggucaucguggggaccgugaaggccgagcuccccgagggccgcgggcuggccggcccggccgagcccgagcuggaggaggagcucgaggcggaccacacgccccacuaccccgagcaggagaccgagccgccccuggggagcugcuccgacgucaugcugagcguggaggaggagggcaaggaggacccccuccccaccgccgccuccggcaaguga

SEQ ID NO: 989 - RNA, 1788 nt, Artificial Sequence
  derived and/or modified sequence opt2 from CDE30__Homo_sapiens__AAA51947
augcgcguccuccucgccgcccucggccuccucuuccucggcgcccuccgcgccuucccccaggaccgccccuucgaggacaccugccacggcaaccccucccacuacuacgacaaggccguccgccgcugcugcuaccgcugccccaugggccucuuccccacccagcagugcccccagcgccccaccgacugccgcaagcagugcgagcccgacuacuaccucgacgaggccgaccgcugcaccgccugcgucaccugcucccgcgacgaccucgucgagaagacccccugcgccuggaacuccucccgcgucugcgagugccgccccggcauguucugcuccaccuccgccgucaacuccugcgcccgcugcuucuuccacuccgucugccccgccggcaugaucgucaaguuccccggcaccgcccagaagaacaccgucugcgagcccgccucccccggcgucucccccgccugcgccucccccgagaacugcaaggagcccuccuccggcaccaucccccaggccaagcccacccccgucucccccgccaccuccuccgccuccaccaugcccguccgcggcggcacccgccucgcccaggaggccgccuccaagcucacccgcgcccccgacucccccuccuccgucggccgccccuccuccgaccccggccucucccccacccagcccugccccgagggcuccggcgacugccgcaagcagugcgagcccgacuacuaccucgacgaggccggccgcugcaccgccugcgucuccugcucccgcgacgaccucgucgagaagacccccugcgccuggaacuccucccgcaccugcgagugccgccccggcaugaucugcgccaccuccgccaccaacuccugcgcccgcugcguccccuaccccaucugcgccgccgagaccgucaccaagccccaggacauggccgagaaggacaccaccuucgaggcccccccccucggcacccagcccgacugcaaccccacccccgagaacggcgaggcccccgccuccaccucccccacccagucccuccucgucgacucccaggccuccaagacccuccccauccccaccuccgcccccgucgcccucuccuccaccggcaagcccguccucgacgccggccccguccucuucugggucauccucguccucgucgucgucgucggcuccuccgccuuccuccucugccaccgccgcgccugccgcaagcgcauccgccagaagcuccaccucugcuaccccguccagaccucccagcccaagcucgagcucgucgacucccgcccccgccgcuccuccacccagcuccgcuccggcgccuccgucaccgagcccgucgccgaggagcgcggccucaugucccagccccucauggagaccugccacuccgucggcgccgccuaccucgagucccucccccuccaggacgccucccccgccggcggccccuccuccccccgcgaccuccccgagccccgcgucuccaccgagcacaccaacaacaagaucgagaagaucuacaucaugaaggccgacaccgucaucgucggcaccgucaaggccgagcuccccgagggccgcggccucgccggccccgccgagcccgagcucgaggaggagcucgaggccgaccacaccccccacuaccccgagcaggagaccgagcccccccucggcuccugcuccgacgucaugcucuccgucgaggaggagggcaaggaggacccccuccccaccgccgccuccggcaaguga

SEQ ID NO: 990 - RNA, 1788 nt, Artificial Sequence
  derived and/or modified sequence opt3 from CDE30__Homo_sapiens__AAA51947
augagagugcugcucgccgcucuuggccuguuguucuuaggggcacugagggccuuuccccaggaccggccuuucgaggauaccugccacggaaacccaagccauuacuaugacaaggcgguccgccgauguugcuaccguuguccgaugggucuauuucccacacaacagugcccucagagaccaacugauuguaggaaacagugcgaacccgacuauuaccucgaugaggcugaccgguguacggccugcguuaccuguucccgcgaugaccugguggaaaagacaccuugcgcauggaacucuucaagaguaugugagugcaggccaggcauguucugcaguacuagcgccgucaauuccugugcucggugcuuuuuccacucugugugucccgcagggaugaucgugaaauuuccuggaaccgcccaaaagaauacaguuugcgaaccagcuucgccgggcgugucacccgccugugcgagcccugagaacugcaaagagccaaguuccgguaccauuccccaggcaaagccuacuccagucucucccgccacaagcuccgcuucaaccaugccggugcgcgggggaacgcgacuugcccaggaagcagcuaguaagcugacuagagccccugauagccccucuuccguaggcaggccaucaagcgacccuggcuugagucccacccagccaugucccgaggggucuggagauugccggaaacaaugugaaccugacuauuaccucgaugaggcgggucguugcacagccuguguuuccugcagccgcgacgaccugguggagaagacuccaugcgcauggaacucgucuagaaccugugaaugcaggccgggcaugauaugugcuacauccgccaccaauucaugcgcucgguguguccccuauccuaucugcgccgcagagacggugacuaaaccacaggauauggccgaaaaggacacaaccuucgaggcucccccucuggggacucagccagauuguaaucccacaccggaaaacggagaggcgccugcaaguaccagcccaacgcagucccucuuaguggacucucaagccagcaaaacccugcccauuccuacaucagcucccgucgcccuuaguuccacuggcaagccaguuuuggaugcagguccugugcuguuuuggguaauccuagugcucgucgugguuguggggagcucugccuuccugcuuugccaucgacgcgcuuguagaaagaggauucggcagaaacugcacuugugcuaccccguccagaccucacaaccaaagcucgagcugguggacagucgcccgagaaggagcuccacacaguuacguucuggagccucgguaacugaaccuguugcagaggaacggggccugaugagccagccccucauggagaccugucauuccgugggcgcggcuuaccuugaaucacugccauugcaggaugccagucccgcagggggaccuucuagcccacgagaccuacccgagccuagagucuccacagagcacaccaauaacaaaaucgaaaagauauauaucaugaaagccgauacugugauugucgguacggugaaggcugagcugccggaaggcagggggcucgccggaccagcagagcccgaacuggaggaggaacuugaggcugaccacacaccucauuacccagaacaagagaccgagcccccucugggcucaugcagcgauguuauguugucuguggaagaggaagguaaagaggacccgcuccccacugccgcguccgggaaguga

SEQ ID NO: 991 - RNA, 1788 nt, Artificial Sequence
  derived and/or modified sequence opt4 from CDE30__Homo_sapiens__AAA51947
augagagugcugcuggccgcccugggccugcuguuccugggcgcccugagagccuucccccaggacagacccuucgaggacaccugccacggcaaccccagccacuacuacgacaaggccgugagaagaugcugcuacagaugccccaugggccuguuccccacccagcagugcccccagagacccaccgacugcagaaagcagugcgagcccgacuacuaccuggacgaggccgacagaugcaccgccugcgugaccugcagcagagacgaccugguggagaagacccccugcgccuggaacagcagcagagugugcgagugcagacccggcauguucugcagcaccagcgccgugaacagcugcgccagaugcuucuuccacagcgugugccccgccggcaugaucgugaaguuccccggcaccgcccagaagaacaccgugugcgagcccgccagccccggcgugagccccgccugcgccagccccgagaacugcaaggagcccagcagcggcaccaucccccaggccaagcccacccccgugagccccgccaccagcagcgccagcaccaugcccgugagaggcggcaccagacuggcccaggaggccgccagcaagcugaccagagcccccgacagccccagcagcgugggcagacccagcagcgaccccggccugagccccacccagcccugccccgagggcagcggcgacugcagaaagcagugcgagcccgacuacuaccuggacgaggccggcagaugcaccgccugcgugagcugcagcagagacgaccugguggagaagacccccugcgccuggaacagcagcagaaccugcgagugcagacccggcaugaucugcgccaccagcgccaccaacagcugcgccagaugcgugcccuaccccaucugcgccgccgagaccgugaccaagccccaggacauggccgagaaggacaccaccuucgaggcccccccccugggcacccagcccgacugcaaccccacccccgagaacggcgaggcccccgccagcaccagccccacccagagccugcugguggacagccaggccagcaagacccugcccauccccaccagcgcccccguggcccugagcagcaccggcaagcccgugcuggacgccggccccgugcuguucugggugauccuggugcugguggugguggugggcagcagcgccuuccugcugugccacagaagagccugcagaaagagaaucagacagaagcugcaccugugcuaccccgugcagaccagccagcccaagcuggagcugguggacagcagacccagaagaagcagcacccagcugagaagcggcgccagcgugaccgagcccguggccgaggagagaggccugaugagccagccccugauggagaccugccacagcgugggcgccgccuaccuggagagccugccccugcaggacgccagccccgccggcggccccagcagccccagagaccugcccgagcccagagugagcaccgagcacaccaacaacaagaucgagaagaucuacaucaugaaggccgacaccgugaucgugggcaccgugaaggccgagcugcccgagggcagaggccuggccggccccgccgagcccgagcuggaggaggagcuggaggccgaccacaccccccacuaccccgagcaggagaccgagcccccccugggcagcugcagcgacgugaugcugagcguggaggaggagggcaaggaggacccccugcccaccgccgccagcggcaaguga

SEQ ID NO: 992 - RNA, 1788 nt, Artificial Sequence
  derived and/or modified sequence opt5 from CDE30__Homo_sapiens__AAA51947
augagagugcugcucgccgcucugggccuucuguuccucggggcccugcgggcguuuccccaggaccgcccuuucgaggauaccugccacggaaacccgagccauuacuaugacaaggcugucagacgguguugcuaccgcugucccaugggccuuuuuccuacacaacagugcccccagagaccuacggauugucggaaacagugcgaacccgacuauuaccuggaugaggccgaccgcuguaccgccugcguuacauguuccagagaugaccucguggaaaagaccccuugcgcuuggaacucuagccgggugugugagugccgcccggggauguucugcuccacaucugccgucaauagcugugcuagaugcuuuuuccacuccgugugucccgccggaaugaucguuaaauuuccuggcaccgcgcaaaagaauacagugugcgaacccgccucuccuggggucagccccgcuugugccuccccggagaacugcaaagagccuagcucuggaaccauuccccaggcuaagccuacgcccgugucccccgccaccagcucugcguccacaaugccuguucggggcggcacccgccuggcccaggaagcugccagcaagcugacaagagcuccggauucucccuccagcguggggcggccuuccucugaccccggacucagcccuacccagcccuguccggagggcuccggggauugccgcaaacaaugugaaccugacuauuaccuggaugaggccggaagaugcacggccugugucagcugcucucgggacgaccuuguggagaagacacccugcgcuuggaacuccagcagaaccugugaaugccgcccuggcaugaucugugcgacaucugccaccaauagcugcgcucggugugugcccuauccuauuugcgccgccgagaccgucacaaaaccccaggauauggcugaaaaggacacgaccuucgaggccccgccucuggggacacagcccgauuguaaucccaccccugaaaacggagaggcgccggcuuccacaucucccacccagagccuccugguugacucccaagccagcaaaacgcuuccuauccccacaucugccccuguggcucuguccagcaccggcaagcccgugcucgaugccggcccuguccuguuuugggugauucugguucucguggucgugguugggucuuccgcuuuccugcuuugccauagacgcgccugucggaagagaauccgccagaaacugcaccucugcuaccccgugcagaccagccaaccgaagcuggagcuugucgacucccggccuagacgcucuagcacacagcugcgguccggagcgucugugaccgaacccgucgccgaggaaagaggccucaugagccagccucugauggagacaugucauuccgugggggcugccuaccuggaaagccucccccugcaggaugcuucuccggccggaggcccuuccagcccccgcgaccuuccugagccccggguuucuacggagcacaccaauaacaaaaucgaaaagauuuauaucaugaaagcggauacagugauugucgggaccgugaaggccgagcugcccgaaggaagaggccucgcuggcccugccgagccggaacuggaggaggaacuugaggcugaccacacaccccauuacccugaacaagagaccgagcccccucugggguccugcagcgauguuaugcucucuguggaagaggaaggaaaagaggacccccugccuacggccgccagcggcaaguga

SEQ ID NO: 993 - protein, 303 aa, Artificial Sequence
  CDK4/m__Homo_sapiens__A0A024RBB6
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 994 - RNA, 912 nt, Artificial Sequence
  CDK4/m__Homo_sapiens__EAW97060
auggcuaccucucgauaugagccaguggcugaaauuggugucggugccuaugggacaguguacaaggcccgugauccccacaguggccacuuuguggcccucaagagugugagaguccccaauggaggaggagguggaggaggccuucccaucagcacaguucgugagguggcuuuacugaggcgacuggaggcuuuugagcaucccaauguuguccggcugauggacgucugugccacaucccgaacugaccgggagaucaagguaacccugguguuugagcauguagaccaggaccuaaggacauaucuggacaaggcacccccaccaggcuugccagccgaaacgaucaaggaucugaugcgccaguuucuaagaggccuagauuuccuucaugccaauugcaucguucaccgagaucugaagccagagaacauucuggugacaagugguggaacagucaagcuggcugacuuuggccuggccagaaucuacagcuaccagauggcacuuacacccgugguuguuacacucugguaccgagcucccgaaguucuucugcaguccacauaugcaacaccuguggacauguggaguguuggcuguaucuuugcagagauguuucgucgaaagccucucuucuguggaaacucugaagccgaccaguugggcaaaaucuuugaccugauugggcugccuccagaggaugacuggccucgagauguaucccugccccguggagccuuuccccccagagggccccgcccagugcagucggugguaccugagauggaggagucgggagcacagcugcugcuggaaaugcugacuuuuaacccacacaagcgaaucucugccuuucgagcucugcagcacucuuaucuacauaaggaugaagguaauccggaguga

SEQ ID NO: 995 - RNA, 912 nt, Artificial Sequence
  derived and/or modified sequence opt1 from CDK4/m__Homo_sapiens__EAW97060
auggccaccagccgcuacgagcccguggccgagaucggcgucggggcguacggcaccguguacaaggcccgggacccgcacuccgggcacuucguggcccucaagagcguccgcgugcccaacggcgggggcggcgggggcgggcugcccaucuccacggugcgggaggucgcccugcugcgccggcucgaggccuucgagcaccccaacguggugcgccugauggacgucugcgcgaccagccggaccgaccgcgagaucaaggugacccugguguucgagcacgucgaccaggaccuccggacguaccuggacaaggccccgccgcccggccugcccgccgagaccaucaaggaccucaugcgccaguuccugcgggggcuggacuuccuccacgccaacugcaucgugcaccgcgaccugaagccggagaacauccuggugaccuccggcggcaccgucaagcucgcggacuucgggcuggcccggaucuacagcuaccagauggcccugacgcccgugguggucacccucugguaccgcgcccccgaggugcugcugcaguccaccuacgccacccccguggacauguggagcgucggcugcaucuucgcggagauguuccggcgcaagccccucuucugcgggaacuccgaggccgaccagcugggcaagaucuucgaccugaucggccucccgcccgaggacgacuggccccgggacgugagccugccccgcggggccuucccgccccggggcccccgccccgugcaguccgucgugcccgagauggaggagagcggggcccagcugcuccuggagaugcugacguucaacccccacaagcggaucuccgccuuccgcgcgcuccagcacagcuaccugcacaaggacgagggcaaccccgaguga

SEQ ID NO: 996 - RNA, 912 nt, Artificial Sequence
  derived and/or modified sequence opt2 from CDK4/m__Homo_sapiens__EAW97060
auggccaccucccgcuacgagcccgucgccgagaucggcgucggcgccuacggcaccgucuacaaggcccgcgacccccacuccggccacuucgucgcccucaaguccguccgcguccccaacggcggcggcggcggcggcggccuccccaucuccaccguccgcgaggucgcccuccuccgccgccucgaggccuucgagcaccccaacgucguccgccucauggacgucugcgccaccucccgcaccgaccgcgagaucaaggucacccucgucuucgagcacgucgaccaggaccuccgcaccuaccucgacaaggcccccccccccggccuccccgccgagaccaucaaggaccucaugcgccaguuccuccgcggccucgacuuccuccacgccaacugcaucguccaccgcgaccucaagcccgagaacauccucgucaccuccggcggcaccgucaagcucgccgacuucggccucgcccgcaucuacuccuaccagauggcccucacccccgucgucgucacccucugguaccgcgcccccgagguccuccuccaguccaccuacgccacccccgucgacaugugguccgucggcugcaucuucgccgagauguuccgccgcaagccccucuucugcggcaacuccgaggccgaccagcucggcaagaucuucgaccucaucggccucccccccgaggacgacuggccccgcgacgucucccucccccgcggcgccuuccccccccgcggcccccgccccguccaguccgucguccccgagauggaggaguccggcgcccagcuccuccucgagaugcucaccuucaacccccacaagcgcaucuccgccuuccgcgcccuccagcacuccuaccuccacaaggacgagggcaaccccgaguga

SEQ ID NO: 997 - RNA, 912 nt, Artificial Sequence
  derived and/or modified sequence opt3 from CDK4/m__Homo_sapiens__EAW97060
auggccaccagcagauacgagcccguggcugaaaucggcgucggggcauauggaacaguuuacaaggccagggacccucacuccggucauuucguggcgcugaaaucuguacgggugccaaacggcgggggaggcggugggggacucccgauuucaacuguccgcgagguggcucugcuucgacguuuggaagccuuugagcaccccaauguugugagauuaauggaugucugcgcaacgaguaggaccgaccgggaaauaaaggugacacugguauucgagcauguugaucaggaccuacgcacuuaucucgauaaagccccuccacccggccugccugcugagaccaucaaggaccuuaugagacaauuucugaggggcuuggauuuccuccacgcaaacuguauugugcaucgggaccugaaaccagaaaauauccuggucacaagcgggggaaccgugaagcucgccgauuuugguuuagcucgcauuuacuccuaucagauggcccugacucccguggucguuacacuuugguaccgagcgccugagguguugcugcagucuaccuaugcaacgccaguagacauguggucggugggcugcaucuucgccgaaauguuuagaaggaagccgcuauucugugggaacucagaggcugaucagcucggaaaaauauuugaccugaucggccuucccccugaggaugacuggccacgggacgucagccugccccguggugccuucccuccacgcgggcccagaccggugcaaaguguugugccugaaauggaggaauccggagcacaguugcuccuggagauguuaacuuuuaauccccacaagaggauuucugcuuuccgggcccugcagcacagcuaccuccauaaagaugaaggcaacccagaguga

SEQ ID NO: 998 - RNA, 912 nt, Artificial Sequence
  derived and/or modified sequence opt4 from CDK4/m__Homo_sapiens__EAW97060
auggccaccagcagauacgagcccguggccgagaucggcgugggcgccuacggcaccguguacaaggccagagacccccacagcggccacuucguggcccugaagagcgugagagugcccaacggcggcggcggcggcggcggccugcccaucagcaccgugagagagguggcccugcugagaagacuggaggccuucgagcaccccaacguggugagacugauggacgugugcgccaccagcagaaccgacagagagaucaaggugacccugguguucgagcacguggaccaggaccugagaaccuaccuggacaaggcccccccccccggccugcccgccgagaccaucaaggaccugaugagacaguuccugagaggccuggacuuccugcacgccaacugcaucgugcacagagaccugaagcccgagaacauccuggugaccagcggcggcaccgugaagcuggccgacuucggccuggccagaaucuacagcuaccagauggcccugacccccgugguggugacccugugguacagagcccccgaggugcugcugcagagcaccuacgccacccccguggacauguggagcgugggcugcaucuucgccgagauguucagaagaaagccccuguucugcggcaacagcgaggccgaccagcugggcaagaucuucgaccugaucggccugccccccgaggacgacuggcccagagacgugagccugcccagaggcgccuucccccccagaggccccagacccgugcagagcguggugcccgagauggaggagagcggcgcccagcugcugcuggagaugcugaccuucaacccccacaagagaaucagcgccuucagagcccugcagcacagcuaccugcacaaggacgagggcaaccccgaguga

SEQ ID NO: 999 - RNA, 912 nt, Artificial Sequence
  derived and/or modified sequence opt5 from CDK4/m__Homo_sapiens__EAW97060
auggccaccagcagauacgagcccguggcugaaaucggcgucggggccuauggaacaguuuacaaggcgcgggacccucacuccggccauuucguggcucugaaaucugugcgcgucccgaacgggggaggcgggggaggcggccuccccauuagcacggugagagagguugcccugcuucggcgccuggaagccuuugagcacccuaauguggucagacucauggaugugugcgcuaccucccggacagaccgcgaaaucaagguuacccugguguucgagcaugucgaucaggaccuuagaacauaucuggauaaagcucccccucccgggcucccugccgagaccauuaaggaccugaugcggcaauuucugcgcggacucgauuuccugcacgccaacuguaucgugcauagagaccuuaaaccggaaaauauucuggugacaucuggcgggaccgucaagcucgcggauuuuggacuggcccggaucuacagcuaucagauggcucuuacgcccguuguggugacccugugguaccgcgccccugagguccuccugcaguccacauaugcuacccccguggacauguggucuguuggcugcaucuucgccgaaauguuuagacggaagccucuguucugugggaacagcgaggcggaucagcucggaaaaauuuuugaccugaucggccuucccccggaggaugacuggccucgcgacgugucccugcccagaggcgccuucccuccccgggggcccagaccuguccaaagcgugguuccggaaauggaggaaucuggagcucagcuccugcuugagaugcugacauuuaauccccacaagcgcauuuccgccuuccgggcucuccagcacagcuaccugcauaaagaugaaggcaacccugaguga

SEQ ID NO: 1000 - protein, 303 aa, Artificial Sequence; identical to SEQ ID NO: 993
  CDK4/m__Homo_sapiens__P11802

SEQ ID NO: 1001 - RNA, 912 nt, Artificial Sequence; identical to SEQ ID NO: 994
  CDK4/m__Homo_sapiens__AAA35673

SEQ ID NO: 1002 - RNA, 912 nt, Artificial Sequence; identical to SEQ ID NO: 995
  derived and/or modified sequence opt1 from CDK4/m__Homo_sapiens__AAA35673

SEQ ID NO: 1003 - RNA, 912 nt, Artificial Sequence; identical to SEQ ID NO: 996
  derived and/or modified sequence opt2 from CDK4/m__Homo_sapiens__AAA35673

SEQ ID NO: 1004 - RNA, 912 nt, Artificial Sequence; identical to SEQ ID NO: 997
  derived and/or modified sequence opt3 from CDK4/m__Homo_sapiens__AAA35673

SEQ ID NO: 1005 - RNA, 912 nt, Artificial Sequence; identical to SEQ ID NO: 998
  derived and/or modified sequence opt4 from CDK4/m__Homo_sapiens__AAA35673

SEQ ID NO: 1006 - RNA, 912 nt, Artificial Sequence; identical to SEQ ID NO: 999
  derived and/or modified sequence opt5 from CDK4/m__Homo_sapiens__AAA35673

SEQ ID NO: 1007 - protein, 229 aa, Artificial Sequence
  CDK4/m__Homo_sapiens__Q6LC83
MDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 1008 - RNA, 690 nt, Artificial Sequence
  CDK4/m__Homo_sapiens__AAB50213
auggacgucugugccacaucccgaacugaccgggagaucaagguaacccugguguuugagcauguagaccaggaccuaaggacauaucuggacaaggcacccccaccaggcuugccagccgaaacgaucaaggaucugaugcgccaguuucuaagaggccuagauuuccuucaugccaauugcaucguucaccgagaucugaagccagagaacauucuggugacaagugguggaacagucaagcuggcugacuuuggccuggccagaaucuacagcuaccagauggcacuuacacccgugguuguuacacucugguaccgagcucccgaaguucuucugcaguccacauaugcaacaccuguggacauguggaguguuggcuguaucuuugcagagauguuucgucgaaagccucucuucuguggaaacucugaagccgaccaguugggcaaaaucuuugaccugauugggcugccuccagaggaugacuggccucgagauguaucccugccccguggagccuuuccccccagagggccccgcccagugcagucggugguaccugagauggaggagucgggagcacagcugcugcuggaaaugcugacuuuuaacccacacaagcgaaucucugccuuucgagcucugcagcacucuuaucuacauaaggaugaagguaauccggaguga

SEQ ID NO: 1009 - RNA, 690 nt, Artificial Sequence
  derived and/or modified sequence opt1 from CDK4/m__Homo_sapiens__AAB50213
auggacgugugcgccaccagccgcaccgaccgggagaucaaggucacgcugguguucgagcacguggaccaggaccuccgcaccuaccuggacaaggcgcccccgcccggccugcccgccgagaccaucaaggaccucaugcggcaguuccugcgcgggcuggacuuccuccacgccaacugcaucguccaccgggaccugaagcccgagaacauccuggugaccuccggcgggacggugaagcucgccgacuucggccuggcccgcaucuacagcuaccagauggcccugaccccggucguggugacccucugguaccgggcgcccgagguccugcugcaguccaccuacgccacgcccguggacauguggagcguggggugcaucuucgccgagauguuccgccggaagccccucuucugcggcaacuccgaggccgaccagcugggcaagaucuucgaccugaucgggcucccgcccgaggacgacuggccccgcgacgucagccugccccggggcgcguucccgccccgcgggccccggcccgugcaguccguggucccggagauggaggagagcggcgcccagcugcuccuggagaugcugaccuucaacccccacaagcgcaucuccgccuuccgggcccuccagcacagcuaccugcacaaggacgaggggaaccccgaguga

SEQ ID NO: 1010 - RNA, 690 nt, Artificial Sequence
  derived and/or modified sequence opt2 from CDK4/m__Homo_sapiens__AAB50213
auggacgucugcgccaccucccgcaccgaccgcgagaucaaggucacccucgucuucgagcacgucgaccaggaccuccgcaccuaccucgacaaggcccccccccccggccuccccgccgagaccaucaaggaccucaugcgccaguuccuccgcggccucgacuuccuccacgccaacugcaucguccaccgcgaccucaagcccgagaacauccucgucaccuccggcggcaccgucaagcucgccgacuucggccucgcccgcaucuacuccuaccagauggcccucacccccgucgucgucacccucugguaccgcgcccccgagguccuccuccaguccaccuacgccacccccgucgacaugugguccgucggcugcaucuucgccgagauguuccgccgcaagccccucuucugcggcaacuccgaggccgaccagcucggcaagaucuucgaccucaucggccucccccccgaggacgacuggccccgcgacgucucccucccccgcggcgccuuccccccccgcggcccccgccccguccaguccgucguccccgagauggaggaguccggcgcccagcuccuccucgagaugcucaccuucaacccccacaagcgcaucuccgccuuccgcgcccuccagcacuccuaccuccacaaggacgagggcaaccccgaguga

SEQ ID NO: 1011 - RNA, 690 nt, Artificial Sequence
  derived and/or modified sequence opt3 from CDK4/m__Homo_sapiens__AAB50213
auggacgugugcgccaccagcagaacagauagggagaucaaggucacucugguuuucgaacacguggaccaggaucuccggacguaccuugacaaagcucccccuccaggccugccggcagagaccauuaaggauuugaugcgccaauuuuuacgagggcuggacuuccuacaugccaacuguauaguacaccgugaucucaaacccgaaaauauccuggugacauccggagguacugucaaacuugcggacuuuggccuggcuagaauuuauucuuaccagauggccuugaccccugugguugugacacucugguauagggcaccagagguccugcugcagucaaccuacgccacucccguggauauguggaguguagggugcaucuucgcugaaauguuucggcgcaagccucucuucuguggaaacagcgaggcagaccaguuaggcaagauuuuugaucugaucggucuuccacccgaggacgauuggccuagagacguuuccuugccaaggggagccuucccgccccgggggccucgcccagugcaaucugucgugcccgaaauggaggaaucgggcgcucagcugcuacucgagaugcugacauuuaauccucauaagcgaauaucagccuucagagcgcuucagcacagcuaucugcauaaagacgagggcaacccagaauga

SEQ ID NO: 1012 - RNA, 690 nt, Artificial Sequence
  derived and/or modified sequence opt4 from CDK4/m__Homo_sapiens__AAB50213
auggacgugugcgccaccagcagaaccgacagagagaucaaggugacccugguguucgagcacguggaccaggaccugagaaccuaccuggacaaggcccccccccccggccugcccgccgagaccaucaaggaccugaugagacaguuccugagaggccuggacuuccugcacgccaacugcaucgugcacagagaccugaagcccgagaacauccuggugaccagcggcggcaccgugaagcuggccgacuucggccuggccagaaucuacagcuaccagauggcccugacccccgugguggugacccugugguacagagcccccgaggugcugcugcagagcaccuacgccacccccguggacauguggagcgugggcugcaucuucgccgagauguucagaagaaagccccuguucugcggcaacagcgaggccgaccagcugggcaagaucuucgaccugaucggccugccccccgaggacgacuggcccagagacgugagccugcccagaggcgccuucccccccagaggccccagacccgugcagagcguggugcccgagauggaggagagcggcgcccagcugcugcuggagaugcugaccuucaacccccacaagagaaucagcgccuucagagcccugcagcacagcuaccugcacaaggacgagggcaaccccgaguga

SEQ ID NO: 1013 - RNA, 690 nt, Artificial Sequence
  derived and/or modified sequence opt5 from CDK4/m__Homo_sapiens__AAB50213
auggacgugugcgccaccagcagaacagaucgggagaucaaggucacgcugguuuucgaacacguggaccaggaucuccgcaccuaccuggacaaagcucccccuccgggccuucccgccgagacaauuaaggaucugaugagacaauuucuccgggggcuggacuuccuucaugcgaacuguaucgugcaccgcgaucugaaaccugaaaauauucucgucaccuccggaggcacagugaagcuggcugacuuugggcuggccagaaucuauucuuaccagauggcccucacccccguuguggucacacugugguaucgggcuccugaggugcuucugcagagcaccuacgccacgcccguugauaugugguccgugggaugcauuuucgcugaaauguuucgcagaaaaccucucuucuguggcaacucugaggccgaccagcuggggaagaucuuugaucuuaucggacugccgcccgaggacgauuggccucgggacgucagccucccccgcggcgcguucccucccagaggcccgcggccugugcaauccgugguccccgaaauggaggaaucuggggcccagcugcugcucgagaugcugaccuuuaauccucauaagcgcauuagcgcuuucagagcccuucagcacuccuaucugcauaaagacgagggaaaccccgaauga

SEQ ID NO: 1014 - protein, 111 aa, Artificial Sequence
  CDK4/m__Homo_sapiens__Q96BE9
MATSRYEPVAEIGVGAYGTVYKARDPHSGHFVALKSVRVPNGGGGGGGLPISTVREVALLRRLEAFEHPNVVRLMDVCATSRTDREIKRCFVESLSSVETLKPTSWAKSLT

SEQ ID NO: 1015 - RNA, 336 nt, Artificial Sequence
  CDK4/m__Homo_sapiens__AAH15669
auggcuaccucucgauaugagccaguggcugaaauuggugucggugccuaugggacaguguacaaggcccgugauccccacaguggccacuuuguggcccucaagagugugagaguccccaauggaggaggagguggaggaggccuucccaucagcacaguucgugagguggcuuuacugaggcgacuggaggcuuuugagcaucccaauguuguccggcugauggacgucugugccacaucccgaacugaccgggagaucaagagauguuucgucgaaagccucucuucuguggaaacucugaagccgaccaguugggcaaaaucuuugaccuga

SEQ ID NO: 1016 - RNA, 336 nt, Artificial Sequence
  derived and/or modified sequence opt1 from CDK4/m__Homo_sapiens__AAH15669
auggccaccagccgcuacgagcccguggccgagaucggcgucggggcguacggcaccguguacaaggcccgggacccgcacuccgggcacuucguggcccucaagagcguccgcgugcccaacggcgggggcggcgggggcgggcugcccaucuccacggugcgggaggucgcccugcugcgccggcucgaggccuucgagcaccccaacguggugcgccugauggacgucugcgcgaccagccggaccgaccgcgagaucaagcggugcuucguggagucccugagcuccguggagacccucaagccgacgagcugggccaagucccugaccuga

SEQ ID NO: 1017 - RNA, 336 nt, Artificial Sequence
  derived and/or modified sequence opt2 from CDK4/m__Homo_sapiens__AAH15669
auggccaccucccgcuacgagcccgucgccgagaucggcgucggcgccuacggcaccgucuacaaggcccgcgacccccacuccggccacuucgucgcccucaaguccguccgcguccccaacggcggcggcggcggcggcggccuccccaucuccaccguccgcgaggucgcccuccuccgccgccucgaggccuucgagcaccccaacgucguccgccucauggacgucugcgccaccucccgcaccgaccgcgagaucaagcgcugcuucgucgagucccucuccuccgucgagacccucaagcccaccuccugggccaagucccucaccuga

SEQ ID NO: 1018 - RNA, 336 nt, Artificial Sequence
  derived and/or modified sequence opt3 from CDK4/m__Homo_sapiens__AAH15669
auggccaccagcagauacgagcccguggcugaaaucggcgucggggcauauggaacaguuuacaaggccagggacccucacuccggucauuucguggcgcugaaaucuguacgggugccaaacggcgggggaggcggugggggacucccgauuucaacuguccgcgagguggcucugcuucgacguuuggaagccuuugagcaccccaauguugugagauuaauggaugucugcgcaacgaguaggaccgaccgggaaauaaagcgcuguuucguggagagccuguccucuguagagacacuaaaaccuacuucgugggccaagucacucaccuga

SEQ ID NO: 1019 - RNA, 336 nt, Artificial Sequence
  derived and/or modified sequence opt4 from CDK4/m__Homo_sapiens__AAH15669
auggccaccagcagauacgagcccguggccgagaucggcgugggcgccuacggcaccguguacaaggccagagacccccacagcggccacuucguggcccugaagagcgugagagugcccaacggcggcggcggcggcggcggccugcccaucagcaccgugagagagguggcccugcugagaagacuggaggccuucgagcaccccaacguggugagacugauggacgugugcgccaccagcagaaccgacagagagaucaagagaugcuucguggagagccugagcagcguggagacccugaagcccaccagcugggccaagagccugaccuga

SEQ ID NO: 1020 - RNA, 336 nt, Artificial Sequence
  derived and/or modified sequence opt5 from CDK4/m__Homo_sapiens__AAH15669
auggccaccagcagauacgagcccguggcugaaaucggcgucggggccuauggaacaguuuacaaggcgcgggacccucacuccggccauuucguggcucugaaaucugugcgcgucccgaacgggggaggcgggggaggcggccuccccauuagcacggugagagagguugcccugcuucggcgccuggaagccuuugagcacccuaauguggucagacucauggaugugugcgcuaccucccggacagaccgcgaaaucaagagauguuucguugagucucugagcuccguggagacccuuaaacccacaucuugggccaagagccugaccuga

SEQ ID NO: 1021 - protein, 142 aa, Artificial Sequence [sequence omitted]

SEQ ID NO: 1022 - RNA, 429 nt, Artificial Sequence
  CDKN2A/m__Homo_sapiens__ACY78326
auggagccggcggcggggagcagcauggagccuucggcugacuggcuggccacggccgcggcccggggucggguagaggaggugcgggcgcugcuggaggcgggggcgcugcccaacgcaccgaauaguuacggucggaggccgauccaggucaugaugaugggcagcgcccgaguggcggagcugcugcugcuccacggcgcggagcccaacugcgccgaccccgccacucucacccgacccgugcacgacgcugcccgggagggcuuccuggacacgcugguggugcugcaccgggccggggcgccgugcgcgaugccuggggccgucugcccguggaccuggcugaggagcugggccaucgcgaugucgcacgguaccugcgcgcggcugcggggggcaccagaggcaguaaccaugcccgcauag

SEQ ID NO: 1023 - RNA, 429 nt, Artificial Sequence
  derived and/or modified sequence opt1 from CDKN2A/m__Homo_sapiens__ACY78326
auggagcccgccgccggcagcuccauggagccgagcgcggacuggcuggccaccgccgccgcccgcgggcggguggaggagguccgcgcgcuccuggaggccggcgcccugcccaacgcccccaacuccuacgggcggcgccccauccaggugaugaugaugggcagcgcgcggguggccgagcuccugcugcuccacggggccgagccgaacugcgccgaccccgccacccugacgcgccccguccacgacgcggcccgggagggcuuccuggacacccucguggugcugcaccgcgccggcgcccccugcgccaugccgggggcggucugccccuggaccuggcugcgguccugggccaucgccaugagccacgggaccugcgcccgccuccggggcgcccccgaggcggugacgaugcccgccuga

SEQ ID NO: 1024 - RNA, 429 nt, Artificial Sequence
  derived and/or modified sequence opt2 from CDKN2A/m__Homo_sapiens__ACY78326
auggagcccgccgccggcuccuccauggagcccuccgccgacuggcucgccaccgccgccgcccgcggccgcgucgaggagguccgcgcccuccucgaggccggcgcccuccccaacgcccccaacuccuacggccgccgccccauccaggucaugaugaugggcuccgcccgcgucgccgagcuccuccuccuccacggcgccgagcccaacugcgccgaccccgccacccucacccgccccguccacgacgccgcccgcgagggcuuccucgacacccucgucguccuccaccgcgccggcgcccccugcgccaugcccggcgccgucugccccuggaccuggcuccgcuccugggccaucgccaugucccacggcaccugcgcccgccuccgcggcgcccccgaggccgucaccaugcccgccuga

SEQ ID NO: 1025 - RNA, 429 nt, Artificial Sequence
  derived and/or modified sequence opt3 from CDKN2A/m__Homo_sapiens__ACY78326
auggagcccgccgcuggcagcuccauggaaccuucugcagacuggcuggccaccgcggcugccagagggaggguggaggaaguccgggcacuccuugaggccggagcucugccaaacgcacccaauucauacggucgccgaccgauccagguuaugaugaugggcagugcccguguggcugaauuguuacugcuacacggggccgagccuaacugcgcggauccagcaacacucacuagacccguacaugacgccgcuagggagggauuccuggauacgcuugugguccugcaccgggccggcgcaccuugugcuaugccaggugccgugugccccuggaccugguugcgcagcugggcgauugccaugucccaugggacaugugcaagacucaggggagcuccugaagccguuacuaugccagcuuga

SEQ ID NO: 1026 - RNA, 429 nt, Artificial Sequence
  derived and/or modified sequence opt4 from CDKN2A/m__Homo_sapiens__ACY78326
auggagcccgccgccggcagcagcauggagcccagcgccgacuggcuggccaccgccgccgccagaggcagaguggaggaggugagagcccugcuggaggccggcgcccugcccaacgcccccaacagcuacggcagaagacccauccaggugaugaugaugggcagcgccagaguggccgagcugcugcugcugcacggcgccgagcccaacugcgccgaccccgccacccugaccagacccgugcacgacgccgccagagagggcuuccuggacacccugguggugcugcacagagccggcgcccccugcgccaugcccggcgccgugugccccuggaccuggcugagaagcugggccaucgccaugagccacggcaccugcgccagacugagaggcgcccccgaggccgugaccaugcccgccuga

SEQ ID NO: 1027 - RNA, 429 nt, Artificial Sequence
  derived and/or modified sequence opt5 from CDKN2A/m__Homo_sapiens__ACY78326
auggagcccgccgcuggcagcuccauggaaccuucugccgacuggcuggcgaccgcugccgccagagggcggguggaggaaguccgcgcucuccuggaggccggagcccuuccgaacgcucccaauagcuacggcagacggccuauccagguuaugaugaugggguccgcgcgcguggccgaacugcuccugcuucacggagcugagcccaacugcgccgauccugcuacacugacgagacccgugcaugacgccgcgcgggagggcuuccucgauacccuggucgugcugcaccgcgccggggcuccuugugccaugccgggagcuguuugccccuggacauggcucagaucuugggccauugccaugagccauggcaccugugcucggcugcgcggcgcgccugaagccgugacaaugcccgcuuga

SEQ ID NO: 1028 - protein, 116 aa, Artificial Sequence
  CDKN2A/m__Homo_sapiens__G3XAG3
MEPAAGSSMEPSADWLATAAARGRVEEVRALLEAGALPNAPNSYGRRPIQVGRGSAAGAGDGGRLWRTKFAGELESGSASILRKKGRLPGEFSEGVCNHRPPPGDALGAWEAKEEE

SEQ ID NO: 1029 - RNA, 351 nt, Artificial Sequence
  CDKN2A/m__Homo_sapiens__EAW58598
auggagccggcggcggggagcagcauggagccuucggcugacuggcuggccacggccgcggcccggggucggguagaggaggugcgggcgcugcuggaggcgggggcgcugcccaacgcaccgaauaguuacggucggaggccgauccagguggguagagggucugcagcgggagcaggggauggcgggcgacucuggaggacgaaguuugcaggggaauuggaaucagguagcgcuucgauucuccggaaaaaggggaggcuuccuggggaguuuucagaagggguuuguaaucacagaccuccuccuggcgacgcccugggggcuugggaagccaaggaagaggaauga

SEQ ID NO: 1030 - RNA, 351 nt, Artificial Sequence
  derived and/or modified sequence opt1 from CDKN2A/m__Homo_sapiens__EAW58598
auggagcccgccgccggcagcuccauggagcccagcgcggacuggcuggccaccgccgccgcccgcgggcggguggaggagguccgcgcgcuccuggaggccggcgcccugcccaacgcccccaacuccuacgggcggcgccccauccaggugggccgggggagcgcggccggcgccggcgacgggggccgccucuggcggaccaaguucgccggggagcuggaguccggcagcgccuccauccugcgcaagaaggggcggcuccccggcgaguucagcgagggcgugugcaaccaccgcccgccgcccggggacgcgcugggcgccugggaggccaaggaggaggaguga

SEQ ID NO: 1031 - RNA, 351 nt, Artificial Sequence
  derived and/or modified sequence opt2 from CDKN2A/m__Homo_sapiens__EAW58598
auggagcccgccgccggcuccuccauggagcccuccgccgacuggcucgccaccgccgccgcccgcggccgcgucgaggagguccgcgcccuccucgaggccggcgcccuccccaacgcccccaacuccuacggccgccgccccauccaggucggccgcggcuccgccgccggcgccggcgacggcggccgccucuggcgcaccaaguucgccggcgagcucgaguccggcuccgccuccauccuccgcaagaagggccgccuccccggcgaguucuccgagggcgucugcaaccaccgccccccccccggcgacgcccucggcgccugggaggccaaggaggaggaguga

SEQ ID NO: 1032 - RNA, 351 nt, Artificial Sequence
  derived and/or modified sequence opt3 from CDKN2A/m__Homo_sapiens__EAW58598
auggagcccgccgcuggcagcuccauggaaccuucugcagacuggcuggccaccgcggcugccagagggaggguggaggaaguccgggcacuccuugaggccggagcucugccaaacgcacccaauucauacggucgccgaccgauccagguuggccgugggagugccgcuggagccggcgauggugggagauuguggaggacaaaguucgcgggagaauuagagagcggcuccgcaucuauucugcggaaaaagggccgccuaccuggggaguuuucggaaggagugugcaaccacagaccacccccuggugacgcccucggcgcuugggaggccaaagaagaggaguga

SEQ ID NO: 1033 - RNA, 351 nt, Artificial Sequence
  derived and/or modified sequence opt4 from CDKN2A/m__Homo_sapiens__EAW58598
auggagcccgccgccggcagcagcauggagcccagcgccgacuggcuggccaccgccgccgccagaggcagaguggaggaggugagagcccugcuggaggccggcgcccugcccaacgcccccaacagcuacggcagaagacccauccaggugggcagaggcagcgccgccggcgccggcgacggcggcagacuguggagaaccaaguucgccggcgagcuggagagcggcagcgccagcauccugagaaagaagggcagacugcccggcgaguucagcgagggcgugugcaaccacagacccccccccggcgacgcccugggcgccugggaggccaaggaggaggaguga

SEQ ID NO: 1034 - RNA, 351 nt, Artificial Sequence
  derived and/or modified sequence opt5 from CDKN2A/m__Homo_sapiens__EAW58598
auggagcccgccgcuggcagcuccauggaaccuucugccgacuggcuggcgaccgcugccgccagagggcggguggaggaaguccgcgcucuccuggaggccggagcccuuccgaacgcucccaauagcuacggcagacggccuauccagguugggcgcggauccgcggccggcgcuggggauggaggcagacuguggcggacaaaguucgccggcgaacucgagucugggagcgcuuccauucugcgcaaaaagggaagacuucccggcgaguuuucugaaggggugugcaaccaccggccucccccuggagacgcccugggcgcgugggaggccaaagaagaggaguga

SEQ ID NO: 1035 - protein, 156 aa, Artificial Sequence
  CDKN2A/m__Homo_sapiens__K7PML8
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 1036 - RNA, 471 nt, Artificial Sequence
  CDKN2A/m__Homo_sapiens__AFN61598
auggagccggcggcggggagcagcauggagccuucggcugacuggcuggccacggccgcggcccggggucggguagaggaggugcgggcgcugcuggaggcgggggcgcugcccaacgcaccgaauaguuacggucggaggccgauccaggucaugaugaugggcagcgcccgaguggcggagcugcugcugcuccacggcgcggagcccaacugcgccgaccccgccacucucacccgacccgugcacgacgcugcccgggagggcuuccuggacacgcugguggugcugcaccgggccggggcgcggcuggacgugcgcgaugccuggggccgucugcccguggaccuggcugaggagcugggccaucgcgaugucgcacgguaccugcgcgcggcugcggggggcaccagaggcaguaaccaugcccgcauagaugccgcggaaggucccucagacauccccgauuga

SEQ ID NO: 1037 - RNA, 471 nt, Artificial Sequence
  derived and/or modified sequence opt1 from CDKN2A/m__Homo_sapiens__AFN61598
auggagcccgccgccggcagcuccauggagccgagcgcggacuggcuggccaccgccgccgcccgcgggcggguggaggagguccgcgcgcuccuggaggccggcgcccugcccaacgcccccaacuccuacgggcggcgccccauccaggugaugaugaugggcagcgcgcggguggccgagcuccugcugcuccacggggccgagccgaacugcgccgaccccgccacccugacgcgccccguccacgacgcggcccgggagggcuuccuggacacccucguggugcugcaccgcgccggcgcccggcuggacguccgcgacgccugggggcggcuccccguggaccuggcggaggagcugggccaccgcgacguggcccgguaccuccgcgccgccgccgggggcacccggggguccaaccacgcgcgcaucgacgccgccgagggcccgagcgacauccccgacuga

SEQ ID NO: 1038 - RNA, 471 nt, Artificial Sequence
  derived and/or modified sequence opt2 from CDKN2A/m__Homo_sapiens__AFN61598
auggagcccgccgccggcuccuccauggagcccuccgccgacuggcucgccaccgccgccgcccgcggccgcgucgaggagguccgcgcccuccucgaggccggcgcccuccccaacgcccccaacuccuacggccgccgccccauccaggucaugaugaugggcuccgcccgcgucgccgagcuccuccuccuccacggcgccgagcccaacugcgccgaccccgccacccucacccgccccguccacgacgccgcccgcgagggcuuccucgacacccucgucguccuccaccgcgccggcgcccgccucgacguccgcgacgccuggggccgccuccccgucgaccucgccgaggagcucggccaccgcgacgucgcccgcuaccuccgcgccgccgccggcggcacccgcggcuccaaccacgcccgcaucgacgccgccgagggccccuccgacauccccgacuga

SEQ ID NO: 1039 - RNA, 471 nt, Artificial Sequence
  derived and/or modified sequence opt3 from CDKN2A/m__Homo_sapiens__AFN61598
auggagcccgccgcuggcagcuccauggaaccuucugcagacuggcuggccaccgcggcugccagagggaggguggaggaaguccgggcacuccuugaggccggagcucugccaaacgcacccaauucauacggucgccgaccgauccagguuaugaugaugggcagugcccguguggcugaauuguuacugcuacacggggccgagccuaacugcgcggauccagcaacacucacuagacccguacaugacgccgcuagggagggauuccuggauacgcuugugguccugcaccgggccggcgcacgcuuggacgugagagaugcuugggguaggcucccuguugaccuggccgaggaacuggggcaucgggauguggcgcgcuaucuccgagccgcagcuggaggcaccagaggcagcaaucacgccaggauugacgcugccgaagggccauccgauauacccgacuga

SEQ ID NO: 1040 - RNA, 471 nt, Artificial Sequence
  derived and/or modified sequence opt4 from CDKN2A/m__Homo_sapiens__AFN61598
auggagcccgccgccggcagcagcauggagcccagcgccgacuggcuggccaccgccgccgccagaggcagaguggaggaggugagagcccugcuggaggccggcgcccugcccaacgcccccaacagcuacggcagaagacccauccaggugaugaugaugggcagcgccagaguggccgagcugcugcugcugcacggcgccgagcccaacugcgccgaccccgccacccugaccagacccgugcacgacgccgccagagagggcuuccuggacacccugguggugcugcacagagccggcgccagacuggacgugagagacgccuggggcagacugcccguggaccuggccgaggagcugggccacagagacguggccagauaccugagagccgccgccggcggcaccagaggcagcaaccacgccagaaucgacgccgccgagggccccagcgacauccccgacuga

SEQ ID NO: 1041 - RNA, 471 nt, Artificial Sequence
  derived and/or modified sequence opt5 from CDKN2A/m__Homo_sapiens__AFN61598
auggagcccgccgcuggcagcuccauggaaccuucugccgacuggcuggcgaccgcugccgccagagggcggguggaggaaguccgcgcucuccuggaggccggagcccuuccgaacgcucccaauagcuacggcagacggccuauccagguuaugaugaugggguccgcgcgcguggccgaacugcuccugcuucacggagcugagcccaacugcgccgauccugcuacacugacgagacccgugcaugacgccgcgcgggagggcuuccucgauacccuggucgugcugcaccgcgccggggcuagacucgacguucgggaugccuggggacgccugccuguggaccuugcugaggaacugggccauagagaugucgcccgguaucuccgcgccgcugcgggcgggacaagaggaucuaaucacgcccggauugacgcugccgaaggcccgagcgauauccccgacuga

SEQ ID NO: 1042 - protein, 108 aa, Artificial Sequence
  CDKN2A/m__Homo_sapiens__L8E941
MEVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 1043 - RNA, 327 nt, Artificial Sequence
  CDKN2A/m__Homo_sapiens__CCQ43815
auggaagucaugaugaugggcagcgcccgaguggcggagcugcugcugcuccacggcgcggagcccaacugcgccgaccccgccacucucacccgacccgugcacgacgcugcccgggagggcuuccuggacacgcugguggugcugcaccgggccggggcgcggcuggacgugcgcgaugccuggggccgucugcccguggaccuggcugaggagcugggccaucgcgaugucgcacgguaccugcgcgcggcugcggggggcaccagaggcaguaaccaugcccgcauagaugccgcggaaggucccucagacauccccgauuga

SEQ ID NO: 1044 - RNA, 327 nt, Artificial Sequence
  derived and/or modified sequence opt1 from CDKN2A/m__Homo_sapiens__CCQ43815
auggaggugaugaugaugggcagcgcccgcgucgccgagcugcuccugcugcacggggcggagcccaacugcgccgacccggccacccucacccggcccgugcacgacgccgcccgcgagggcuuccuggacacgcuggugguccuccaccgggcgggggcccgccuggacgugcgggacgccuggggccgccugcccguggaccucgccgaggagcuggggcaccgggacgucgcgcgcuaccugcgggccgccgccggcggcacccgcggguccaaccacgcccggaucgacgcggccgagggccccagcgacaucccggacuga

SEQ ID NO: 1045 - RNA, 327 nt, Artificial Sequence
  derived and/or modified sequence opt2 from CDKN2A/m__Homo_sapiens__CCQ43815
auggaggucaugaugaugggcuccgcccgcgucgccgagcuccuccuccuccacggcgccgagcccaacugcgccgaccccgccacccucacccgccccguccacgacgccgcccgcgagggcuuccucgacacccucgucguccuccaccgcgccggcgcccgccucgacguccgcgacgccuggggccgccuccccgucgaccucgccgaggagcucggccaccgcgacgucgcccgcuaccuccgcgccgccgccggcggcacccgcggcuccaaccacgcccgcaucgacgccgccgagggccccuccgacauccccgacuga

SEQ ID NO: 1046 - RNA, 327 nt, Artificial Sequence
  derived and/or modified sequence opt3 from CDKN2A/m__Homo_sapiens__CCQ43815
auggaggugaugaugaugggcagcgccagagucgcugaacugcuccuucugcacggggcagagcccaacugcgccgacccugcgaccuugacaaggccaguucaugaugcugcccgggaaggauucuuagacacucuggugguacuacaccgcgccggugcacgacucgaugugcgugacgcuuggggcagacugccggucgaucuugcagaggaacuggggcauagggacguggcccgguacuugcgcgcugccgcgggaggcacgagagguuccaaucacgcaaggaucgaugccgcugaggggcccucugacauuccugauuga

SEQ ID NO: 1047 - RNA, 327 nt, Artificial Sequence
  derived and/or modified sequence opt4 from CDKN2A/m__Homo_sapiens__CCQ43815
auggaggugaugaugaugggcagcgccagaguggccgagcugcugcugcugcacggcgccgagcccaacugcgccgaccccgccacccugaccagacccgugcacgacgccgccagagagggcuuccuggacacccugguggugcugcacagagccggcgccagacuggacgugagagacgccuggggcagacugcccguggaccuggccgaggagcugggccacagagacguggccagauaccugagagccgccgccggcggcaccagaggcagcaaccacgccagaaucgacgccgccgagggccccagcgacauccccgacuga

SEQ ID NO: 1048 - RNA, 327 nt, Artificial Sequence
  derived and/or modified sequence opt5 from CDKN2A/m__Homo_sapiens__CCQ43815
auggaggugaugaugaugggcagcgccagagucgcugaacugcuccugcuucacggggccgagcccaacugcgcggacccugcuacccugacacggccgguucaugaugccgcccgcgaaggauuccucgacacgcugguggugcuucacagagcuggcgcccggcuggauguccgcgacgcuugggggagacuccccguggaucuggccgaggaacugggacaucgggacguugcgcgcuaccucagagccgcugccggcgggacccggggauccaaucacgcucgcaucgaugccgcggagggcccuucugacauucccgauuga

SEQ ID NO: 1049 - protein, 132 aa, Artificial Sequence
  CDKN2A/m__Homo_sapiens__Q8N726
MVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 1050 - RNA, 399 nt, Artificial Sequence
  CDKN2A/m__Homo_sapiens__AAA82236
auggugcgcagguucuuggugacccuccggauucggcgcgcgugcggcccgccgcgagugaggguuuucgugguucacaucccgcggcucacgggggagugggcagcgccaggggcgcccgccgcuguggcccucgugcugaugcuacugaggagccagcgucuagggcagcagccgcuuccuagaagaccaggucaugaugaugggcagcgcccgaguggcggagcugcugcugcuccacggcgcggagcccaacugcgccgaccccgccacucucacccgacccgugcacgacgcugcccgggagggcuuccuggacacgcugguggugcugcaccgggccggggcgcggcuggacgugcgcgaugccuggggccgucugcccguggaccuggcuga

SEQ ID NO: 1051 - RNA, 399 nt, Artificial Sequence
  derived and/or modified sequence opt1 from CDKN2A/m__Homo_sapiens__AAA82236
auggugcgccgguuccuggucacccuccgcauccggcgcgccugcgggcccccgcgggugcgcguguucgucgugcacaucccccggcugaccggggagugggccgcgcccggcgcccccgccgccguggcccugguccucaugcugcugcgcagccagcggcucgggcagcagccgcugccccgccggcccggccacgacgacgggcagcgccccuccggcggcgcggccgccgccccgcggcgcggggcgcagcugcggcgcccccggcacagccaccccacgcgcgcccggcgcugccccggcgggcucccgggccacgccgggggcgccgcccccggccggggcgcggccggccgcgcccgcugccuggggcccuccgcccggggccccggcuga

SEQ ID NO: 1052 - RNA, 399 nt, Artificial Sequence
  derived and/or modified sequence opt2 from CDKN2A/m__Homo_sapiens__AAA82236
augguccgccgcuuccucgucacccuccgcauccgccgcgccugcggccccccccgcguccgcgucuucgucguccacaucccccgccucaccggcgagugggccgcccccggcgcccccgccgccgucgcccucguccucaugcuccuccgcucccagcgccucggccagcagccccucccccgccgccccggccacgacgacggccagcgccccuccggcggcgccgccgccgccccccgccgcggcgcccagcuccgccgcccccgccacucccaccccacccgcgcccgccgcugccccggcggccuccccggccacgccggcggcgccgcccccggccgcggcgccgccggccgcgcccgcugccucggccccuccgcccgcggccccggcuga

SEQ ID NO: 1053 - RNA, 399 nt, Artificial Sequence
  derived and/or modified sequence opt3 from CDKN2A/m__Homo_sapiens__AAA82236
auggugagaagguuccuggucacccuccggauccgccgagccugcgggcccccucguguuagaguguuuguagugcacauuccaaggcuuacaggcgagugggcugcaccgggagcccccgcggcugucgcccugguguugauguuacugcggagccagcgccuaggucaacagccucucccaagaaggcccggccaugacgaugggcagcggccuuccggaggcgcagccgcugcaccacgccgaggugcccagcugagaaggccccggcacucucauccuacucgugcucgcagauguccagggggacuuccgggccacgccggcggggcggcacccggaaggggugccgcuggccgggcccgaugccuggggccuucagcacgcggaccaggcuga

SEQ ID NO: 1054 - RNA, 399 nt, Artificial Sequence
  derived and/or modified sequence opt4 from CDKN2A/m__Homo_sapiens__AAA82236
auggugagaagauuccuggugacccugagaaucagaagagccugcggcccccccagagugagaguguucguggugcacauccccagacugaccggcgagugggccgcccccggcgcccccgccgccguggcccuggugcugaugcugcugagaagccagagacugggccagcagccccugcccagaagacccggccacgacgacggccagagacccagcggcggcgccgccgccgcccccagaagaggcgcccagcugagaagacccagacacagccaccccaccagagccagaagaugccccggcggccugcccggccacgccggcggcgccgcccccggcagaggcgccgccggcagagccagaugccugggccccagcgccagaggccccggcuga

SEQ ID NO: 1055 - RNA, 399 nt, Artificial Sequence
  derived and/or modified sequence opt5 from CDKN2A/m__Homo_sapiens__AAA82236
auggugagacgguuccuggucacccuccgcaucagacgggccugcgggcccccucgcguuagaguguuugugguccacauuccgcggcugacaggcgagugggcugcccccggagcgccugcugccguggcccuuguucugaugcuccugcgcagccagagacuuggccaacagccccugccucggcgccccgggcaugacgauggacagagaccuuccggcggggcugccgcugccccgcggcgcggagcgcagcucagacggccccgccacucucauccuacgagagcccggagaugucccggcggccugccugggcacgcuggaggcgccgcucccgggcgcggagccgcgggccgggccagaugccuggggccgagcgcucgcggaccuggcuga

SEQ ID NO: 1056 - protein, 702 aa, Artificial Sequence
  CEA__Homo_sapiens__NP_004354
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 1057 - RNA, 2109 nt, Artificial Sequence
  CEA__Homo_sapiens__CCDS12584.1
auggagucucccucggccccuccccacagauggugcauccccuggcagaggcuccugcucacagccucacuucuaaccuucuggaacccgcccaccacugccaagcucacuauugaauccacgccguucaaugucgcagaggggaaggaggugcuucuacuuguccacaaucugccccagcaucuuuuuggcuacagcugguacaaaggugaaagaguggauggcaaccgucaaauuauaggauauguaauaggaacucaacaagcuaccccagggcccgcauacaguggucgagagauaauauaccccaaugcaucccugcugauccagaacaucauccagaaugacacaggauucuacacccuacacgucauaaagucagaucuugugaaugaagaagcaacuggccaguuccggguauacccggagcugcccaagcccuccaucuccagcaacaacuccaaacccguggaggacaaggaugcuguggccuucaccugugaaccugagacucaggacgcaaccuaccugugguggguaaacaaucagagccucccggucagucccaggcugcagcuguccaauggcaacaggacccucacucuauucaaugucacaagaaaugacacagcaagcuacaaaugugaaacccagaacccagugagugccaggcgcagugauucagucauccugaauguccucuauggcccggaugcccccaccauuuccccucuaaacacaucuuacagaucaggggaaaaucugaaccucuccugccacgcagccucuaacccaccugcacaguacucuugguuugucaaugggacuuuccagcaauccacccaagagcucuuuauccccaacaucacugugaauaauaguggauccuauacgugccaagcccauaacucagacacuggccucaauaggaccacagucacgacgaucacagucuaugcagagccacccaaacccuucaucaccagcaacaacuccaaccccguggaggaugaggaugcuguagccuuaaccugugaaccugagauucagaacacaaccuaccugugguggguaaauaaucagagccucccggucagucccaggcugcagcuguccaaugacaacaggacccucacucuacucagugucacaaggaaugauguaggacccuaugaguguggaauccagaacgaauuaaguguugaccacagcgacccagucauccugaauguccucuauggcccagacgaccccaccauuucccccucauacaccuauuaccguccaggggugaaccucagccucuccugccaugcagccucuaacccaccugcacaguauucuuggcugauugaugggaacauccagcaacacacacaagagcucuuuaucuccaacaucacugagaagaacagcggacucuauaccugccaggccaauaacucagccaguggccacagcaggacuacagucaagacaaucacagucucugcggagcugcccaagcccuccaucuccagcaacaacuccaaacccguggaggacaaggaugcuguggccuucaccugugaaccugaggcucagaacacaaccuaccugugguggguaaauggucagagccucccagucagucccaggcugcagcuguccaauggcaacaggacccucacucuauucaaugucacaagaaaugacgcaagagccuauguauguggaauccagaacucagugagugcaaaccgcagugacccagucacccuggauguccucuaugggccggacacccccaucauuucccccccagacucgucuuaccuuucgggagcgaaccucaaccucuccugccacucggccucuaacccauccccgcaguauucuuggcguaucaaugggauaccgcagcaacacacacaaguucucuuuaucgccaaaaucacgccaaauaauaacgggaccuaugccuguuuugucucuaacuuggcuacuggccgcaauaauuccauagucaagagcaucacagucucugcaucuggaacuucuccuggucucucagcuggggccacugucggcaucaugauuggagugcugguugggguugcucugauauag

SEQ ID NO: 1058 - RNA, 2109 nt, Artificial Sequence
  derived and/or modified sequence opt1 from CEA__Homo_sapiens__CCDS12584.1
auggagagccccuccgccccgccccaccgcuggugcauccccuggcagcggcugcuccugaccgccagccugcucaccuucuggaacccgcccacgaccgcgaagcugaccaucgaguccacccccuucaacguggccgagggcaaggagguccugcuccuggugcacaaccugccccagcaccucuucggguacagcugguacaagggcgagcgcguggacgggaaccggcagaucaucggcuacgucaucgggacgcagcaggccacccccggcccggccuacuccggccgcgagaucaucuaccccaacgccagccugcugauccagaacaucauccagaacgacaccggguucuacacccuccacgugaucaaguccgaccuggugaacgaggaggcgacgggccaguuccgggucuaccccgagcugcccaagccgagcaucuccagcaacaacuccaagcccguggaggacaaggacgccguggccuucacgugcgagcccgagacccaggacgccaccuaccucuggugggucaacaaccagagccugcccguguccccgcgccugcagcucagcaacgggaaccggacgcugacccuguucaacgugacccgcaacgacaccgcguccuacaagugcgagacgcagaaccccgucagcgcccggcgcuccgacagcgugauccucaacgugcuguacggccccgacgcccccaccaucuccccgcugaacaccagcuaccggagcggggagaaccucaaccuguccugccacgccgccagcaacccgcccgcgcaguacuccugguucgucaacggcaccuuccagcagagcacgcaggagcuguucauccccaacaucaccgugaacaacuccggcagcuacacgugccaggcccacaacuccgacaccgggcucaaccgcaccaccgugaccaccaucacggucuacgccgagccgcccaagcccuucaucaccagcaacaacuccaaccccguggaggacgaggacgccguggcccugaccugcgagcccgagauccagaacaccacguaccuguggugggucaacaaccagagccuccccgugagcccccggcugcagcuguccaacgacaaccgcacccucacccugcuguccgugacccggaacgacgucggcccguacgagugcgggauccagaacgagcucagcguggaccacuccgaccccgucauccugaacgugcuguacggccccgacgaccccacgaucagcccguccuacaccuacuaccgccccggcgugaaccucagccuguccugccacgcggccagcaacccgcccgcccaguacagcuggcugaucgacgggaacauccagcagcacacccaggagcuguucaucuccaacaucaccgagaagaacagcggccucuacacgugccaggccaacaacuccgccagcgggcacucccggaccaccgucaagaccaucaccgugagcgcggagcugcccaagcccuccaucagcuccaacaacagcaagcccguggaggacaaggacgccgucgccuucacgugcgagcccgaggcccagaacaccaccuaccucuggugggugaacggccagucccugccggugagcccccgccugcagcucuccaacgggaaccggacccugacgcuguucaacgucacccgcaacgacgcccgggcguacgugugcggcauccagaacagcguguccgccaaccgcagcgaccccgucacccuggacgugcucuacggccccgacaccccgaucaucuccccgcccgacagcagcuaccuguccggggccaaccugaaccucagcugccacuccgccagcaaccccagcccccaguacuccuggcgcaucaacggcaucccccagcagcacacccaggugcuguucaucgcgaagaucacccccaacaacaacgggaccuacgccugcuucgucuccaaccuggccaccggccggaacaacagcaucgugaaguccaucacggugagcgccuccgggaccagccccggccucuccgccggcgcgaccgucgggaucaugaucggcgugcuggugggggucgcccugaucuga

SEQ ID NO: 1059 - RNA, 2109 nt, Artificial Sequence
  derived and/or modified sequence opt2 from CEA__Homo_sapiens__CCDS12584.1
auggagucccccuccgcccccccccaccgcuggugcauccccuggcagcgccuccuccucaccgccucccuccucaccuucuggaacccccccaccaccgccaagcucaccaucgaguccacccccuucaacgucgccgagggcaaggagguccuccuccucguccacaaccucccccagcaccucuucggcuacuccugguacaagggcgagcgcgucgacggcaaccgccagaucaucggcuacgucaucggcacccagcaggccacccccggccccgccuacuccggccgcgagaucaucuaccccaacgccucccuccucauccagaacaucauccagaacgacaccggcuucuacacccuccacgucaucaaguccgaccucgucaacgaggaggccaccggccaguuccgcgucuaccccgagcuccccaagcccuccaucuccuccaacaacuccaagcccgucgaggacaaggacgccgucgccuucaccugcgagcccgagacccaggacgccaccuaccucuggugggucaacaaccagucccuccccgucuccccccgccuccagcucuccaacggcaaccgcacccucacccucuucaacgucacccgcaacgacaccgccuccuacaagugcgagacccagaaccccgucuccgcccgccgcuccgacuccgucauccucaacguccucuacggccccgacgcccccaccaucuccccccucaacaccuccuaccgcuccggcgagaaccucaaccucuccugccacgccgccuccaacccccccgcccaguacuccugguucgucaacggcaccuuccagcaguccacccaggagcucuucauccccaacaucaccgucaacaacuccggcuccuacaccugccaggcccacaacuccgacaccggccucaaccgcaccaccgucaccaccaucaccgucuacgccgagccccccaagcccuucaucaccuccaacaacuccaaccccgucgaggacgaggacgccgucgcccucaccugcgagcccgagauccagaacaccaccuaccucuggugggucaacaaccagucccuccccgucuccccccgccuccagcucuccaacgacaaccgcacccucacccuccucuccgucacccgcaacgacgucggccccuacgagugcggcauccagaacgagcucuccgucgaccacuccgaccccgucauccucaacguccucuacggccccgacgaccccaccaucucccccuccuacaccuacuaccgccccggcgucaaccucucccucuccugccacgccgccuccaacccccccgcccaguacuccuggcucaucgacggcaacauccagcagcacacccaggagcucuucaucuccaacaucaccgagaagaacuccggccucuacaccugccaggccaacaacuccgccuccggccacucccgcaccaccgucaagaccaucaccgucuccgccgagcuccccaagcccuccaucuccuccaacaacuccaagcccgucgaggacaaggacgccgucgccuucaccugcgagcccgaggcccagaacaccaccuaccucuggugggucaacggccagucccuccccgucuccccccgccuccagcucuccaacggcaaccgcacccucacccucuucaacgucacccgcaacgacgcccgcgccuacgucugcggcauccagaacuccgucuccgccaaccgcuccgaccccgucacccucgacguccucuacggccccgacacccccaucaucuccccccccgacuccuccuaccucuccggcgccaaccucaaccucuccugccacuccgccuccaaccccuccccccaguacuccuggcgcaucaacggcaucccccagcagcacacccagguccucuucaucgccaagaucacccccaacaacaacggcaccuacgccugcuucgucuccaaccucgccaccggccgcaacaacuccaucgucaaguccaucaccgucuccgccuccggcaccucccccggccucuccgccggcgccaccgucggcaucaugaucggcguccucgucggcgucgcccucaucuga

SEQ ID NO: 1060 - RNA, 2109 nt, Artificial Sequence
  derived and/or modified sequence opt3 from CEA__Homo_sapiens__CCDS12584.1
auggagagccccuccgccccuccacacagauggugcaucccguggcagaggcugcuccuuaccgcuucucuguugacauucuggaaucccccuacuacggcaaaguuaaccauugaaucaacaccauuuaauguggccgagggcaaagaaguccugcuacucguucauaaccugccccaacaccuuuucggguacaguugguauaagggagagcggguggacgguaaucgccagauaaucggcuacguaauugggacucagcaggcgaccccuggaccagcuuauagcggccgagaaaucauuuaccccaacgccucccuguugauccaaaauauaauccagaacgauacagguuuuuauacccuccaugugauuaaaucugaccuggucaaugaggaggcaacugggcaguuccguguguacccugaacugccaaagccgucgaucucaagcaacaauaguaaacccguugaggauaaggacgccguggcuuuuacaugugaaccugagacccaggaugcaacguaucucuggugggucaacaaucaauccuuaccagugucucccagacugcagcuuagcaacggaaauaggacuuugacccuguucaacguaacacggaaugacacugccuccuacaagugcgagacccagaacccuguuucagcucgcagaagugauagcgugauucuaaacguccucuacggcccagacgcccccacaaucucuccgcugaauaccuccuauaggucaggcgaaaaccuuaaucugagcugucacgcggcaaguaacccucccgcccaguacucuugguuugugaaugggacguuccaacaguccacucaggaguuguuuauaccaaacauuacagugaauaacagcggaucguauaccugccaagcucauaauucugauacuggucucaaccggacaaccgucacgaccaucacaguuuacgccgaaccucccaaaccauucauuacuuccaauaacucaaaucccguggaggacgaagaugcaguagcucugaccugugagccugagauccagaacacaacuuauuuauggugggugaauaaccagagucugccagucagcccgcgccuccagcuuuccaacgacaaucgaacccugacauugcuaucugugaccagaaacgauguuggccccuacgaaugcgggauccaaaaugagcugagcguggaccacucagacccugucauucucaacgugcuguauggaccagaugaccccacuauaaguccuuccuacacguacuauaggccaggcguaaaucuuagccugucuugucacgccgcgucaaaucccccggcccaguacaguugguugaucgaugguaauauucagcagcauacacaagaacucuuuaucagcaacauaaccgagaagaacuccgggcuguauacuugccaggcaaacaauucugcuucgggacacagccggaccacaguuaaaaccauuacuguguccgccgaauuaccuaagccaucaaucaguucuaacaauagcaaacccgucgaggacaaggaugcuguggccuucacaugugagccugaagcacagaacacgaccuaccuguggugggucaauggccagucccuacccgugucaccacgucuccaacugagcaacggcaaccgcacucuuacauuguuuaauguuaccagaaacgacgccagggcuuaugugugcgggauccagaacucuguauccgcgaaccggagugauccugucacacuggacgugcucuacggacccgauacuccaauuaucagcccgccugacucuuccuaucugucaggugcaaaucuuaaccugaguugucauagcgccucgaaucccuccccacaguacucuuggcgaauuaacggcauaccccagcaacacacccagguuuuguucaucgcuaagauuacgccuaauaacaaugggaccuacgccugcuucgugagcaaccucgcaacaggacgcaauaacucaaucgucaaaaguaucacuguguccgccucuggcaccagcccaggucuguccgcuggggccacaguaggcauuaugauaggaguguuaguuggcgucgcacugaucuga

SEQ ID NO: 1061 - RNA, 2109 nt, Artificial Sequence
  derived and/or modified sequence opt4 from CEA__Homo_sapiens__CCDS12584.1
auggagagccccagcgcccccccccacagauggugcauccccuggcagagacugcugcugaccgccagccugcugaccuucuggaacccccccaccaccgccaagcugaccaucgagagcacccccuucaacguggccgagggcaaggaggugcugcugcuggugcacaaccugccccagcaccuguucggcuacagcugguacaagggcgagagaguggacggcaacagacagaucaucggcuacgugaucggcacccagcaggccacccccggccccgccuacagcggcagagagaucaucuaccccaacgccagccugcugauccagaacaucauccagaacgacaccggcuucuacacccugcacgugaucaagagcgaccuggugaacgaggaggccaccggccaguucagaguguaccccgagcugcccaagcccagcaucagcagcaacaacagcaagcccguggaggacaaggacgccguggccuucaccugcgagcccgagacccaggacgccaccuaccuguggugggugaacaaccagagccugcccgugagccccagacugcagcugagcaacggcaacagaacccugacccuguucaacgugaccagaaacgacaccgccagcuacaagugcgagacccagaaccccgugagcgccagaagaagcgacagcgugauccugaacgugcuguacggccccgacgcccccaccaucagcccccugaacaccagcuacagaagcggcgagaaccugaaccugagcugccacgccgccagcaacccccccgcccaguacagcugguucgugaacggcaccuuccagcagagcacccaggagcuguucauccccaacaucaccgugaacaacagcggcagcuacaccugccaggcccacaacagcgacaccggccugaacagaaccaccgugaccaccaucaccguguacgccgagccccccaagcccuucaucaccagcaacaacagcaaccccguggaggacgaggacgccguggcccugaccugcgagcccgagauccagaacaccaccuaccuguggugggugaacaaccagagccugcccgugagccccagacugcagcugagcaacgacaacagaacccugacccugcugagcgugaccagaaacgacgugggccccuacgagugcggcauccagaacgagcugagcguggaccacagcgaccccgugauccugaacgugcuguacggccccgacgaccccaccaucagccccagcuacaccuacuacagacccggcgugaaccugagccugagcugccacgccgccagcaacccccccgcccaguacagcuggcugaucgacggcaacauccagcagcacacccaggagcuguucaucagcaacaucaccgagaagaacagcggccuguacaccugccaggccaacaacagcgccagcggccacagcagaaccaccgugaagaccaucaccgugagcgccgagcugcccaagcccagcaucagcagcaacaacagcaagcccguggaggacaaggacgccguggccuucaccugcgagcccgaggcccagaacaccaccuaccuguggugggugaacggccagagccugcccgugagccccagacugcagcugagcaacggcaacagaacccugacccuguucaacgugaccagaaacgacgccagagccuacgugugcggcauccagaacagcgugagcgccaacagaagcgaccccgugacccuggacgugcuguacggccccgacacccccaucaucagcccccccgacagcagcuaccugagcggcgccaaccugaaccugagcugccacagcgccagcaaccccagcccccaguacagcuggagaaucaacggcaucccccagcagcacacccaggugcuguucaucgccaagaucacccccaacaacaacggcaccuacgccugcuucgugagcaaccuggccaccggcagaaacaacagcaucgugaagagcaucaccgugagcgccagcggcaccagccccggccugagcgccggcgccaccgugggcaucaugaucggcgugcuggugggcguggcccugaucuga

SEQ ID NO: 1062 - RNA, 2109 nt, Artificial Sequence
  derived and/or modified sequence opt5 from CEA__Homo_sapiens__CCDS12584.1
auggagagccccuccgccccuccgcacagauggugcauccccuggcagcggcugcuccugaccgcuucucuucugacauucuggaacccucccacgaccgccaagcucacaauugaaagcaccccuuuuaauguggcggagggcaaagaaguccugcuucugguucauaaccucccccaacaccuguucggguacuccugguauaagggagagcgcguggacggcaauagacagaucauuggguacgugaucggaacacagcaggcuaccccuggcccggccuauucugggcgggaaauuaucuaccccaacgccagccugcucauccaaaauauuauccagaacgauacaggauuuuauacccugcaugucauuaaauccgaccuugugaaugaggaggcuacgggccaguuccgcguuuacccugaacugcccaagccuucuaucagcuccaacaauagcaaacccguggaggauaaggacgccgucgcuuuuaccugugaaccggagacacaggaugccaccuaucucuggugggugaacaaucaaucucugccuguuucccccagacuucagcugagcaacggcaaucggacacucacccuguucaacgugacgcgcaaugacacagcgucuuacaagugcgagacccagaacccugucuccgccagacggagcgauucugugauucugaacgugcucuacgggcccgacgcucccacaaucuccccucugaauaccagcuaucgcuccggagaaaaccuuaaucugucuugucacgccgcuagcaacccgcccgcccaguacuccugguuugucaauggcaccuuccaacagagcacacaggagcucuuuauuccuaacaucacgguuaauaacucuggguccuauaccugccaagcgcauaauagcgauacaggacugaacagaaccacagugaccacgaucacaguguacgccgaacccccuaaacccuucauuaccucuaauaacagcaauccggucgaggacgaagaugcuguggcccuuaccugugagccugagauccagaacacaaccuaucugugguggguuaauaaccagucccuccccgugucuccucggcugcagcugagcaacgacaaucgcacacucacgcugcuuuccgucaccagaaacgaugugggccccuacgaaugcgggauucaaaaugagcugagcguugaccacucugacccugugauccucaacguccuguauggacccgaugacccgacaauuuccccuagcuacaccuacuaucggcccggcgugaaucuuucucuguccugucacgcugccagcaaucccccugcccaguacuccuggcucaucgauggcaauauccagcagcauacacaagaacuguuuauuucuaacaucaccgagaagaauagcgggcuguauacgugccaggcuaacaauuccgcgucuggacacagccgcaccacagucaaaaccauuacaguguccgccgaacucccgaagcccagcaucucuuccaacaauagcaaaccuguugaggacaaggaugcuguggccuucaccugugagcccgaagcccagaacacgacauaccuguggugggucaauggccagucucuuccugugucccccagacugcaacucagcaacgggaaccggacccugacacuguuuaauguuaccagaaacgacgcucgcgccuaugugugcggcauucagaacucugucagcgcgaaccgguccgauccugugacccuugacgugcucuacggacccgauacaccgaucaucagcccucccgacucuuccuaucugagcggggcuaaucugaaccucuccugucauucugccagcaauccuucuccccaguacuccuggagaauuaacggaaucccgcagcaacacacgcagguucuguucauugccaagaucaccccuaauaacaauggcacauacgcuugcuucgucagcaaccuugccaccggccgcaauaacuccauugugaaaucuaucacagugagcgcuuccgggaccagccccggacugucugccggcgcgacggucgggauuaugaucggagugcucguuggcguggcccugaucuga

SEQ ID NO: 1063 - protein, 344 aa, Artificial Sequence
  CEAM6__Homo_sapiens__P40199
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 1064 - RNA, 1035 nt, Artificial Sequence
  CEAM6__Homo_sapiens__AAA51739
augggaccccccucagccccucccugcagauugcauguccccuggaaggagguccugcucacagccucacuucuaaccuucuggaacccacccaccacugccaagcucacuauugaauccacgccauucaaugucgcagaggggaaggagguucuucuacucgcccacaaccugccccagaaucguauugguuacagcugguacaaaggcgaaagaguggauggcaacagucuaauuguaggauauguaauaggaacucaacaagcuaccccagggcccgcauacaguggucgagagacaauauaccccaaugcaucccugcugauccagaacgucacccagaaugacacaggauucuauacccuacaagucauaaagucagaucuugugaaugaagaagcaaccggacaguuccauguauacccggagcugcccaagcccuccaucuccagcaacaacuccaaccccguggaggacaaggaugcuguggccuucaccugugaaccugagguucagaacacaaccuaccugugguggguaaauggucagagccucccggucagucccaggcugcagcuguccaauggcaacaugacccucacucuacucagcgucaaaaggaacgaugcaggauccuaugaaugugaaauacagaacccagcgagugccaaccgcagugacccagucacccugaauguccucuauggcccagauggccccaccauuucccccucaaaggccaauuaccguccaggggaaaaucugaaccucuccugccacgcagccucuaacccaccugcacaguacucuugguuuaucaaugggacguuccagcaauccacacaagagcucuuuauccccaacaucacugugaauaauagcggauccuauaugugccaagcccauaacucagccacuggccucaauaggaccacagucacgaugaucacagucucuggaagugcuccuguccucucagcuguggccaccgucggcaucacgauuggagugcuggccagggucgcucugauauag

SEQ ID NO: 1065 - RNA, 1035 nt, Artificial Sequence
  derived and/or modified sequence opt1 from CEAM6__Homo_sapiens__AAA51739
auggggcccccgagcgccccgcccugccgccugcacgugcccuggaaggagguccuccugaccgccucccugcucaccuucuggaacccgcccacgaccgcgaagcugaccaucgagagcacccccuucaacguggccgagggcaaggaggugcugcuccuggcccacaaccugccccagaaccggaucggcuacuccugguacaagggggagcgcgucgacggcaacagccucaucgugggguacgugaucggcacgcagcaggccacccccggccccgccuacuccgggcgggagaccaucuaccccaacgcgagccugcugauccagaacgucacccagaacgacacgggcuucuacacccuccaggugaucaaguccgaccuggugaacgaggaggccaccgggcaguuccacgucuaccccgagcugccgaagcccagcaucuccagcaacaacuccaaccccguggaggacaaggacgccguggccuucacgugcgagcccgagguccagaacaccaccuaccucuggugggugaacggccagagccugccggugagcccccgccugcagcucuccaacgggaacaugacccugacccugcucuccgucaagcggaacgacgcgggcagcuacgagugcgagauccagaaccccgccuccgccaaccgcagcgaccccgugacgcugaacgugcuguacggcccggacgggcccaccaucucccccagcaaggccaacuaccggcccggcgagaaccucaaccugagcugccacgccgcguccaacccgcccgcccaguacagcugguucaucaacgggaccuuccagcaguccacccaggagcuguucauccccaacaucacggucaacaacagcggcuccuacaugugccaggcccacaacagcgccaccggccucaaccgcaccaccgugacgaugaucaccguguccgggagcgcccccguccuguccgcgguggccaccgugggcaucaccaucgggguccuggcccggguggcccucaucuga

SEQ ID NO: 1066 - RNA, 1035 nt, Artificial Sequence
  derived and/or modified sequence opt2 from CEAM6__Homo_sapiens__AAA51739
augggcccccccuccgccccccccugccgccuccacguccccuggaaggagguccuccucaccgccucccuccucaccuucuggaacccccccaccaccgccaagcucaccaucgaguccacccccuucaacgucgccgagggcaaggagguccuccuccucgcccacaaccucccccagaaccgcaucggcuacuccugguacaagggcgagcgcgucgacggcaacucccucaucgucggcuacgucaucggcacccagcaggccacccccggccccgccuacuccggccgcgagaccaucuaccccaacgccucccuccucauccagaacgucacccagaacgacaccggcuucuacacccuccaggucaucaaguccgaccucgucaacgaggaggccaccggccaguuccacgucuaccccgagcuccccaagcccuccaucuccuccaacaacuccaaccccgucgaggacaaggacgccgucgccuucaccugcgagcccgagguccagaacaccaccuaccucuggugggucaacggccagucccuccccgucuccccccgccuccagcucuccaacggcaacaugacccucacccuccucuccgucaagcgcaacgacgccggcuccuacgagugcgagauccagaaccccgccuccgccaaccgcuccgaccccgucacccucaacguccucuacggccccgacggccccaccaucucccccuccaaggccaacuaccgccccggcgagaaccucaaccucuccugccacgccgccuccaacccccccgcccaguacuccugguucaucaacggcaccuuccagcaguccacccaggagcucuucauccccaacaucaccgucaacaacuccggcuccuacaugugccaggcccacaacuccgccaccggccucaaccgcaccaccgucaccaugaucaccgucuccggcuccgcccccguccucuccgccgucgccaccgucggcaucaccaucggcguccucgcccgcgucgcccucaucuga

SEQ ID NO: 1067 - RNA, 1035 nt, Artificial Sequence
  derived and/or modified sequence opt3 from CEAM6__Homo_sapiens__AAA51739
auggggcccccuagcgccccaccgugcagacugcacgugcccuggaaggagguccuccuuaccgcuucccuguugacauucuggaacccuccaacuacggcaaaauuaaccaucgaaucuacacccuuuaauguugccgagggcaaggaagugcugcuacucgcgcauaaccugccucagaauaggauuggauacucaugguauaaaggugagcggguagacggcaacagucuuauagugggguacgucaucggaacucaacaggcuaccccaggccccgccuauagcggucgcgaaacaauuuacccuaaugcaucccuguugauccagaacgugacccagaaugauacuggguucuauacacuccaaguuauuaagucugaccuggugaacgaggaggccaccggacaguuucacgucuacccagaacugccgaaacccucgaucucaagcaauaacaguaauccuguggaggauaaggacgcuguagcauucacgugugaaccagagguucagaacacuaccuaucucuggugggugaauggccaguccuuacccgucucuccucgacugcaacuuagcaacggcaauaugacauugacucugcuauccgugaagcguaacgaugccgggucauacgagugcgaaauacagaacccagcuagugccaauagaagcgaccccgugacccucaacguccuguacggaccggaugguccuacaaucucucccuccaaagcgaauuauaggccaggcgagaaccuuaaucugucaugucaugcagccagcaacccucccgcucaguacaguugguuuauuaaugggaccuuccagcaaucuacgcaggaauuguuuaucccaaacauuacuguuaauaacuccggaagcuauaugugccaggcccacaauucggcaacaggccucaaccggaccacugugacaaugaucaccguaucugguuccgcucccgugcugucagccgucgcgacgguggggauaaccauuggaguuuuagcccgcguggcacugaucuga

SEQ ID NO: 1068 - RNA, 1035 nt, Artificial Sequence
  derived and/or modified sequence opt4 from CEAM6__Homo_sapiens__AAA51739
augggcccccccagcgccccccccugcagacugcacgugcccuggaaggaggugcugcugaccgccagccugcugaccuucuggaacccccccaccaccgccaagcugaccaucgagagcacccccuucaacguggccgagggcaaggaggugcugcugcuggcccacaaccugccccagaacagaaucggcuacagcugguacaagggcgagagaguggacggcaacagccugaucgugggcuacgugaucggcacccagcaggccacccccggccccgccuacagcggcagagagaccaucuaccccaacgccagccugcugauccagaacgugacccagaacgacaccggcuucuacacccugcaggugaucaagagcgaccuggugaacgaggaggccaccggccaguuccacguguaccccgagcugcccaagcccagcaucagcagcaacaacagcaaccccguggaggacaaggacgccguggccuucaccugcgagcccgaggugcagaacaccaccuaccuguggugggugaacggccagagccugcccgugagccccagacugcagcugagcaacggcaacaugacccugacccugcugagcgugaagagaaacgacgccggcagcuacgagugcgagauccagaaccccgccagcgccaacagaagcgaccccgugacccugaacgugcuguacggccccgacggccccaccaucagccccagcaaggccaacuacagacccggcgagaaccugaaccugagcugccacgccgccagcaacccccccgcccaguacagcugguucaucaacggcaccuuccagcagagcacccaggagcuguucauccccaacaucaccgugaacaacagcggcagcuacaugugccaggcccacaacagcgccaccggccugaacagaaccaccgugaccaugaucaccgugagcggcagcgcccccgugcugagcgccguggccaccgugggcaucaccaucggcgugcuggccagaguggcccugaucuga

SEQ ID NO: 1069 - RNA, 1035 nt, Artificial Sequence
  derived and/or modified sequence opt5 from CEAM6__Homo_sapiens__AAA51739
auggggcccccuagcgccccgcccugcagacugcacgugccuuggaaggagguccuccugaccgcuucccuucugacauucuggaaucccccuacgaccgccaaacucacaaucgaaucuacccccuuuaacguugcggagggcaaggaagugcugcuucuggcucauaaccucccucagaaucggauuggauacagcugguauaaaggcgagcgcguggacgggaacucccugaucgucggauacgugauuggcacacaacaggccaccccggggcccgccuauucuggaagagaaacaaucuacccuaaugcuagccugcucauucagaacguuacccagaaugauacgggcuucuauacccugcaagugaucaaguccgaccuugucaacgaggaggccacaggccaguuucacguguaccccgaacugccuaaacccucuaucagcuccaauaacagcaauccgguugaggauaaggacgcuguggccuucaccugugaaccugagguccagaacacaaccuaucucuggugggugaaugggcagucucugcccguguccccucggcuucaacugagcaacggaaauaugacgcucacacugcugucugucaagcgcaacgaugcgggcuccuacgagugcgaaauucagaaccccgccagcgcuaauagaucugaccccguuacccucaacgugcuguacgggccugauggaccgacaaucucccccagcaaagccaauuaucggccuggcgagaaccuuaaucuguccugucaugcugccucuaaucccccugcgcaguacagcugguuuauuaacgggaccuuccagcaauccacccaggaacucuuuauccccaacauuacagugaauaacagcggaucuuauaugugccaggcccacaauuccgcuacgggccugaaccgcaccacagucaccaugaucacagugagcggcucugccccgguucuuagcgcuguggccaccgucgggauuacgaucggagugcuggccagaguugcucucaucuga

SEQ ID NO: 1070 - protein, 390 aa, Artificial Sequence
  CH3L2__Homo_sapiens__Q15782
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 1071 - RNA, 1173 nt, Artificial Sequence
  CH3L2__Homo_sapiens__AAB04533
augggagcaaccaccauggaccagaagucucucugggcagguguaguggucuugcugcuucuccagggaggaucugccuacaaacugguuugcuacuuuaccaacuggucccaggaccggcaggaaccaggaaaauucaccccugagaauauugaccccuuccuaugcucucaucucaucuauucauucgccagcaucgaaaacaacaagguuaucaucaaggacaagagugaagugaugcucuaccagaccaucaacagucucaaaaccaagaaucccaaacugaaaauucucuuguccauuggaggguaccuguuugguuccaaaggguuccacccuaugguggauucuucuacaucacgcuuggaauucauuaacuccauaauccuguuucugaggaaccauaacuuugauggacuggauguaagcuggaucuacccagaucagaaagaaaacacucauuucacugugcugauucaugaguuagcagaagccuuucagaaggacuucacaaaauccaccaaggaaaggcuucucuugacugcgggcguaucugcagggaggcaaaugauugauaacagcuaucaaguugagaaacuggcaaaagaucuggauuucaucaaccuccuguccuuugacuuccaugggucuugggaaaagccccuuaucacuggccacaacagcccucugagcaagggguggcaggacagagggccaagcuccuacuacaauguggaauaugcugugggguacuggauacauaagggaaugccaucagagaagguggucaugggcauccccacauaugggcacuccuucacacuggccucugcagaaaccaccgugggggccccugccucuggcccuggagcugcuggacccaucacagagucuucaggcuuccuggccuauuaugagaucugccaguuccugaaaggagccaagaucacgcggcuccaggaucagcagguucccuacgcagucaaggggaaccagugggugggcuaugaugaugugaagaguauggagaccaagguucaguucuuaaagaauuuaaaccugggaggagccaugaucuggucuauugacauggaugacuucacuggcaaauccugcaaccagggcccuuacccucuuguccaagcagucaagagaagccuuggcucccuguga

SEQ ID NO: 1072 - RNA, 1173 nt, Artificial Sequence
  derived and/or modified sequence opt1 from CH3L2__Homo_sapiens__AAB04533
augggcgccaccaccauggaccagaagucccugugggccgggguggucgugcuccugcugcuccagggcgggagcgcguacaagcuggugugcuacuucacgaacuggagccaggaccgccaggagcccggcaaguucaccccggagaacaucgaccccuuccugugcucccaccucaucuacagcuucgccuccaucgagaacaacaaggucaucaucaaggacaagagcgaggugaugcuguaccagaccaucaacucccugaagaccaagaaccccaagcucaagauccugcugagcaucgggggcuaccucuucggcuccaagggguuccaccccaugguggacagcuccacgagccggcuggaguucaucaacuccaucauccuguuccuccgcaaccacaacuucgacggccuggacgucagcuggaucuacccggaccagaaggagaacacccacuucaccgugcugauccacgagcucgccgaggccuuccagaaggacuucaccaaguccacgaaggagcggcugcugcucaccgccggggugagcgcgggccgccagaugaucgacaacuccuaccaggucgagaagcuggccaaggaccuggacuucaucaaccuccugagcuucgacuuccacggguccugggagaagccccugaucaccggccacaacagcccccucagcaagggcuggcaggaccgggggcccuccagcuacuacaacguggaguacgccgugggcuacuggauccacaaggggaugccguccgagaaggucgugaugggcauccccaccuacggccacagcuucacgcuggccuccgcggagaccaccgugggggcccccgccagcggccccggggccgccggcccgaucaccgaguccagcggguuccuggcguacuacgagaucugccaguuccucaagggcgccaagaucacgcgccugcaggaccagcagguccccuacgccgugaagggcaaccagugggugggguacgacgacgucaaguccauggagaccaaggugcaguuccugaagaaccucaaccugggcggggccaugaucuggagcaucgacauggacgacuucaccggcaaguccugcaaccaggggcccuacccccuggugcaggccgucaagcggagccucggcucccuguga

SEQ ID NO: 1073 - RNA, 1173 nt, Artificial Sequence
  derived and/or modified sequence opt2 from CH3L2__Homo_sapiens__AAB04533
augggcgccaccaccauggaccagaagucccucugggccggcgucgucguccuccuccuccuccagggcggcuccgccuacaagcucgucugcuacuucaccaacuggucccaggaccgccaggagcccggcaaguucacccccgagaacaucgaccccuuccucugcucccaccucaucuacuccuucgccuccaucgagaacaacaaggucaucaucaaggacaaguccgaggucaugcucuaccagaccaucaacucccucaagaccaagaaccccaagcucaagauccuccucuccaucggcggcuaccucuucggcuccaagggcuuccaccccauggucgacuccuccaccucccgccucgaguucaucaacuccaucauccucuuccuccgcaaccacaacuucgacggccucgacgucuccuggaucuaccccgaccagaaggagaacacccacuucaccguccucauccacgagcucgccgaggccuuccagaaggacuucaccaaguccaccaaggagcgccuccuccucaccgccggcgucuccgccggccgccagaugaucgacaacuccuaccaggucgagaagcucgccaaggaccucgacuucaucaaccuccucuccuucgacuuccacggcuccugggagaagccccucaucaccggccacaacuccccccucuccaagggcuggcaggaccgcggccccuccuccuacuacaacgucgaguacgccgucggcuacuggauccacaagggcaugcccuccgagaaggucgucaugggcauccccaccuacggccacuccuucacccucgccuccgccgagaccaccgucggcgcccccgccuccggccccggcgccgccggccccaucaccgaguccuccggcuuccucgccuacuacgagaucugccaguuccucaagggcgccaagaucacccgccuccaggaccagcagguccccuacgccgucaagggcaaccagugggucggcuacgacgacgucaaguccauggagaccaagguccaguuccucaagaaccucaaccucggcggcgccaugaucugguccaucgacauggacgacuucaccggcaaguccugcaaccagggccccuacccccucguccaggccgucaagcgcucccucggcucccucuga

SEQ ID NO: 1074 - RNA, 1173 nt, Artificial Sequence
  derived and/or modified sequence opt3 from CH3L2__Homo_sapiens__AAB04533
augggcgccaccacaauggaccaaaagagccugugggcugggguggucguucuccuucuguugcagggagguuccgcauacaaauuagugugcuauuucacuaacuggucucaggauagacaggagcccggcaaguuuacgccugaaaauaucgacccauuccuguguucacaccuaauuuacaguuuugccagcauagagaacaauaaaguaaucauuaaggauaaauccgaagugaugcucuaucagaccaucaacucucugaagacaaagaauccgaaacuuaagauucuguugucgaucgggggauaccucuucggcucaaaagguuuucaucccauggucgacagcaguacuuccaggcuggaguucauaaacucuaucauucuguuucuccggaaucacaacuucgauggguuagacgugagcuggaucuauccugaucaaaaggaaaauacccauuuuacaguucugauucacgagcuugcggaggcuuuccagaaagacuuuaccaaguccacuaaggaacgcuugcugcuaacagccggagugucagcaggccgacagaugaucgauaacaguuaccaggucgagaaacucgccaaggaccuggauuucauaaaucuucugagcuuugacuuccauggcucuugggaaaaaccauugauuaccgggcacaacuccccacucucaaagggauggcaagaucgugguccuagcaguuauuacaauguggaguacgcuguaggcuauuggauccacaaagggaugccaucugagaagguugugaugggcauucccacguacggacauuccuucacucuggcaagcgccgaaaccacagucggugcuccugccucggggccaggagcggcaggcccgaucacugagucuuccggcuuuuuagccuauuacgaaaucugccaguuccugaaaggggcuaagauuaccagacuccaggaccagcaagugcccuaugccgugaagggaaaccagugggucgguuacgacgauguuaaaucaauggagacaaaggugcaguuucuuaaaaaucugaacuugggcggggcaaugauauggaguaucgacauggaugacuucaccggaaagagcuguaaccaaggcccuuauccccuaguacaggcugugaaaaggucccuggguucucucuga

SEQ ID NO: 1075 - RNA, 1173 nt, Artificial Sequence
  derived and/or modified sequence opt4 from CH3L2__Homo_sapiens__AAB04533
augggcgccaccaccauggaccagaagagccugugggccggcgugguggugcugcugcugcugcagggcggcagcgccuacaagcuggugugcuacuucaccaacuggagccaggacagacaggagcccggcaaguucacccccgagaacaucgaccccuuccugugcagccaccugaucuacagcuucgccagcaucgagaacaacaaggugaucaucaaggacaagagcgaggugaugcuguaccagaccaucaacagccugaagaccaagaaccccaagcugaagauccugcugagcaucggcggcuaccuguucggcagcaagggcuuccaccccaugguggacagcagcaccagcagacuggaguucaucaacagcaucauccuguuccugagaaaccacaacuucgacggccuggacgugagcuggaucuaccccgaccagaaggagaacacccacuucaccgugcugauccacgagcuggccgaggccuuccagaaggacuucaccaagagcaccaaggagagacugcugcugaccgccggcgugagcgccggcagacagaugaucgacaacagcuaccagguggagaagcuggccaaggaccuggacuucaucaaccugcugagcuucgacuuccacggcagcugggagaagccccugaucaccggccacaacagcccccugagcaagggcuggcaggacagaggccccagcagcuacuacaacguggaguacgccgugggcuacuggauccacaagggcaugcccagcgagaagguggugaugggcauccccaccuacggccacagcuucacccuggccagcgccgagaccaccgugggcgcccccgccagcggccccggcgccgccggccccaucaccgagagcagcggcuuccuggccuacuacgagaucugccaguuccugaagggcgccaagaucaccagacugcaggaccagcaggugcccuacgccgugaagggcaaccagugggugggcuacgacgacgugaagagcauggagaccaaggugcaguuccugaagaaccugaaccugggcggcgccaugaucuggagcaucgacauggacgacuucaccggcaagagcugcaaccagggccccuacccccuggugcaggccgugaagagaagccugggcagccuguga

SEQ ID NO: 1076 - RNA, 1173 nt, Artificial Sequence
  derived and/or modified sequence opt5 from CH3L2__Homo_sapiens__AAB04533
augggcgccaccacaauggaccaaaagagccugugggcugggguggucguucuccugcuucugcagggaggcuccgccuacaaacucgugugcuauuucacgaacuggucucaggauagacaggagcccgggaaguuuaccccugaaaauaucgacccguuccuguguagccaccuuauuuacuccuuugcgucuaucgagaacaauaaagugauuaucaaggauaaaagcgaagucaugcuguaucagacaauuaacucccucaagaccaagaaucccaaacugaagauccugcucucuaucggaggcuaccuguucgggagcaaaggauuucauccuaugguggacuccagcacaucucggcuugaguucauuaacuccaucauucuguuucuccgcaaucacaacuucgauggccuggacguuagcuggaucuaucccgaucaaaaggaaaauacccauuuuacagugcuuauucacgagcuggcugaggccuuccagaaagacuuuaccaagucuacgaaggaaagacuccugcugaccgccggcgucuccgcugggcggcagaugaucgauaacagcuaccagguggagaaacucgccaaggaccuggauuucauuaaucuucugucuuuugacuuccauggauccugggaaaaaccucucaucacaggccacaacagcccccuguccaagggguggcaagaucgcggaccuucuagcuauuacaauguugaguacgcugugggcuauuggauccacaaagggaugccguccgagaaggucgugaugggcauucccaccuacggacauagcuucacacuugccucugcggaaaccacggugggcgccccugcuuccgggcccggagccgcuggcccuaucacagagagcucuggguuucuggccuauuacgaaauuugccaguuccucaaaggagcgaagaucaccagacugcaggaccagcaaguccccuaugccguuaagggcaaccagugggugggguacgacgaugugaaaagcauggagacaaagguccaguuucugaaaaaucucaaccugggaggcgcuaugauuugguccaucgacauggaugacuucaccggcaagucuuguaaccaagggccguauccucuugugcaggccguuaaacggagccugggaucccucuga

SEQ ID NO: 1077 - protein, 943 aa, Artificial Sequence
  CLCA2__Homo_sapiens__Q9UQC9
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 1078 - RNA, 2832 nt, Artificial Sequence
  CLCA2__Homo_sapiens__AAD40367
augacccaaaggagcauugcagguccuauuugcaaccugaaguuugugacucuccugguugccuuaaguucagaacucccauuccugggagcuggaguacagcuucaagacaauggguauaauggauugcucauugcaauuaauccucagguaccugagaaucagaaccucaucucaaacauuaaggaaaugauaacugaagcuucauuuuaccuauuuaaugcuaccaagagaagaguauuuuucagaaauauaaagauuuuaauaccugccacauggaaagcuaauaauaacagcaaaauaaaacaagaaucauaugaaaaggcaaaugucauagugacugacugguauggggcacauggagaugauccauacacccuacaauacagaggguguggaaaagagggaaaauacauucauuucacaccuaauuuccuacugaaugauaacuuaacagcuggcuacggaucacgaggccgaguguuuguccaugaaugggcccaccuccguugggguguguucgaugaguauaacaaugacaaaccuuucuacauaaaugggcaaaaucaaauuaaagugacaagguguucaucugacaucacaggcauuuuugugugugaaaaagguccuugcccccaagaaaacuguauuauuaguaagcuuuuuaaagaaggaugcaccuuuaucuacaauagcacccaaaaugcaacugcaucaauaauguucaugcaaaguuuaucuucugugguugaauuuuguaaugcaaguacccacaaccaagaagcaccaaaccuacagaaccagaugugcagccucagaagugcaugggauguaaucacagacucugcugacuuucaccacagcuuucccaugaaugggacugagcuuccaccuccucccacauucucgcuuguacaggcuggugacaaaguggucuguuuagugcuggauguguccagcaagauggcagaggcugacagacuccuucaacuacaacaagccgcagaauuuuauuugaugcagauuguugaaauucauaccuucgugggcauugccaguuucgacagcaaaggagagaucagagcccagcuacaccaaauuaacagcaaugaugaucgaaaguugcugguuucauaucugcccaccacuguaucagcuaaaacagacaucagcauuuguucagggcuuaagaaaggauuugaggugguugaaaaacugaauggaaaagcuuauggcucugugaugauauuagugaccagcggagaugauaagcuucuuggcaauugcuuacccacugugcucagcagugguucaacaauucacuccauugcccuggguucaucugcagccccaaaucuggaggaauuaucacgucuuacaggagguuuaaaguucuuuguuccagauauaucaaacuccaauagcaugauugaugcuuucaguagaauuuccucuggaacuggagacauuuuccagcaacauauucagcuugaaaguacaggugaaaaugucaaaccucaccaucaauugaaaaacacagugacuguggauaauacugugggcaacgacacuauguuucuaguuacguggcaggccagugguccuccugagauuauauuauuugauccugauggacgaaaauacuacacaaauaauuuuaucaccaaucuaacuuuucggacagcuagucuuuggauuccaggaacagcuaagccugggcacuggacuuacacccugaacaauacccaucauucucugcaagcccugaaagugacagugaccucucgcgccuccaacucagcugugcccccagccacuguggaagccuuuguggaaagagacagccuccauuuuccucauccugugaugauuuaugccaaugugaaacagggauuuuaucccauucuuaaugccacugucacugccacaguugagccagagacuggagauccuguuacgcugagacuccuugaugauggagcaggugcugauguuauaaaaaaugauggaauuuacucgagguauuuuuucuccuuugcugcaaaugguagauauagcuugaaagugcaugucaaucacucucccagcauaagcaccccagcccacucuauuccagggagucaugcuauguauguaccagguuacacagcaaacgguaauauucagaugaaugcuccaaggaaaucaguaggcagaaaugaggaggagcgaaaguggggcuuuagccgagucagcucaggaggcuccuuuucagugcugggaguuccagcuggcccccacccugauguguuuccaccaugcaaaauuauugaccuggaagcuguaaaaguagaagaggaauugacccuaucuuggacagcaccuggagaagacuuugaucagggccaggcuacaagcuaugaaauaagaaugaguaaaagucuacagaauauccaagaugacuuuaacaaugcuauuuuaguaaauacaucaaagcgaaauccucagcaagcuggcaucagggagauauuuacguucucaccccagauuuccacgaauggaccugaacaucagccaaauggagaaacacaugaaagccacagaauuuauguugcaauacgagcaauggauaggaacuccuuacagucugcuguaucuaacauugcccaggcgccucuguuuauuccccccaauucugauccuguaccugccagagauuaucuuauauugaaaggaguuuuaacagcaauggguuugauaggaaucauuugccuuauuauaguugugacacaucauacuuuaagcaggaaaaagagagcagacaagaaagagaauggaacaaaauuauuauaa

SEQ ID NO: 1079 - RNA, 2832 nt, Artificial Sequence
  derived and/or modified sequence opt1 from CLCA2__Homo_sapiens__AAD40367
augacccagcgcagcaucgccggccccaucugcaaccugaaguucgugacccuccuggucgcccuguccagcgagcucccguuccugggggcgggcgugcagcugcaggacaacggguacaacggccuccugaucgccaucaacccccaggugcccgagaaccagaaccugaucuccaacaucaaggagaugaucacggaggccagcuucuaccucuucaacgccaccaagcggcgcgucuucuuccggaacaucaagauccugauccccgccaccuggaaggcgaacaacaacuccaagaucaagcaggagagcuacgagaaggccaacgugaucgugaccgacugguacggggcccacggcgacgacccguacacgcugcaguaccgcggcugcgggaaggagggcaaguacauccacuucacccccaacuuccuccugaacgacaaccugaccgccggguacggcucccgggggcgcgucuucgugcacgagugggcgcaccuccgguggggcguguucgacgaguacaacaacgacaagcccuucuacaucaacggccagaaccagaucaaggucacccgcugcagcuccgacaucacggggaucuucgugugcgagaagggccccugcccgcaggagaacugcaucaucagcaagcuguucaaggaggggugcaccuucaucuacaacuccacccagaacgccaccgccagcaucauguucaugcagucccugagcuccguggucgaguucugcaacgccagcacgcacaaccaggaggcccccaaccuccagaaccagaugugcucccugcggagcgcgugggacgugaucaccgacuccgccgacuuccaccacagcuuccccaugaacggcaccgagcugcccccgccgcccaccuucagccucgugcaggccggcgacaaggucgugugccuggugcuggacgucuccagcaagauggccgaggccgaccgccuccugcagcugcagcaggcggccgaguucuaccucaugcagaucguggagauccacacguucguggggaucgccuccuucgacagcaagggcgagauccgggcccagcugcaccagaucaacuccaacgacgaccgcaagcugcucgucagcuaccugcccaccaccguguccgccaagaccgacaucagcaucugcuccgggcugaagaagggcuucgagguggucgagaagcucaacgggaaggcguacggcagcgugaugauccuggucacguccggcgacgacaagcugcucgggaacugccugcccaccgugcugagcuccggcagcaccauccacuccaucgcccucgggagcuccgccgcccccaaccuggaggagcugagccggcucaccggcgggcugaaguucuucgugcccgacaucuccaacagcaacagcaugaucgacgccuucucccgcaucagcuccggcacgggcgacaucuuccagcagcacauccagcuggagagcaccggggagaacgucaagccccaccaccagcucaagaacaccgugaccguggacaacacggucggcaacgacaccauguuccuggugaccuggcaggcguccgggccgcccgagaucauccuguucgaccccgacggccggaaguacuacaccaacaacuucaucacgaaccucaccuuccgcaccgccagccuguggauccccgggaccgccaagccgggccacuggacguacacccugaacaacacccaccacucccugcaggcccucaaggugaccgucaccagccgggcguccaacagcgccgugccgcccgccacgguggaggccuucgucgagcgcgacucccugcacuucccccaccccgugaugaucuacgccaacgugaagcagggcuucuaccccauccugaacgcgaccgucaccgccaccguggagcccgagacgggggacccggugacccuccggcugcuggacgacggcgccggggccgacgucaucaagaacgacggcaucuacagccgcuacuucuucuccuucgccgcgaacggccgguacagccucaaggugcacgugaaccacucccccagcaucuccacccccgcccacagcauccccgggagccacgccauguacgucccgggcuacaccgccaacgggaacauccagaugaacgcgccccgcaaguccgugggccgcaacgaggaggagcggaaguggggguucagccgcguguccagcggcggcuccuucagcguccugggggugcccgccggcccccacccggacguguucccgcccugcaagaucaucgaccuggaggccgucaagguggaggaggagcucacgcuguccuggaccgcccccggggaggacuucgaccagggccaggccaccagcuacgagauccggauguccaagagccugcagaacauccaggacgacuucaacaacgcgauccucgugaacaccuccaagcgcaacccccagcaggccgggauccgggagaucuucacguucagcccccagaucuccaccaacggccccgagcaccagcccaacggcgagacccacgagagccaccgcaucuacgucgccauccgggccauggaccgcaacucccugcagagcgccguguccaacaucgcgcaggccccgcuguucaucccgcccaacagcgaccccgugcccgcccgggacuaccucauccugaaggggguccugaccgccaugggccucaucgggaucaucugccugaucaucguggugacgcaccacacccugucccgcaagaagcgggccgacaagaaggagaacggcaccaagcuccuguga

SEQ ID NO: 1080 - RNA, 2832 nt, Artificial Sequence
  derived and/or modified sequence opt2 from CLCA2__Homo_sapiens__AAD40367
augacccagcgcuccaucgccggccccaucugcaaccucaaguucgucacccuccucgucgcccucuccuccgagcuccccuuccucggcgccggcguccagcuccaggacaacggcuacaacggccuccucaucgccaucaacccccagguccccgagaaccagaaccucaucuccaacaucaaggagaugaucaccgaggccuccuucuaccucuucaacgccaccaagcgccgcgucuucuuccgcaacaucaagauccucauccccgccaccuggaaggccaacaacaacuccaagaucaagcaggaguccuacgagaaggccaacgucaucgucaccgacugguacggcgcccacggcgacgaccccuacacccuccaguaccgcggcugcggcaaggagggcaaguacauccacuucacccccaacuuccuccucaacgacaaccucaccgccggcuacggcucccgcggccgcgucuucguccacgagugggcccaccuccgcuggggcgucuucgacgaguacaacaacgacaagcccuucuacaucaacggccagaaccagaucaaggucacccgcugcuccuccgacaucaccggcaucuucgucugcgagaagggccccugcccccaggagaacugcaucaucuccaagcucuucaaggagggcugcaccuucaucuacaacuccacccagaacgccaccgccuccaucauguucaugcagucccucuccuccgucgucgaguucugcaacgccuccacccacaaccaggaggcccccaaccuccagaaccagaugugcucccuccgcuccgccugggacgucaucaccgacuccgccgacuuccaccacuccuuccccaugaacggcaccgagcucccccccccccccaccuucucccucguccaggccggcgacaaggucgucugccucguccucgacgucuccuccaagauggccgaggccgaccgccuccuccagcuccagcaggccgccgaguucuaccucaugcagaucgucgagauccacaccuucgucggcaucgccuccuucgacuccaagggcgagauccgcgcccagcuccaccagaucaacuccaacgacgaccgcaagcuccucgucuccuaccuccccaccaccgucuccgccaagaccgacaucuccaucugcuccggccucaagaagggcuucgaggucgucgagaagcucaacggcaaggccuacggcuccgucaugauccucgucaccuccggcgacgacaagcuccucggcaacugccuccccaccguccucuccuccggcuccaccauccacuccaucgcccucggcuccuccgccgcccccaaccucgaggagcucucccgccucaccggcggccucaaguucuucguccccgacaucuccaacuccaacuccaugaucgacgccuucucccgcaucuccuccggcaccggcgacaucuuccagcagcacauccagcucgaguccaccggcgagaacgucaagccccaccaccagcucaagaacaccgucaccgucgacaacaccgucggcaacgacaccauguuccucgucaccuggcaggccuccggcccccccgagaucauccucuucgaccccgacggccgcaaguacuacaccaacaacuucaucaccaaccucaccuuccgcaccgccucccucuggauccccggcaccgccaagcccggccacuggaccuacacccucaacaacacccaccacucccuccaggcccucaaggucaccgucaccucccgcgccuccaacuccgccgucccccccgccaccgucgaggccuucgucgagcgcgacucccuccacuucccccaccccgucaugaucuacgccaacgucaagcagggcuucuaccccauccucaacgccaccgucaccgccaccgucgagcccgagaccggcgaccccgucacccuccgccuccucgacgacggcgccggcgccgacgucaucaagaacgacggcaucuacucccgcuacuucuucuccuucgccgccaacggccgcuacucccucaagguccacgucaaccacucccccuccaucuccacccccgcccacuccauccccggcucccacgccauguacguccccggcuacaccgccaacggcaacauccagaugaacgccccccgcaaguccgucggccgcaacgaggaggagcgcaaguggggcuucucccgcgucuccuccggcggcuccuucuccguccucggcguccccgccggcccccaccccgacgucuucccccccugcaagaucaucgaccucgaggccgucaaggucgaggaggagcucacccucuccuggaccgcccccggcgaggacuucgaccagggccaggccaccuccuacgagauccgcauguccaagucccuccagaacauccaggacgacuucaacaacgccauccucgucaacaccuccaagcgcaacccccagcaggccggcauccgcgagaucuucaccuucuccccccagaucuccaccaacggccccgagcaccagcccaacggcgagacccacgagucccaccgcaucuacgucgccauccgcgccauggaccgcaacucccuccaguccgccgucuccaacaucgcccaggccccccucuucaucccccccaacuccgaccccguccccgcccgcgacuaccucauccucaagggcguccucaccgccaugggccucaucggcaucaucugccucaucaucgucgucacccaccacacccucucccgcaagaagcgcgccgacaagaaggagaacggcaccaagcuccucuga

SEQ ID NO: 1081 - RNA, 2832 nt, Artificial Sequence
  derived and/or modified sequence opt3 from CLCA2__Homo_sapiens__AAD40367
augacccagagaagcaucgccggccccauuugcaaccugaaguucgugacacuccuugucgcucuguccucugaguugccauuuuuaggggcaggaguucaacugcaggacaaugguuacaacggccuacucauagccaucaauccucaggugccggaaaaccagaaucugauuucaaacaucaaagagaugauuacugaagcgaguuucuaucuuuuuaaugcuacgaagaggcggguauucuuucgcaacaucaaaauacugauccccgccaccuggaaggcaaauaacaauagcaaaauuaagcaagaguccuacgaaaaggccaacgugaucgucacagauugguauggggcucacggagacgauccuuacacuuugcaguaucgaggcugugguaaagaggggaaguacauucauuucaccccaaauuuucuccugaacgacaaucugacagcaggauauggcucucguggcagaguguucguucacgagugggcccaucucagguggggaguguuugaugaauacaacaacgacaaacccuucuacaucaaugggcagaaccagauaaaggucacccggugcucgucagauauuacugguaucuuugugugugagaaaggcccuugcccacaagaaaauuguauuaucagcaaguuauucaaggaggggugcacauuuaucuauaacaguacccagaaugcuacggccuccauuauguucaugcagucucugagcuccguaguugaguucuguaacgcgucaacucacaaucaggaagcacccaaccuucaaaaucagaugugcaguuugcgcagcgccugggacgugauaaccgauucugcugacuuucaucacuccuucccuaugaacggaacagagcugccaccgcccccuacuuuuagucuaguccaggccggcgauaaaguggugugucucguccuggacguuagcaguaagauggcagaagcugauagacuucugcaauugcagcaggccgcggaguucuaccucaugcagaucguggaaauucacaccuuuguagguaucgccucuuucgacuccaaaggggagauaagggcacaacugcaucagauuaauagcaacgacgaucggaaguuacuggugucguaucucccaacaaccgucucugcuaaaacggacaucuccaucugcucaggacuuaagaaaggcuuugaggugguugaaaagcugaauggcaaggccuacgggagugugaugauuuuggucacuagcggagaugacaaacuacuggguaacugucuccccacagugcuguccucuggcagcaccauccacucaauugcucuugggaguuccgccgcaccuaaucuggaggaauugagccgccucacuggaggccugaaguucuuuguaccagauauaucuaacucaaacaguaugaucgacgccuucagccgaauuuccucugguacaggggauaucuuucagcagcauauccaauuagagucgaccggcgaaaauguuaaaccccaccaccagcugaagaacacggugaccgucgacaauacagugggaaacgauacuauguuccuagucaccuggcaggcuagcggcccgccugagauuauacucuuugaccccgaugggagaaaauauuacacaaauaacuucaucacuaaucugaccuucaggacagcgucccuuuggauuccaggaaccgcaaagccuggucauuggacuuauacguugaacaauacacaccauucacugcaggcccucaaggugaccguuacuucacgggcuucuaacagcgccgugcccccagcaaccguagaggccuuugucgaacgugacucccugcacuucccccauccugugaugaucuacgcuaauguuaaacaaggcuuuuacccaauucuuaacgccacagugaccgcaacugucgagccggaaacaggggaccccgugacgcugcgcuugcucgaugacggagcgggcgcugauguaaucaagaaugacgguauauauucaagauacuucuuuagcuucgccgcaaacgggagguauucucugaaagugcacguuaaucacuccccuaguaucagcaccccagcccauucuauucccggcucccacgcuauguacgucccuggauauacugccaacggcaacauccagaugaaugcaccacggaagucaguggggcgaaacgaggaggaacgcaaauggggauuuaguagagugagcucggguggcuccuucucugucuuagggguucccgcuggaccgcauccugauguguuuccacccugcaagauuaucgaccuggaggccgugaagguagaagaggaacuaacacucagcuggaccgcgccuggcgaggauuucgaccagggucaggccacaucauacgagauaaggaugaguaaaucccugcaaaauauucaggaugacuuuaacaaugcuauccuugucaacacuucuaagcggaauccccagcaagcagggauucgcgaaaucuucaccuuuagcccacagauauccacgaacggcccugagcaccagcccaauggagaaacccacgagucacauagaaucuauguggccauuagggcuauggaucguaacagcuugcagagugccguuucuaauaucgcacaagcgccacuguucauuccgccuaacuccgaccccgugccagcccgggauuaccucauccugaaaggcgucuuaacagcuauggggcugauaggaauuaucugccuuaucauugugguuacucaccauaccuugagccgaaagaaaagagccgacaagaaggaaaauggcacaaaacuccuguga

SEQ ID NO: 1082 - RNA, 2832 nt, Artificial Sequence
  derived and/or modified sequence opt4 from CLCA2__Homo_sapiens__AAD40367
augacccagagaagcaucgccggccccaucugcaaccugaaguucgugacccugcugguggcccugagcagcgagcugcccuuccugggcgccggcgugcagcugcaggacaacggcuacaacggccugcugaucgccaucaacccccaggugcccgagaaccagaaccugaucagcaacaucaaggagaugaucaccgaggccagcuucuaccuguucaacgccaccaagagaagaguguucuucagaaacaucaagauccugauccccgccaccuggaaggccaacaacaacagcaagaucaagcaggagagcuacgagaaggccaacgugaucgugaccgacugguacggcgcccacggcgacgaccccuacacccugcaguacagaggcugcggcaaggagggcaaguacauccacuucacccccaacuuccugcugaacgacaaccugaccgccggcuacggcagcagaggcagaguguucgugcacgagugggcccaccugagauggggcguguucgacgaguacaacaacgacaagcccuucuacaucaacggccagaaccagaucaaggugaccagaugcagcagcgacaucaccggcaucuucgugugcgagaagggccccugcccccaggagaacugcaucaucagcaagcuguucaaggagggcugcaccuucaucuacaacagcacccagaacgccaccgccagcaucauguucaugcagagccugagcagcgugguggaguucugcaacgccagcacccacaaccaggaggcccccaaccugcagaaccagaugugcagccugagaagcgccugggacgugaucaccgacagcgccgacuuccaccacagcuuccccaugaacggcaccgagcugccccccccccccaccuucagccuggugcaggccggcgacaagguggugugccuggugcuggacgugagcagcaagauggccgaggccgacagacugcugcagcugcagcaggccgccgaguucuaccugaugcagaucguggagauccacaccuucgugggcaucgccagcuucgacagcaagggcgagaucagagcccagcugcaccagaucaacagcaacgacgacagaaagcugcuggugagcuaccugcccaccaccgugagcgccaagaccgacaucagcaucugcagcggccugaagaagggcuucgaggugguggagaagcugaacggcaaggccuacggcagcgugaugauccuggugaccagcggcgacgacaagcugcugggcaacugccugcccaccgugcugagcagcggcagcaccauccacagcaucgcccugggcagcagcgccgcccccaaccuggaggagcugagcagacugaccggcggccugaaguucuucgugcccgacaucagcaacagcaacagcaugaucgacgccuucagcagaaucagcagcggcaccggcgacaucuuccagcagcacauccagcuggagagcaccggcgagaacgugaagccccaccaccagcugaagaacaccgugaccguggacaacaccgugggcaacgacaccauguuccuggugaccuggcaggccagcggcccccccgagaucauccuguucgaccccgacggcagaaaguacuacaccaacaacuucaucaccaaccugaccuucagaaccgccagccuguggauccccggcaccgccaagcccggccacuggaccuacacccugaacaacacccaccacagccugcaggcccugaaggugaccgugaccagcagagccagcaacagcgccgugccccccgccaccguggaggccuucguggagagagacagccugcacuucccccaccccgugaugaucuacgccaacgugaagcagggcuucuaccccauccugaacgccaccgugaccgccaccguggagcccgagaccggcgaccccgugacccugagacugcuggacgacggcgccggcgccgacgugaucaagaacgacggcaucuacagcagauacuucuucagcuucgccgccaacggcagauacagccugaaggugcacgugaaccacagccccagcaucagcacccccgcccacagcauccccggcagccacgccauguacgugcccggcuacaccgccaacggcaacauccagaugaacgcccccagaaagagcgugggcagaaacgaggaggagagaaaguggggcuucagcagagugagcagcggcggcagcuucagcgugcugggcgugcccgccggcccccaccccgacguguucccccccugcaagaucaucgaccuggaggccgugaagguggaggaggagcugacccugagcuggaccgcccccggcgaggacuucgaccagggccaggccaccagcuacgagaucagaaugagcaagagccugcagaacauccaggacgacuucaacaacgccauccuggugaacaccagcaagagaaacccccagcaggccggcaucagagagaucuucaccuucagcccccagaucagcaccaacggccccgagcaccagcccaacggcgagacccacgagagccacagaaucuacguggccaucagagccauggacagaaacagccugcagagcgccgugagcaacaucgcccaggccccccuguucaucccccccaacagcgaccccgugcccgccagagacuaccugauccugaagggcgugcugaccgccaugggccugaucggcaucaucugccugaucaucguggugacccaccacacccugagcagaaagaagagagccgacaagaaggagaacggcaccaagcugcuguga

SEQ ID NO: 1083 - RNA, 2832 nt, Artificial Sequence
  derived and/or modified sequence opt5 from CLCA2__Homo_sapiens__AAD40367
augacccagagaagcaucgccggccccauuugcaaccugaaguucgugacacuccuggucgcucuuuccucugagcugccuuuucucggggccggaguucaacugcaggacaauggcuacaacgggcuucugaucgcgauuaauccccaggugcccgaaaaccagaaucucaucagcaacauuaaagagaugaucacggaagcuagcuucuaucuguuuaaugccaccaagcggcgcguguucuuuagaaacaucaaaauucugaucccugccacauggaaggcuaauaacaauucuaaaauuaagcaagagagcuacgaaaaggccaacgucaucgugaccgauugguauggagcucacggcgacgaucccuacacacuccaguaucggggguguggaaaagagggcaaguacauucauuucaccccuaauuuucugcuuaacgacaaucugacagccggcuaugggucccgcggaagaguuuucgugcacgagugggcgcaucuccgguggggcgucuuugaugaauacaacaacgacaaacccuucuacaucaaugggcagaaccagauuaaggugacccgcugcucuagcgauaucacgggaaucuuuguuugugagaaaggcccuugcccgcaagaaaauuguauuaucuccaagcuguucaaggaggggugcaccuuuauuuauaacagcacacagaaugccaccgcuucuaucauguucaugcagucccuuagcucuguggucgaguucuguaacgccuccacacacaaucaggaagcucccaaccugcaaaaucagaugugcagccucagaucugccugggacgugauuaccgauuccgcggacuuucaucacagcuucccuaugaacggaacggagcugcccccucccccgacauuuucccuggugcaggccggcgauaaagucguuugucucgugcuggacgugucuagcaagauggcugaagccgaucggcuucugcaacuccagcaggcugccgaguucuaccugaugcagaucgucgaaauccacaccuuugugggcauugccuccuucgacagcaaaggggagauccgcgcucaacuucaucagauuaauucuaacgacgauagaaagcugcucguuuccuaucugccuacaaccgugagcgcgaaaaccgacaucucuauuugcagcggacugaagaaaggcuuugaggucguggaaaagcucaaugggaaggccuacggauccguuaugauccuggugacaucuggcgaugacaaacuucuggggaacugucuccccacgguccugagcuccggaagcaccauccacucuauugcucuuggcuccagcgccgccccuaaucuggaggaacucucucggcugacaggcgggcugaaguucuuugugcccgauaucuccaacagcaacuccaugauugacgcuuucucucgcaucagcuccggaaccggcgauauuuuucagcagcauauccaacucgagucuacaggggaaaaugucaaaccccaccaccagcugaagaacaccgugacgguugacaauacagugggaaacgauaccauguuccuugucaccuggcaggccagcggcccuccggagauuauccuguuugaccccgaugggagaaaauauuacacaaauaacuucaucaccaaucucacauuccggacggcgucccuguggauuccuggcaccgcuaagcccggacauuggacauauacccugaacaauacacaccauagccuucaggcccucaaggugaccguuacgucucgcgccuccaacagcgcugugccucccgccaccgucgaggcuuuuguggaaagagacucucugcacuucccgcauccugugaugaucuacgccaauguuaaacaaggcuuuuaccccauucugaacgcgacagucaccgccacaguggagccugaaaccggggaccccgugacgcuccggcugcuugaugacggagcuggcgccgaugucaucaagaaugacgggauuuauuccagauacuucuuuagcuucgcugccaacggacgcuauucucugaaagugcacguuaaucacagcccuuccaucagcacacccgcgcauucuaucccgggcucccacgccauguacgugccuggguauaccgcuaacggcaacauucagaugaaugccccgcggaaguccgucggaagaaacgaggaggaacgcaaauggggcuuuucccgggugucuagcgggggauccuucucuguucucggcgugcccgcugggccucauccggaugucuuucccccuugcaagaucauugaccuggaggccgugaagguugaagaggaacugacacuuagcuggaccgcccccggagaggauuucgaccagggccaggcuaccuccuacgagaucagaaugucuaaaagccuccaaaauauucaggaugacuuuaacaaugcgauccuggugaacacauccaagcgcaauccucagcaagccgggauccgggaaauuuucacguuuagcccccagaucucuaccaacggcccugagcaccagcccaauggagaaacacacgagucccauagaauuuaugucgcuauccgcgccauggaucggaacagccugcagucugccguguccaauauugcucaagccccucucuucaucccgcccaacagcgacccugugcccgcgagagauuaccugauccuuaaaggcguccugaccgcuauggggcucauuggaaucauuugccugaucauuguugugacacaccauacccugucucgcaagaaacgggccgacaagaaggaaaauggcacgaaacuucucuga

SEQ ID NO: 1084 - protein, 235 aa, Artificial Sequence
  CML28__Homo_sapiens__Q9NQT4
MEEETHTDAKIRAENGTGSSPRGPGCSLRHFACEQNLLSRPDGSASFLQGDTSVLAGVYGPAEVKVSKEIFNKATLEVILRPKIGLPGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 1085 - RNA, 708 nt, Artificial Sequence
  CML28__Homo_sapiens__AAF82135
auggaggaggagacgcauacugacgccaaaauccgugcugaaaauggaacaggguccagcccucgggguccuggcugcagccuccggcacuuugccugcgaacagaaccugcugucgcggccagauggcucugcuuccuuccugcaaggugacaccucuguccuggcggguguguacgggccggccgaggugaaggucagcaaagagauuuucaacaaggccacacucgaagugauccugaggccgaagauugggcugccugguguugcagagaagagccgggagcggcugaucaggaacacgugcgaggcgguggugcugggcacguugcacccccgcaccuccaucaccguggugcugcagguugucagcgaugccggcucucuccuggccuguugucugaaugccgccugcauggcauugguggaugcaggugugcccaugcgggcucucuucuguggggucgccugcgcccuggacucugaugggacccucgugcuggauccuacauccaagcaagaaaaggaggcccgggcaguccugaccuuugcccuggacagcguggaacggaagcugcugauguccagcaccaaggggcucuacucagacacugagcuccagcagugccuggcugcggcccaggccgcuucgcaacacgucuuccguuucuaccgggaaucgcugcagaggcguuacuccaagagcuga

SEQ ID NO: 1086 - RNA, 708 nt, Artificial Sequence
  derived and/or modified sequence opt1 from CML28__Homo_sapiens__AAF82135
auggaggaggagacccacaccgacgccaagauccgcgccgagaacggcacggggagcagcccccggggcccggggugcagccugcgccacuucgcgugcgagcagaaccuccugucccggcccgacggcagcgccuccuuccugcagggggacaccagcgugcucgccggcgucuacggccccgccgaggugaagguguccaaggagaucuucaacaaggccacccuggaggucauccugcgccccaagaucgggcucccgggcguggcggagaagucccgggagcgccugauccggaacacgugcgaggccgugguccuggggacccuccacccccgcaccuccaucaccguggugcugcaggucgugagcgacgccggcucccugcucgccugcugccugaacgcggccugcauggcccugguggacgccgggguccccaugcgggcccucuucugcggcguggcgugcgcccuggacagcgacggcacccuggugcucgaccccacguccaagcaggagaaggaggcccgcgccguccugaccuucgcccuggacagcguggagcggaagcuccugauguccagcaccaaggggcuguacuccgacaccgagcuccagcagugccuggcggccgcccaggccgccagccagcacguguuccgcuucuaccgggagucccugcagcgccgguacagcaagagcuga

SEQ ID NO: 1087 - RNA, 708 nt, Artificial Sequence
  derived and/or modified sequence opt2 from CML28__Homo_sapiens__AAF82135
auggaggaggagacccacaccgacgccaagauccgcgccgagaacggcaccggcuccuccccccgcggccccggcugcucccuccgccacuucgccugcgagcagaaccuccucucccgccccgacggcuccgccuccuuccuccagggcgacaccuccguccucgccggcgucuacggccccgccgaggucaaggucuccaaggagaucuucaacaaggccacccucgaggucauccuccgccccaagaucggccuccccggcgucgccgagaagucccgcgagcgccucauccgcaacaccugcgaggccgucguccucggcacccuccacccccgcaccuccaucaccgucguccuccaggucgucuccgacgccggcucccuccucgccugcugccucaacgccgccugcauggcccucgucgacgccggcguccccaugcgcgcccucuucugcggcgucgccugcgcccucgacuccgacggcacccucguccucgaccccaccuccaagcaggagaaggaggcccgcgccguccucaccuucgcccucgacuccgucgagcgcaagcuccucauguccuccaccaagggccucuacuccgacaccgagcuccagcagugccucgccgccgcccaggccgccucccagcacgucuuccgcuucuaccgcgagucccuccagcgccgcuacuccaaguccuga

SEQ ID NO: 1088 - RNA, 708 nt, Artificial Sequence
  derived and/or modified sequence opt3 from CML28__Homo_sapiens__AAF82135
auggaggaagagacccacacagacgccaagaucagagcugaaaacggcacugggagcucccccaggggaccugguugcucucugcggcauuucgcaugugagcagaaucuccuuucacgcccagauggcagugccagcuuucugcaaggggacacguccguguuggcgggagucuacggcccggcugaaguuaaagugucuaaggagauuuucaacaaagccaccuuagagguaauacugcgacccaagaucggucuaccugggguggcagaaaaaucgcgugagagacucauuaggaauacaugcgaagccgucgugcugggaacucuucacccacggaccucaaucacaguugugcugcaggucgugagcgaugcuggcaguuugcucgcauguugccugaacgccgcuuguauggcccugguagacgcgggcguucccaugcgcgcacucuuuugcgggguggccugugcuuuagauuccgacggaacccugguccuugauccuacuucuaagcaggagaaggaggccagagcaguguugacauucgcucuggacagcguggaaaggaaacuacucauguccucaaccaagggucuguauagugauacggagcuucagcaaugccuggccgcggcccaggcagcuagccagcaugucuuucgguucuaccgcgaaucuuugcagcgaagauauuccaaaucauga

SEQ ID NO: 1089 - RNA, 708 nt, Artificial Sequence
  derived and/or modified sequence opt4 from CML28__Homo_sapiens__AAF82135
auggaggaggagacccacaccgacgccaagaucagagccgagaacggcaccggcagcagccccagaggccccggcugcagccugagacacuucgccugcgagcagaaccugcugagcagacccgacggcagcgccagcuuccugcagggcgacaccagcgugcuggccggcguguacggccccgccgaggugaaggugagcaaggagaucuucaacaaggccacccuggaggugauccugagacccaagaucggccugcccggcguggccgagaagagcagagagagacugaucagaaacaccugcgaggccguggugcugggcacccugcaccccagaaccagcaucaccguggugcugcagguggugagcgacgccggcagccugcuggccugcugccugaacgccgccugcauggcccugguggacgccggcgugcccaugagagcccuguucugcggcguggccugcgcccuggacagcgacggcacccuggugcuggaccccaccagcaagcaggagaaggaggccagagccgugcugaccuucgcccuggacagcguggagagaaagcugcugaugagcagcaccaagggccuguacagcgacaccgagcugcagcagugccuggccgccgcccaggccgccagccagcacguguucagauucuacagagagagccugcagagaagauacagcaagagcuga

SEQ ID NO: 1090 - RNA, 708 nt, Artificial Sequence
  derived and/or modified sequence opt5 from CML28__Homo_sapiens__AAF82135
auggaggaagagacccacacagacgccaagaucagagcugaaaacggcacggggagcucuccccggggaccuggcugcucccugcgccauuucgccugugagcagaaucuccugagcagaccggauggguccgcgucuuuucuucaaggagacaccagcgugcuggcuggcgucuacgggcccgccgaaguuaaaguguccaaggagauuuucaacaaagccacacucgaggugauccugcggccuaagauuggacuucccggcgucgcugaaaaaucucgcgagagacugauccggaauaccugcgaagccgugguucucggcacacugcacccucgcaccagcauuacagugguccuccaggugguuuccgaugcugggagccugcuggccuguugccuuaacgcggccuguauggcucugguggacgccggaguccccaugagagcucucuuuugcggcguggccugugcgcuggauucugacgggacccuugugcuggauccuacguccaagcaggagaaggaggcccgggcuguccucaccuucgcccuggacagcguugaacgcaaacugcucaugucuuccacaaagggacuguauagcgauaccgagcuucagcaaugccuggcugccgcccaggcugcgucucagcauguguuuagauucuaccgggaaucccuccagcgcagauauagcaaauccuga

SEQ ID NO: 1091 - protein, 583 aa, Artificial Sequence
  CML66__Homo_sapiens__Q96RS6
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSLTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 1092 - RNA, 1752 nt, Artificial Sequence
  CML66__Homo_sapiens__CCDS6312.1
auggagguggcggcuaauugcucccuacgggugaagagaccucuguuggauccccgcuucgaggguuacaagcucucucuugagccgcugccuuguuaccagcuggagcuugacgcagcuguggcagagguaaaacuucgagaugaucaauauacacuggaacacaugcaugcuuuuggaauguauaauuaccugcacugugauucaugguaucaagacagugucuacuauauugauacccuuggaagaauuaugaauuuaacaguaaugcuggacacugccuuaggaaaaccacgagagguguuucgacuuccuacagauuugacagcaugugacaaccgucuuugugcaucuauccauuucucaucuucuaccuggguuaccuugucagauggaacuggaagauuguaugucauuggaacaggugaacguggaaauagcgcuucugaaaaaugggagauuauguuuaaugaagaacuuggggauccuuuuauuauaauucacaguaucucacugcuaaaugcugaagaacauucuauagcuacccuacuucuucgaauagagaaagaggaauuggauaugaaaggaagugguuucuauguuucucuggagugggucacuaucaguaagaaaaaucaagauaauaaaaaauaugaaauuauuaagcgugauauucuccguggaaagucagugccacauuaugcugcuauugagccugauggaaauggucuaaugauuguauccuacaagucuuuaacauuuguucaggcuggucaagaucuugaagaaaauauggaugaagacauaucagagaaaaucaaagaaccucuguauuacuggcaacagacugaagaugauuugacaguaaccauacggcuuccagaagacaguacuaaggaggacauucaaauacaguuuuugccugaucacaucaacauuguacugaaggaucaccaguuuuuagaaggaaaacucuauucaucuauugaucaugaaagcaguacauggauaauuaaagagaguaauagcuuggagauuuccuugauuaagaagaaugaaggacugaccuggccagagcuaguaauuggagauaaacaaggggaacuuauaagagauucagcccagugugcugcaauagcugaacguuugaugcauuugaccucugaagaacugaauccaaauccagauaaagaaaaaccaccuugcaaugcucaagaguuagaagaaugugauauuuucuuugaagagagcuccaguuuaugcagauuugauggcaauacauuaaaaacuacucauguggugaaucuuggaagcaaccaguaccuuuucucugucauaguggauccuaaagaaaugcccugcuucuguuugcgccaugauguugaugcccuacucuggcaaccacacuccagcaaacaagaugauaugugggagcacaucgcaacuuucaaugcuuuaggcuauguccaagcaucaaagagagacaaaaaauuuuuugccugugcuccaaauuacucguaugcagcccuuugugagugccuucgucgaguauucaucuaucgucagccugcucccauguccacuguacuuuacaacagaaaggaaggcaggcaaguaggacagguugcuaagcagcaaguagcaagccuagaaaccaaugauccuauuuuaggauuucaggcaacaaaugagagauuauuuguucuuacuaccaaaaaccucuuuuuaauaaaaguaaauacagagaauuaa

SEQ ID NO: 1093 - RNA, 1752 nt, Artificial Sequence
  derived and/or modified sequence opt1 from CML66__Homo_sapiens__CCDS6312.1
auggagguggccgccaacugcagccugcgcgucaagcggccccuccuggacccgcgcuucgagggcuacaagcugucccucgagccccugcccugcuaccagcuggagcucgacgcggccguggccgaggugaagcugcgggacgaccaguacacccuggagcacaugcacgccuucgggauguacaacuaccuccacugcgacagcugguaccaggacuccgucuacuacaucgacacccugggccgcaucaugaaccugacggugaugcucgacaccgcccuggggaagccccgggagguguuccgccugccgaccgaccucaccgcgugcgacaaccggcugugcgccagcauccacuucuccagcuccacgugggucacccugagcgacggcaccgggcgccucuacgugaucggcaccggcgagcgggggaacuccgccagcgagaagugggagaucauguucaacgaggagcugggcgaccccuucaucaucauccacuccaucagccugcucaacgccgaggagcacuccaucgcgacgcugcugcuccgcaucgagaaggaggagcuggacaugaaggggagcggcuucuacgugucccuggagugggucaccaucagcaagaagaaccaggacaacaagaaguacgagaucaucaagcgggacauccuccgcgggaaguccgugccccacuacgccgccaucgagcccgacggcaacggccugaugaucgugagcuacaagucccugaccuucguccaggccgggcaggaccucgaggagaacauggacgaggacaucagcgagaagaucaaggagccgcuguacuacuggcagcagaccgaggacgaccugacggugaccauccggcuccccgaggacagcaccaaggaggacauccagauccaguuccugcccgaccacaucaacaucgugcugaaggaccaccaguuccucgagggcaagcuguacuccagcaucgaccacgaguccagcaccuggaucaucaaggaguccaacagccuggagaucucccucaucaagaagaacgaggggcugacguggcccgagcuggucaucggcgacaagcagggcgagcucauccgcgacagcgcccagugcgcggccaucgccgagcggcugaugcaccugaccuccgaggagcucaacccgaaccccgacaaggagaagccgcccugcaacgcccaggagcuggaggagugcgacaucuucuucgaggagagcuccagccugugccgcuucgacgggaacacccucaagaccacgcacguggugaaccugggcuccaaccaguaccuguucagcgucaucguggaccccaaggagaugcccugcuucugccugcggcacgacguggacgcccuccuguggcagccccacuccagcaagcaggacgacaugugggagcacaucgcgaccuucaacgcccugggguacguccaggccuccaagcgcgacaagaaguucuucgccugcgcccccaacuacagcuacgcggcccucugcgagugccugcggcgcguguucaucuaccggcagccggcccccauguccaccgugcuguacaaccgcaaggagggccgccaggucggccagguggccaagcagcaggucgccagccucgagaccaacgaccccauccugggguuccaggcgacgaacgagcggcuguucgugcucaccaccaagaaccuguuccugaucaaggugaacaccgagaacuga

SEQ ID NO: 1094 - RNA, 1752 nt, Artificial Sequence
  derived and/or modified sequence opt2 from CML66__Homo_sapiens__CCDS6312.1
auggaggucgccgccaacugcucccuccgcgucaagcgcccccuccucgacccccgcuucgagggcuacaagcucucccucgagccccuccccugcuaccagcucgagcucgacgccgccgucgccgaggucaagcuccgcgacgaccaguacacccucgagcacaugcacgccuucggcauguacaacuaccuccacugcgacuccugguaccaggacuccgucuacuacaucgacacccucggccgcaucaugaaccucaccgucaugcucgacaccgcccucggcaagccccgcgaggucuuccgccuccccaccgaccucaccgccugcgacaaccgccucugcgccuccauccacuucuccuccuccaccugggucacccucuccgacggcaccggccgccucuacgucaucggcaccggcgagcgcggcaacuccgccuccgagaagugggagaucauguucaacgaggagcucggcgaccccuucaucaucauccacuccaucucccuccucaacgccgaggagcacuccaucgccacccuccuccuccgcaucgagaaggaggagcucgacaugaagggcuccggcuucuacgucucccucgagugggucaccaucuccaagaagaaccaggacaacaagaaguacgagaucaucaagcgcgacauccuccgcggcaaguccgucccccacuacgccgccaucgagcccgacggcaacggccucaugaucgucuccuacaagucccucaccuucguccaggccggccaggaccucgaggagaacauggacgaggacaucuccgagaagaucaaggagccccucuacuacuggcagcagaccgaggacgaccucaccgucaccauccgccuccccgaggacuccaccaaggaggacauccagauccaguuccuccccgaccacaucaacaucguccucaaggaccaccaguuccucgagggcaagcucuacuccuccaucgaccacgaguccuccaccuggaucaucaaggaguccaacucccucgagaucucccucaucaagaagaacgagggccucaccuggcccgagcucgucaucggcgacaagcagggcgagcucauccgcgacuccgcccagugcgccgccaucgccgagcgccucaugcaccucaccuccgaggagcucaaccccaaccccgacaaggagaagccccccugcaacgcccaggagcucgaggagugcgacaucuucuucgaggaguccuccucccucugccgcuucgacggcaacacccucaagaccacccacgucgucaaccucggcuccaaccaguaccucuucuccgucaucgucgaccccaaggagaugcccugcuucugccuccgccacgacgucgacgcccuccucuggcagccccacuccuccaagcaggacgacaugugggagcacaucgccaccuucaacgcccucggcuacguccaggccuccaagcgcgacaagaaguucuucgccugcgcccccaacuacuccuacgccgcccucugcgagugccuccgccgcgucuucaucuaccgccagcccgcccccauguccaccguccucuacaaccgcaaggagggccgccaggucggccaggucgccaagcagcaggucgccucccucgagaccaacgaccccauccucggcuuccaggccaccaacgagcgccucuucguccucaccaccaagaaccucuuccucaucaaggucaacaccgagaacuga

SEQ ID NO: 1095 - RNA, 1752 nt, Artificial Sequence
  derived and/or modified sequence opt3 from CML66__Homo_sapiens__CCDS6312.1
auggagguggccgcuaacugcagccugagagucaagaggccccuccuugacccucgguucgaaggcuacaaacuguccuuggagccauuaccguguuaucagcuggaacuagaugcagccguugcggaggugaagcuccgcgacgaucaauacacccuggaacacaugcaugcuuuugggauguauaauuaccuucacugcgacucuugguaucaggauucaguauacuauaucgacacacugggacgaauuaugaacuugacugugaugcucgauacggcccuggguaaaccccgugaggucuucagacugccuaccgaccucacagcaugugauaauagguuaugcgccaguauacauuuuagcuccucuacuugggugacccugucggacggcacagggcggcuuuacguuaucggaaccggcgagcgcgguaacucagcuagcgaaaagugggagauuauguucaaugaagaguugggggauccauuuaucauuauccacaguauaucccugcuaaacgcagaggaacauucuaucgccacucuccugcuuagaauugagaaagaagaacuggacaugaagggaagcggcuucuacguguccuuggaaugggucacaaucucaaagaaaaaucaggauaacaagaaauaugagauuaucaagagggacauacuccggggcaaaagugugccccacuacgcugccauugagccugacgggaauggacugaugaucguaagcuauaagucuuuaaccuuuguucaggcgggucaagaucuggaagagaacauggacgaagauauuuccgagaagaucaaagaaccacucuacuauuggcagcagacggaggacgaucuuacugugaccauccgccugcccgaggacucaacaaaggaagauauucagauacaauucuugccugaccacaucaauauuguccuaaaagaucaucaguuucuggagggcaagcucuacagcaguaucgaccacgaaucuuccacuuggauaauuaaagagagcaacucgcuggaaaucucucuuaucaagaaaaaugaggggcugaccuggccagaguuggugauuggagauaagcagggcgaacucauccgagacuccgcacagugugccgcuauugccgagagacugaugcauuuaacaucagaggagcugaacccgaaucccgacaaggagaaaccuccaugcaacgcacaagaacuagaggaaugugauauauucuuugaggaaaguagcucccucugcagguucgacgguaacacccugaagacgacucacguggucaaucuugggucuaaccaguauuuguuuagcguuaucguggaucccaaagagaugccuuguuucugccugcggcacgacguagaugcucuccuguggcagccacauucaaguaagcaagacgauaugugggagcacauugccacauucaaugcgcuuggauacgugcaggccuccaaacgugacaagaaguuuuucgcaugugcucccaacuacagcuaugccgcucugugcgaaugcuugcgcagagucuuuaucuacaggcagccggccccuaugucuaccgugcucuauaaucggaaagagggccgacagguuggccaaguggcaaagcagcaggucgccucacuggaaacuaacgaucccaucuuaggguuccaggcuacaaaugagcgccuguuugugcuaaccacgaaaaaccucuuccugauuaagguaaauaccgaaaacuga

SEQ ID NO: 1096 - RNA, 1752 nt, Artificial Sequence
  derived and/or modified sequence opt4 from CML66__Homo_sapiens__CCDS6312.1
auggagguggccgccaacugcagccugagagugaagagaccccugcuggaccccagauucgagggcuacaagcugagccuggagccccugcccugcuaccagcuggagcuggacgccgccguggccgaggugaagcugagagacgaccaguacacccuggagcacaugcacgccuucggcauguacaacuaccugcacugcgacagcugguaccaggacagcguguacuacaucgacacccugggcagaaucaugaaccugaccgugaugcuggacaccgcccugggcaagcccagagagguguucagacugcccaccgaccugaccgccugcgacaacagacugugcgccagcauccacuucagcagcagcaccugggugacccugagcgacggcaccggcagacuguacgugaucggcaccggcgagagaggcaacagcgccagcgagaagugggagaucauguucaacgaggagcugggcgaccccuucaucaucauccacagcaucagccugcugaacgccgaggagcacagcaucgccacccugcugcugagaaucgagaaggaggagcuggacaugaagggcagcggcuucuacgugagccuggagugggugaccaucagcaagaagaaccaggacaacaagaaguacgagaucaucaagagagacauccugagaggcaagagcgugccccacuacgccgccaucgagcccgacggcaacggccugaugaucgugagcuacaagagccugaccuucgugcaggccggccaggaccuggaggagaacauggacgaggacaucagcgagaagaucaaggagccccuguacuacuggcagcagaccgaggacgaccugaccgugaccaucagacugcccgaggacagcaccaaggaggacauccagauccaguuccugcccgaccacaucaacaucgugcugaaggaccaccaguuccuggagggcaagcuguacagcagcaucgaccacgagagcagcaccuggaucaucaaggagagcaacagccuggagaucagccugaucaagaagaacgagggccugaccuggcccgagcuggugaucggcgacaagcagggcgagcugaucagagacagcgcccagugcgccgccaucgccgagagacugaugcaccugaccagcgaggagcugaaccccaaccccgacaaggagaagccccccugcaacgcccaggagcuggaggagugcgacaucuucuucgaggagagcagcagccugugcagauucgacggcaacacccugaagaccacccacguggugaaccugggcagcaaccaguaccuguucagcgugaucguggaccccaaggagaugcccugcuucugccugagacacgacguggacgcccugcuguggcagccccacagcagcaagcaggacgacaugugggagcacaucgccaccuucaacgcccugggcuacgugcaggccagcaagagagacaagaaguucuucgccugcgcccccaacuacagcuacgccgcccugugcgagugccugagaagaguguucaucuacagacagcccgcccccaugagcaccgugcuguacaacagaaaggagggcagacaggugggccagguggccaagcagcagguggccagccuggagaccaacgaccccauccugggcuuccaggccaccaacgagagacuguucgugcugaccaccaagaaccuguuccugaucaaggugaacaccgagaacuga

SEQ ID NO: 1097 - RNA, 1752 nt, Artificial Sequence
  derived and/or modified sequence opt5 from CML66__Homo_sapiens__CCDS6312.1
auggagguggccgcuaacugcagccugagagucaagcggccccuccuggacccucgcuucgaaggcuacaaacuuucccuggagccgcuccccuguuaucagcuggaacuugaugccgcgguugcugaggugaagcugagagacgaucaguacacccucgaacacaugcaugccuuugggauguauaauuaccugcacugcgacucuugguaucaggauagcguguacuauaucgacacacugggacggauuaugaaccucacggucaugcuggauaccgcccuuggcaaaccucgcgagguguucagacugcccacagaccucaccgcuugugauaaucggcugugcgccuccauccauuuuucuagcuccacauggguuacccuuucugacgggacaggacgccuguacgugauuggcaccggggagagaggaaacagcgcuuccgaaaagugggagaucauguucaaugaagaacucggcgauccuuuuauuaucauccacagcauuucucugcugaacgccgaggaacauuccaucgcgacgcuccugcuucggauugagaaagaggagcuggacaugaagggcagcggguucuacgucucucucgaaugggugaccaucuccaagaaaaaucaggauaacaagaaauaugagauuaucaagcgcgacauucugagaggaaaaagcguuccccacuacgccgcuaucgagccugacggcaaugggcuuaugaucgugucuuauaagucccugacauuuguccaggccggacaagaucucgaagagaacauggacgaagauauuagcgagaagaucaaagaaccgcuguacuauuggcagcagaccgaggacgaucugacagugaccauucggcuccccgaggacuccacgaaggaagauauccagauucaauuccugccugaccacaucaauaucgugcuuaaagaucaucaguuucuggagggcaagcucuacucuagcauugaccacgaauccagcacauggaucauuaaagagucuaacucccuggaaaucagccuuauuaagaaaaaugaggggcugaccuggcccgagcucgucaucggagauaagcagggcgaacugauccgcgacucugcucagugugccgcgauugccgagagacugaugcaucucacaagcgaggaacugaacccuaaucccgacaaggagaaaccgccuugcaacgcucaagaacuugaggaaugugauaucuucuuugaggaauccucuagccugugccgguucgacggcaacacccucaagaccacacacguugugaaucugggguccaaccaguaucuguuuagcgugauugucgaucccaaagagaugccuuguuucugccuucgccacgacguggaugcccuccuguggcagccccauucuuccaagcaagacgauaugugggagcacaucgcuacguucaaugcccugggauacguucaggccagcaaaagagacaagaaguuuuucgcuugugcgcccaacuacucuuaugccgcucucugcgaaugccugcggagaguguuuauuuaccgccagccugccccgauguccaccguccuuuauaaucggaaagagggcagacagguggggcaaguugccaagcaacagguggcuagccuggaaacaaacgaucccauccucggauuccaggccaccaaugagcgccuguuuguccugacaaccaaaaaccuuuuccucauuaaggugaauacggaaaacuga

SEQ ID NO: 1098 - protein, 520 aa, Artificial Sequence
  COA-1/m__Homo_sapiens__Q5T124
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 1099 - RNA, 1563 nt, Artificial Sequence
  COA-1/m__Homo_sapiens__CCDS41288.1
augagcucaccuuuggccucccuuagcaagacccgaaaagugccccugcccucggagccuaugaauccugggaggcgaggaauccgcaucuauggagaugaagaugagguggacauguugagugauggguguggcucagaagaaaagaucucagucccuuccugcuauggcggcauaggugccccugugagucggcaagucccugcaucccaugacucggagcugauggccuucaugacgaggaaguugugggaccuggagcagcaggugaaggcccagacugaugagauacuguccaaggaucagaagauagcggcccuagaggaccuggugcagacccuccggccacacccagccgaggcaacccugcagcggcaggaggaacuggagacgaugugugugcagcugcagcggcaggucagggagauggagcgguuccucagugacuauggccugcagugggugggcgagcccauggaccaggaggacucagagagcaagacagucucagagcauggcgagagggacuggaugacagccaagaaguucuggaagccaggggacucauuggcgcccccugagguggacuuugacaggcugcuggccagccugcaggaucuuagugagcuggugguagagggugacacccaagugacaccagugcccggcggggcacggcugcguacccucgagcccaucccgcugaagcucuaccggaauggcaucaugauguucgacgggcccuuccagcccuucuacgaucccuccacacagcgcugccuccgagacauauuggauggcuucuuucccucagagcuccagcgacuguaccccaaugggguccccuuuaaggugagugacuugcgcaaucaggucuaccuggaggauggacuggaccccuucccaggcgagggccguguggugggcaggcagcugaugcacaaggccuuggacaggguggaggagcacccaggcuccaggaugacugcugagaaauuucugaacaggcuccccaaguuugugauccggcaaggcgaggugauugacauccggggccccaucagggacaccuugcagaacugcugcccauugccugcccggauccaggagauugugguggagacgcccaccuuggccgcugagcgagagaggagccaggagucacccaacacgccggcacccccgcucuccaugcugcgcaucaagucugagaauggggaacaggccuuccuacugaugaugcagccugacaacaccauuggggacgugcgagcucugcuagcgcaggccagggucauggaugccucugccuuugagaucuucagcacauucccgcccacccucuaccaggacgauacacucacgcugcaggcugcaggccuugugcccaaagcagcacugcugcugcgggcacgccgagccccgaaguccagccugaaauucaguccuggucccugucccggucccggucccggccccagucccggucccggucccggccccagucccggucccggucccggccccagucccuguccuggacccagucccagcccccaauaa

SEQ ID NO: 1100 - RNA, 1563 nt, Artificial Sequence
  derived and/or modified sequence opt1 from COA-1/m__Homo_sapiens__CCDS41288.1
augagcagcccccuggccucccucuccaagacccgcaaggugccgcugcccagcgagcccaugaaccccggccggcgcgggauccggaucuacggcgacgaggacgaggucgacaugcuguccgacgggugcggcagcgaggagaagaucuccgugccgagcugcuacgggggcaucggcgcccccgugucccgccagguccccgcgagccacgacuccgagcucauggccuucaugacccggaagcugugggaccuggagcagcaggucaaggcccagacggacgagauccucagcaaggaccagaagaucgccgcccuggaggaccuggugcagacccuccgcccccacccggcggaggccacccugcagcggcaggaggagcuggagaccaugugcgugcagcuccagcgccaggugcgggagauggagcgcuuccuguccgacuacgggcugcagugggugggcgagcccauggaccaggaggacagcgaguccaagacggucagcgagcacggggagcgggacuggaugaccgccaagaaguucuggaagcccggcgacucccucgcgcccccggagguggacuucgaccgccugcuggccagccuccaggaccuguccgagcugguggucgagggggacacccaggugacccccgugcccggcggcgcccggcuccgcacgcuggagcccaucccgcugaagcucuaccggaacgggaucaugauguucgacggccccuuccagcccuucuacgaccccagcacccagcgcugccugcgggacauccuggacggguucuucccgagcgagcuccagcgccuguaccccaacggcguccccuucaagguguccgaccugcggaaccagguguaccucgaggacggccuggaccccuucccgggggagggccgcgucguggggcggcagcugaugcacaaggcccucgaccgcguggaggagcaccccggcagccgcaugaccgccgagaaguuccugaaccggcugcccaaguucgucauccgccagggggaggugaucgacauccggggccccauccgcgacacccuccagaacugcugcccgcugcccgcccggauccaggagaucguggucgagacgcccacccuggcggccgagcgcgagcggucccaggagagcccgaacacccccgccccgccccucuccaugcugcgcaucaagagcgagaacggcgagcaggccuuccugcucaugaugcagcccgacaacaccaucggggacgugcgggcccugcuggcgcaggcccgcgucauggacgccuccgccuucgagaucuucagcacguucccgcccacccucuaccaggacgacacccugacccugcaggccgcgggccucgugcccaaggccgcccugcugcugcgggcccgccgggcccccaaguccagccucaaguucucccccgggcccugccccggcccggggcccggccccagccccggcccggggcccggccccucccccgggccgggccccgggcccagccccugcccgggccccucccccagcccgcaguga

SEQ ID NO: 1101 - RNA, 1563 nt, Artificial Sequence
  derived and/or modified sequence opt2 from COA-1/m__Homo_sapiens__CCDS41288.1
auguccuccccccucgccucccucuccaagacccgcaaggucccccuccccuccgagcccaugaaccccggccgccgcggcauccgcaucuacggcgacgaggacgaggucgacaugcucuccgacggcugcggcuccgaggagaagaucuccguccccuccugcuacggcggcaucggcgcccccgucucccgccagguccccgccucccacgacuccgagcucauggccuucaugacccgcaagcucugggaccucgagcagcaggucaaggcccagaccgacgagauccucuccaaggaccagaagaucgccgcccucgaggaccucguccagacccuccgcccccaccccgccgaggccacccuccagcgccaggaggagcucgagaccaugugcguccagcuccagcgccagguccgcgagauggagcgcuuccucuccgacuacggccuccagugggucggcgagcccauggaccaggaggacuccgaguccaagaccgucuccgagcacggcgagcgcgacuggaugaccgccaagaaguucuggaagcccggcgacucccucgccccccccgaggucgacuucgaccgccuccucgccucccuccaggaccucuccgagcucgucgucgagggcgacacccaggucacccccguccccggcggcgcccgccuccgcacccucgagcccaucccccucaagcucuaccgcaacggcaucaugauguucgacggccccuuccagcccuucuacgaccccuccacccagcgcugccuccgcgacauccucgacggcuucuuccccuccgagcuccagcgccucuaccccaacggcguccccuucaaggucuccgaccuccgcaaccaggucuaccucgaggacggccucgaccccuuccccggcgagggccgcgucgucggccgccagcucaugcacaaggcccucgaccgcgucgaggagcaccccggcucccgcaugaccgccgagaaguuccucaaccgccuccccaaguucgucauccgccagggcgaggucaucgacauccgcggccccauccgcgacacccuccagaacugcugcccccuccccgcccgcauccaggagaucgucgucgagacccccacccucgccgccgagcgcgagcgcucccaggagucccccaacacccccgcccccccccucuccaugcuccgcaucaaguccgagaacggcgagcaggccuuccuccucaugaugcagcccgacaacaccaucggcgacguccgcgcccuccucgcccaggcccgcgucauggacgccuccgccuucgagaucuucuccaccuucccccccacccucuaccaggacgacacccucacccuccaggccgccggccucguccccaaggccgcccuccuccuccgcgcccgccgcgcccccaaguccucccucaaguucucccccggccccugccccggccccggccccggccccucccccggccccggccccggccccucccccggccccggccccggccccucccccugccccggccccucccccuccccccaguga

SEQ ID NO: 1102 - RNA, 1563 nt, Artificial Sequence
  derived and/or modified sequence opt3 from COA-1/m__Homo_sapiens__CCDS41288.1
augagcuccccucuggccucucucucaaagaccagaaaagugccucuuccaagugagccgaugaaccccggcaggcgggggauccgcauuuacggagacgaagaugaggucgacaugcugagcgaugguugcggcuccgaagagaagauaucuguuccuucguguuaugggggaaucggcgcuccagugucacgacagguacccgcaagccacgacagugaauugauggccuucaugacacguaaauuaugggaucuggagcaacaggugaaggcgcagacugacgagauucuauccaaagaucagaagaucgcugcccucgaagaccugguccaaacgcuuagaccucauccagcagaggccacccugcagaggcaggaagaguuggagacaaugugcgugcagcuccaacggcagguucgcgaaauggagagauuucugucugauuacggucugcagugggugggggaacccauggaccaggaggauagcgaauccaagacugucucagagcacggagagagggacuggaugaccgcuaaaaaguucuggaaaccuggcgauagucucgcaccaccggaaguggacuuugaccgguuacuggccagccuucaagauuugucugagcugguaguugaaggcgacacacaggugacccccgucccugggggagcucgccuacgaacucucgagccaauuccccugaaacuuuauagaaaugguaucaugauguucgauggcccuuuucagccauucuacgaccccuccacacaaaggugucugcgggauauauuggacggguuuuucccgucagaacuccagcgucuguauccuaacggagugcccuuuaaggugagcgauuuacgcaaucaggucuaccuggaggacggccucgauccauucccuggugaggggagaguugugggaaggcagcuuaugcauaaggcccuggaccggguagaggaacaccccggcagucgaaugaccgcggaaaaguuuuugaaccgccuaccaaaauucgugaucagacaaggcgaggucauugauaucagggggcccauucgggacacgcugcagaauugcuguccucucccagcacgcauccaggaaauagugguugagacuccgacccuggccgcugagagagaaaggucucaggagucccccaacacacccgccccaccccuuagcaugcugcguauuaagucggaaaauggagagcaagcauuuuugcucaugaugcagccugacaacacuaucggugaugugcgggcucuguuagcccaggcgcgagucauggacgccucugcauucgagauuuucuccaccuuuccacccacacuguaucaggaugacacccuaacgcuccaagcugccggccuggugccgaaagcugcccuuuugcugagagcaaggcgcgccccuaagucaagucucaaauucagcccagggcccugcccuggacccggcccagguccuucccccgggccaggcccgggaccuucucccggcccagggcccggaccuagcccaugucccgguccuucaccgaguccacaguga

SEQ ID NO: 1103 - RNA, 1563 nt, Artificial Sequence
  derived and/or modified sequence opt4 from COA-1/m__Homo_sapiens__CCDS41288.1
augagcagcccccuggccagccugagcaagaccagaaaggugccccugcccagcgagcccaugaaccccggcagaagaggcaucagaaucuacggcgacgaggacgagguggacaugcugagcgacggcugcggcagcgaggagaagaucagcgugcccagcugcuacggcggcaucggcgcccccgugagcagacaggugcccgccagccacgacagcgagcugauggccuucaugaccagaaagcugugggaccuggagcagcaggugaaggcccagaccgacgagauccugagcaaggaccagaagaucgccgcccuggaggaccuggugcagacccugagaccccaccccgccgaggccacccugcagagacaggaggagcuggagaccaugugcgugcagcugcagagacaggugagagagauggagagauuccugagcgacuacggccugcagugggugggcgagcccauggaccaggaggacagcgagagcaagaccgugagcgagcacggcgagagagacuggaugaccgccaagaaguucuggaagcccggcgacagccuggccccccccgagguggacuucgacagacugcuggccagccugcaggaccugagcgagcuggugguggagggcgacacccaggugacccccgugcccggcggcgccagacugagaacccuggagcccaucccccugaagcuguacagaaacggcaucaugauguucgacggccccuuccagcccuucuacgaccccagcacccagagaugccugagagacauccuggacggcuucuuccccagcgagcugcagagacuguaccccaacggcgugcccuucaaggugagcgaccugagaaaccagguguaccuggaggacggccuggaccccuuccccggcgagggcagaguggugggcagacagcugaugcacaaggcccuggacagaguggaggagcaccccggcagcagaaugaccgccgagaaguuccugaacagacugcccaaguucgugaucagacagggcgaggugaucgacaucagaggccccaucagagacacccugcagaacugcugcccccugcccgccagaauccaggagaucgugguggagacccccacccuggccgccgagagagagagaagccaggagagccccaacacccccgcccccccccugagcaugcugagaaucaagagcgagaacggcgagcaggccuuccugcugaugaugcagcccgacaacaccaucggcgacgugagagcccugcuggcccaggccagagugauggacgccagcgccuucgagaucuucagcaccuucccccccacccuguaccaggacgacacccugacccugcaggccgccggccuggugcccaaggccgcccugcugcugagagccagaagagcccccaagagcagccugaaguucagccccggccccugccccggccccggccccggccccagccccggccccggccccggccccagccccggccccggccccggccccagccccugccccggccccagccccagcccccaguga

SEQ ID NO: 1104 - RNA, 1563 nt, Artificial Sequence
  derived and/or modified sequence opt5 from COA-1/m__Homo_sapiens__CCDS41288.1
augagcucuccccuggccucccucagcaagaccagaaaagugccucugccguccgagcccaugaacccuggccggcgcgggaucagaauuuacggagacgaagaugaggucgacaugcuuucugauggcugcgggagcgaagagaagaucuccguucccucuuguuauggaggcauuggggcuccugugagccgccaggugcccgccucccacgacagcgaacugauggcguucaugacacggaaacucugggaucuggagcaacaggucaaggcucagacggacgagauccuuucuaaagaucagaagauugccgcccuggaagaccucgugcaaacccugagaccucauccggcugaggccacacugcagcggcaggaggaacucgagaccaugugcguucagcugcaacgccaggugagagaaauggagcgguuucuuuccgauuacggacugcagugggucggcgaacccauggaccaggaggauagcgaaucuaagacaguguccgagcacggcgagcgcgacuggaugaccgcuaaaaaguucuggaaaccuggggauagccucgcucccccugaaguugacuuugacagacugcuugcgucucugcaagaucucuccgagcugguggucgaaggagacacacaggugacccccgugccgggcggggcccggcugcgcacgcucgagccuaucccccugaaacuuuauagaaauggaaucaugauguucgauggcccuuuucagcccuucuacgaccccagcacccaacggugucugcgcgauauucucgacggguuuuucccuuccgaacugcagagacuuuauccgaacggaguccccuuuaagguuucugaucugcggaaucagguguaccucgaggacggccuggauccuuuccccggcgaggggagaguggucggacgccagcugaugcauaaggcucucgaccggguggaggaacacccuggcagcagaaugacagccgaaaaguuucugaaccgccuucccaaauucguuauccggcaaggggaggugauugauaucagaggaccgauucgcgacacccugcagaauugcuguccucuccccgcucggauccaggaaauugucguggagacaccuacccuggccgcggagagagaacgcucccaggagagccccaacacgccugcucccccgcuuucuaugcugcggaucaaguccgaaaauggcgagcaagccuuucuccugaugaugcagccugacaacacaaucggggauguuagagcccugcucgcccaggcccgcgugauggacgccagcgcuuucgagauuuucucuaccuuuccgcccacacuguaucaggaugacacccuuacccugcaagcggccggacucgucccuaaagcugcccugcugcuucgggccagacgggcucccaagagcucccucaaauucucucccggcccuugccccggcccugggcccggaccuagccccggcccggggccuggacccuccccuggccccgggccgggcccuagccccuguccuggacccucucccuccccucaguga

SEQ ID NO: 1105 - protein, 142 aa, Artificial Sequence
  coactosin-like_protein__Homo_sapiens__Q14019
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 1106 - RNA, 429 nt, Artificial Sequence
  coactosin-like_protein__Homo_sapiens__AAA88022
auggccaccaagaucgacaaagaggcuugccgggcggcguacaaccuggugcgcgacgacggcucggccgucaucugggugacuuuuaaauaugacggcuccaccaucguccccggcgagcagggagcggaguaccagcacuucauccagcagugcacagaugacguccgguuguuugccuucgugcgcuucaccaccggggaugccaugagcaagagguccaaguuugcccucaucacguggaucggugagaacgucagcgggcugcagcgcgccaaaaccgggacggacaagacccuggugaaggaggucguacagaauuucgcuaaggaguuugugaucagugaucggaaggagcuggaggaagauuucaucaagagcgagcugaagaaggcggggggagccaauuacgacgcccagacggaguaa

SEQ ID NO: 1107 - RNA, 429 nt, Artificial Sequence
  derived and/or modified sequence opt1 from coactosin-like_protein__Homo_sapiens__AAA88022
auggccaccaagaucgacaaggaggccugccgcgcggccuacaaccuggugcgggacgacggcagcgccgucaucugggugaccuucaaguacgacggguccacgaucgugcccggcgagcagggggccgaguaccagcacuucauccagcagugcaccgacgacguccgccucuucgccuucgugcgguucaccaccggcgacgcgaugagcaagcgcuccaaguucgcccugaucacguggaucggggagaacgugagcggccugcagcgggccaagaccggcaccgacaagacccucgucaaggagguggugcagaacuucgccaaggaguucgucaucuccgaccgcaaggagcuggaggaggacuucaucaagagcgagcugaagaaggccgggggcgcgaacuacgacgcccagacggaguga

SEQ ID NO: 1108 - RNA, 429 nt, Artificial Sequence
  derived and/or modified sequence opt2 from coactosin-like_protein__Homo_sapiens__AAA88022
auggccaccaagaucgacaaggaggccugccgcgccgccuacaaccucguccgcgacgacggcuccgccgucaucugggucaccuucaaguacgacggcuccaccaucguccccggcgagcagggcgccgaguaccagcacuucauccagcagugcaccgacgacguccgccucuucgccuucguccgcuucaccaccggcgacgccauguccaagcgcuccaaguucgcccucaucaccuggaucggcgagaacgucuccggccuccagcgcgccaagaccggcaccgacaagacccucgucaaggaggucguccagaacuucgccaaggaguucgucaucuccgaccgcaaggagcucgaggaggacuucaucaaguccgagcucaagaaggccggcggcgccaacuacgacgcccagaccgaguga

SEQ ID NO: 1109 - RNA, 429 nt, Artificial Sequence
  derived and/or modified sequence opt3 from coactosin-like_protein__Homo_sapiens__AAA88022
auggccaccaagaucgacaaagaggcuugcagagcagccuacaaccuggugagggaugacggcagcgcggucauuuggguuacauucaaguaugauggguccacuauagugcccggagaacagggugcugaguaccaacacuuuauccagcaguguacggacgauguacgccucuucgccuuugugcgguucaccacaggcgacgcaaugucuaaacgaucaaaguuugcccuuauuacuuggaucggggaaaaugucaguggacugcagcgugcuaaaaccggcacagauaagaccuuggugaaggagguugugcaaaacuucgcaaaagaauuugucauuagcgacagaaaggaguuagaggaagauuucaucaaauccgagcugaagaaagccgguggggcuaauuaugacgcccagacugaauga

SEQ ID NO: 1110 - RNA, 429 nt, Artificial Sequence
  derived and/or modified sequence opt4 from coactosin-like_protein__Homo_sapiens__AAA88022
auggccaccaagaucgacaaggaggccugcagagccgccuacaaccuggugagagacgacggcagcgccgugaucugggugaccuucaaguacgacggcagcaccaucgugcccggcgagcagggcgccgaguaccagcacuucauccagcagugcaccgacgacgugagacuguucgccuucgugagauucaccaccggcgacgccaugagcaagagaagcaaguucgcccugaucaccuggaucggcgagaacgugagcggccugcagagagccaagaccggcaccgacaagacccuggugaaggagguggugcagaacuucgccaaggaguucgugaucagcgacagaaaggagcuggaggaggacuucaucaagagcgagcugaagaaggccggcggcgccaacuacgacgcccagaccgaguga

SEQ ID NO: 1111 - RNA, 429 nt, Artificial Sequence
  derived and/or modified sequence opt5 from coactosin-like_protein__Homo_sapiens__AAA88022
auggccaccaagaucgacaaagaggcuugcagagccgcguacaaccuggugcgggaugacggcagcgcugucauuuggguuacauucaaguaugauggguccacgaucgugcccggagaacagggcgccgaguaccaacacuuuauucagcaguguaccgacgaugugcgccucuucgccuuugucagauucacaaccggggacgcuaugucuaaacggagcaaguuugcccugaucacauggauuggagaaaauguguccggccuucagcgcgcuaaaaccgggacagauaagacccugguuaaggaggugguccaaaacuucgccaaagaauuugugaucucugacagaaaggagcucgaggaagauuucaucaaaagcgagcugaagaaagcgggaggcgccaauuaugacgcucagacggaauga

SEQ ID NO: 1112 - protein, 164 aa, Artificial Sequence
  collagen_XXIII__Homo_sapiens__L8EAS4
MATRDPWVWMASPDFQARKGKRVHQETLAPGETKDKMELLGLRGPLDLLGPGALLATLGKMAPGEHKAQRAPKESPDKTARWAQRDPQGPRVSLEYLERRATMGHQASLDHQGPRASQGAWGLGERTVWTVPQDRRGSLATEARMELQGPGVPQASRASRETQW

SEQ ID NO: 1113 - RNA, 495 nt, Artificial Sequence
  collagen_XXIII__Homo_sapiens__CCQ43891
auggcuacccgggaccccuggguuuggauggcaagcccggacuuccaggcccgaaaggggaaaagggugcaccaggagacuuuggcccccggggagaccaaggacaagauggagcugcugggccuccggggcccccuggaccuccuggggcccggggcccuccuggcgacacugggaaagauggccccaggggagcacaaggcccagcgggccccaaaggagagcccggacaagacggcgagaugggcccaaagggacccccagggcccaagggugagccuggaguaccuggaaagaagggcgacgaugggacaccaagccagccuggaccaccagggcccaagggcgagccagggagcauggggccucggggagagaacgguguggacggugccccaggaccgaagggggagccuggccaccgaggcacggauggagcugcagggccccggggugccccaggccucaagggcgagcagggagacacagugguga

SEQ ID NO: 1114 - RNA, 495 nt, Artificial Sequence
  derived and/or modified sequence opt1 from collagen_XXIII__Homo_sapiens__CCQ43891
auggccacccgcgaccccuggguguggauggccagcccggacuuccaggcgcggaagggcaagcgcguccaccaggagacccuggcccccggggagacgaaggacaagauggagcuccugggccugcgggggccccucgaccugcugggccccggggcccuccuggccacccugggcaagauggccccgggcgagcacaaggcgcagcgcgcccccaaggagucccccgacaagaccgcccggugggcccagcgcgacccccaggggccgcgggugagccucgaguaccuggagcgccgggcgaccaugggccaccaggccucccuggaccaccaggggccccgcgccagccagggcgccugggggcucggcgagcggacgguguggaccgucccccaggaccgccggggcucccuggccaccgaggcgcgcauggagcugcaggggcccggcgugccgcaggccagccgggccucccgcgagacccagugguga

SEQ ID NO: 1115 - RNA, 495 nt, Artificial Sequence
  derived and/or modified sequence opt2 from collagen_XXIII__Homo_sapiens__CCQ43891
auggccacccgcgaccccugggucuggauggccucccccgacuuccaggcccgcaagggcaagcgcguccaccaggagacccucgcccccggcgagaccaaggacaagauggagcuccucggccuccgcggcccccucgaccuccucggccccggcgcccuccucgccacccucggcaagauggcccccggcgagcacaaggcccagcgcgcccccaaggagucccccgacaagaccgcccgcugggcccagcgcgacccccagggcccccgcgucucccucgaguaccucgagcgccgcgccaccaugggccaccaggccucccucgaccaccagggcccccgcgccucccagggcgccuggggccucggcgagcgcaccgucuggaccgucccccaggaccgccgcggcucccucgccaccgaggcccgcauggagcuccagggccccggcgucccccaggccucccgcgccucccgcgagacccagugguga

SEQ ID NO: 1116 - RNA, 495 nt, Artificial Sequence
  derived and/or modified sequence opt3 from collagen_XXIII__Homo_sapiens__CCQ43891
auggccaccagagaccccuggguguggauggcuagcccugauuuccaggcaaggaagggcaaacggguccaccaagagacacuggccccaggggaaacuaaggacaaaauggagcuccuuggacugcgcgguccguuggauuuacugggccccggggcgcuacucgcuacgcugggaaagauggccccuggcgaacauaaagcacagcgagccccaaaggagucccccgacaagaccgcucguugggcacagagagauccucaggguccaaggguuucucuugaauaccuggagcggcgcgccacaauggggcaccaggcuucauuggaccaucaaggacccagagccagucagggcgcguggggccucggggagaggacuguguggaccguaccucaggaucggcgcggaagccuggcaacagaagcccgaauggagcugcaagguccaggcgugccgcaggcuuccagagccucuagggaaacccagugguga

SEQ ID NO: 1117 - RNA, 495 nt, Artificial Sequence
  derived and/or modified sequence opt4 from collagen_XXIII__Homo_sapiens__CCQ43891
auggccaccagagaccccuggguguggauggccagccccgacuuccaggccagaaagggcaagagagugcaccaggagacccuggcccccggcgagaccaaggacaagauggagcugcugggccugagaggcccccuggaccugcugggccccggcgcccugcuggccacccugggcaagauggcccccggcgagcacaaggcccagagagcccccaaggagagccccgacaagaccgccagaugggcccagagagacccccagggccccagagugagccuggaguaccuggagagaagagccaccaugggccaccaggccagccuggaccaccagggccccagagccagccagggcgccuggggccugggcgagagaaccguguggaccgugccccaggacagaagaggcagccuggccaccgaggccagaauggagcugcagggccccggcgugccccaggccagcagagccagcagagagacccagugguga

SEQ ID NO: 1118 - RNA, 495 nt, Artificial Sequence
  derived and/or modified sequence opt5 from collagen_XXIII__Homo_sapiens__CCQ43891
auggccaccagagaccccuggguguggauggcuagcccugauuuccaggcccggaagggcaaacgcguccaccaagagacacuggcgccgggggaaacgaaggacaaaauggagcuccugggacuuagaggcccccuggaucuccuggggccuggagcccuucuggcuacccucggcaagauggcccccggggaacauaaagcucagcgggccccuaaggagucccccgacaagacagcucgcugggcccagagagauccucagggaccgcggguuucucuggaauaccuggagcgcagagcgaccaugggccaccaagccagccucgaccaucagggcccccgggcuucccagggggccuggggacugggcgagcgcacaguguggaccgugccucaggauagacgggggucucuugcuacagaagcccgcauggagcugcaaggacccggcgucccucaggcgagcagagccucccgggaaacccagugguga

SEQ ID NO: 1119 - protein, 540 aa, Artificial Sequence
  collagen_XXIII__Homo_sapiens__Q86Y22
MGPGERAGGGGDAGKGNAAGGGGGGRSATTAGSRAVSALCLLLSVGSAAACLLLGVQAAALQGRVAALEEERELLRRAGPPGALDAWAEPHLERLLREKLDGLAKIRTAREAPSECVCPPGPPGRRGKPGRRGDPGPPGQSGRDGYPGPLGLDGKPGLPGPKGEKGAPGDFGPRGDQGQDGAAGPPGPPGPPGARGPPGDTGKDGPRGAQGPAGPKGEPGQDGEMGPKGPPGPKGEPGVPGKKGDDGTPSQPGPPGPKGEPGSMGPRGENGVDGAPGPKGEPGHRGTDGAAGPRGAPGLKGEQGDTVVIDYDGRILDALKGPPGPQGPPGPPGIPGAKGELGLPGAPGIDGEKGPKGQKGDPGEPGPAGLKGEAGEMGLSGLPGADGLKGEKGESASDSLQESLAQLIVEPGPPGPPGPPGPMGLQGIQGPKGLDGAKGEKGASGERGPSGLPGPVGPPGLIGLPGTKGEKGRPGEPGLDGFPGPRGEKGDRSERGEKGERGVPGRKGVKGQKGEPGPPGLDQPCPVGPDGLPVPGCWHK

SEQ ID NO: 1120 - RNA, 1623 nt, Artificial Sequence
  collagen_XXIII__Homo_sapiens__AAO18361
augggcccaggcgagcgcgccgguggcggcggcgacgcggggaagggcaaugcggcgggcggcggcggcggagggcgcucggcgacgacggccgggucccgggcggugagcgcgcugugccugcugcucuccgugggcucggcggcugccugccugcugcuggguguccaggcggccgcgcugcagggccggguggcggcgcucgaggaggagcgggagcugcugcggcgcgcggggccgccaggcgcccuggacgccugggccgagccgcaccuggagcgccugcugcgggagaaguuggacggacuagcgaagauccggacugcucgggaagcuccauccgaaugugucugccccccagggcccccuggacggcgcggcaagccugggagaagaggcgacccugguccuccagggcaaucaggacgagauggcuacccgggaccccuggguuuggauggcaagcccggacuuccaggcccgaaaggggaaaagggugcaccaggagacuuuggcccccggggagaccaaggacaagauggagcugcugggccuccggggcccccuggaccuccuggggcccggggcccuccuggcgacacugggaaagauggccccaggggagcacaaggcccagcgggccccaaaggagagcccggacaagacggcgagaugggcccaaagggacccccagggcccaagggugagccuggaguaccuggaaagaagggcgacgaugggacaccaagccagccuggaccaccagggcccaagggcgagccagggagcauggggccucggggagagaacgguguggacggugccccaggaccgaagggggagccuggccaccgaggcacggauggagcugcagggccccggggugccccaggccucaagggcgagcagggagacacaguggugaucgacuaugauggcaggaucuuggaugcccucaaggggccucccggaccacaggggcccccagggccaccagggaucccuggagccaagggcgagcuuggauugcccggugccccaggaaucgauggagagaagggccccaaaggacagaaaggagacccaggagagccugggccagcaggacucaaaggggaagcaggcgagaugggcuuguccggccucccgggcgcugacggccucaagggggagaagggggagucggcgucugacagccuacaggagagccuggcucagcucauaguggagccagggcccccuggccccccuggccccccaggcccgaugggccuccagggaauccagggucccaagggcuuggauggagcaaagggagagaagggugcgucgggugagagaggccccagcggccugccugggccaguuggcccaccgggccuuauugggcugccaggaaccaaaggagagaagggcagacccggggagccaggacuagaugguuucccuggaccccgaggagagaaaggugaucggagcgagcguggagagaagggagaacgagggguccccggccggaaaggagugaagggccagaagggcgagccgggaccaccaggccuggaccagccgugucccgugggccccgacgggcugccugugccuggcugcuggcauaaguga

SEQ ID NO: 1121 - RNA, 1623 nt, Artificial Sequence
  derived and/or modified sequence opt1 from collagen_XXIII__Homo_sapiens__AAO18361
augggccccggggagcgcgccggcgggggcggggacgccggcaagggcaacgcggccgggggcgggggcgggggccggagcgccaccaccgccggcucccgcgccgugagcgcgcugugccuccugcuguccgucgggagcgccgccgccugccuccugcugggcgugcaggcggccgcccuccaggggcggguggccgcccuggaggaggagcgcgagcugcuccggcgcgcgggcccgcccggcgcccuggacgccugggccgagccccaccuggagcggcuccugcgcgagaagcuggacgggcucgccaagauccggacggcgcgcgaggcccccuccgagugcgucugcccgcccggcccgcccgggcggcgcggcaagcccgggcggcgcggcgaccccggcccgcccgggcagagcggccgggacggguaccccggcccccuggggcuggacggcaagcccggccuccccgggccgaagggcgagaagggggcccccggcgacuucgggccccgcggcgaccagggccaggacggggccgccgggcccccgggcccgcccggcccgcccggcgcgcgggggccgcccggcgacaccgggaaggacggcccccgcggggcccagggccccgccggccccaagggggagcccggccaggacggggagaugggccccaaggggccgcccggccccaagggcgagcccggggugcccggcaagaagggggacgacggcacccccucccagcccgggccgcccggccccaagggcgagcccgggagcaugggcccgcgcggggagaacggcguggacggggcccccggccccaagggcgagcccgggcaccggggcaccgacggggccgcgggcccgcggggcgcccccgggcugaagggcgagcagggggacacggucgugaucgacuacgacggccgcauccuggacgcccucaaggggccgcccggcccccagggcccgcccgggccgcccggcauccccggggccaagggcgagcuggggcugcccggcgcgcccggcaucgacggggagaagggccccaaggggcagaagggcgaccccggggagcccggcccggccggccucaagggggaggccggcgagauggggcuguccggccugcccggcgccgacgggcucaagggcgagaagggggagagcgccuccgacagccugcaggagucccuggcgcagcucaucguggagcccgggcccccgggcccgcccggcccgcccggccccauggggcugcagggcauccaggggcccaagggccuggacggggccaagggcgagaagggcgccagcggggagcgcggccccuccgggcuccccggccccgucgggccgcccggccugaucggccugcccgggaccaagggcgagaaggggcggcccggcgagcccgggcucgacggcuuccccggcccgcgcggggagaagggcgaccggagcgagcgcggggagaagggcgagcggggcgugcccgggcgcaagggcgugaaggggcagaagggcgagcccgggcccccgggccuggaccagcccugccccgucggcccggacgggcugcccgugcccggcugcuggcacaaguga

SEQ ID NO: 1122 - RNA, 1623 nt, Artificial Sequence
  derived and/or modified sequence opt2 from collagen_XXIII__Homo_sapiens__AAO18361
augggccccggcgagcgcgccggcggcggcggcgacgccggcaagggcaacgccgccggcggcggcggcggcggccgcuccgccaccaccgccggcucccgcgccgucuccgcccucugccuccuccucuccgucggcuccgccgccgccugccuccuccucggcguccaggccgccgcccuccagggccgcgucgccgcccucgaggaggagcgcgagcuccuccgccgcgccggcccccccggcgcccucgacgccugggccgagccccaccucgagcgccuccuccgcgagaagcucgacggccucgccaagauccgcaccgcccgcgaggcccccuccgagugcgucugcccccccggcccccccggccgccgcggcaagcccggccgccgcggcgaccccggcccccccggccaguccggccgcgacggcuaccccggcccccucggccucgacggcaagcccggccuccccggccccaagggcgagaagggcgcccccggcgacuucggcccccgcggcgaccagggccaggacggcgccgccggcccccccggcccccccggcccccccggcgcccgcggcccccccggcgacaccggcaaggacggcccccgcggcgcccagggccccgccggccccaagggcgagcccggccaggacggcgagaugggccccaagggcccccccggccccaagggcgagcccggcguccccggcaagaagggcgacgacggcacccccucccagcccggcccccccggccccaagggcgagcccggcuccaugggcccccgcggcgagaacggcgucgacggcgcccccggccccaagggcgagcccggccaccgcggcaccgacggcgccgccggcccccgcggcgcccccggccucaagggcgagcagggcgacaccgucgucaucgacuacgacggccgcauccucgacgcccucaagggcccccccggcccccagggcccccccggcccccccggcauccccggcgccaagggcgagcucggccuccccggcgcccccggcaucgacggcgagaagggccccaagggccagaagggcgaccccggcgagcccggccccgccggccucaagggcgaggccggcgagaugggccucuccggccuccccggcgccgacggccucaagggcgagaagggcgaguccgccuccgacucccuccaggagucccucgcccagcucaucgucgagcccggcccccccggcccccccggcccccccggccccaugggccuccagggcauccagggccccaagggccucgacggcgccaagggcgagaagggcgccuccggcgagcgcggccccuccggccuccccggccccgucggcccccccggccucaucggccuccccggcaccaagggcgagaagggccgccccggcgagcccggccucgacggcuuccccggcccccgcggcgagaagggcgaccgcuccgagcgcggcgagaagggcgagcgcggcguccccggccgcaagggcgucaagggccagaagggcgagcccggcccccccggccucgaccagcccugccccgucggccccgacggccuccccguccccggcugcuggcacaaguga

SEQ ID NO: 1123 - RNA, 1623 nt, Artificial Sequence
  derived and/or modified sequence opt3 from collagen_XXIII__Homo_sapiens__AAO18361
augggccccggggagagagccggagguggcggggacgcuggaaagggcaacgcagccggugggggaggcggcgggaggagcgcgaccacagcuggaucccgggccgugucugcacugugccuccuucugucagucgguagugccgcugcauguuuguuacugggcguucaggccgcugcccuacaagggcgcguggcggcacucgaagaggaacgagagcugcuucguagagccggaccuccaggcgcucuggaugccugggcagaaccgcacuuggagaggcuccugcgggagaaacuggacggucucgcuaagauccgcacugccagagaagcgcccagcgagugcguauguccuccagggcccccuggaaggcggggcaaaccaggccgccgaggggaucccggaccuccaggucaguccggcagagacggguacccgggacccuuaggccuggaugguaagccugggcuuccaggccccaaaggagaaaagggcgccccuggggacuucggaccaaggggugaucagggccaggacggggcagcuggacccccgggcccucccgguccaccuggggcccggggacccccaggcgauacgggcaaggacgggccccguggagcucaagguccugccggcccaaaaggggagccgggacaggauggcgagaugggucccaaggggccuccaggccccaaaggagaaccuggcgugccagggaagaaaggagacgauggcacccccucucagccggguccuccagggcccaagggagagccuggcucgauggguccccgcggcgaaaauggggucgacggagcaccaggcccuaagggggagcccggacauagaggcacagacggugccgcugggccaaggggagcgccgggcuugaaaggugaacagggcgauacugugguuauugacuaugaugggcggauacuggacgcacuaaagggaccucccggcccacaagggcccccuggaccacccggcaucccuggugccaaaggggagcucggacugccgggcgcuccagguauugauggcgagaaggggcccaaaggacagaagggcgacccuggggaaccaggacccgccggccuuaaaggugaggcaggggaaaugggacugucaggcuugccuggcgccgaugggcucaagggagagaagggugaaagcgcuagugacucccugcaggagucuuuagcccagcugaucguggagccggggcccccaggcccucccggaccaccuggccccaugggucuccaagggauucagggaccaaaaggccuugauggcgcaaagggggaaaaaggagcgagcggugagcgaggcccguccgggcugccuggacccgucggcccacccgguuugaucgggcuaccuggaaccaagggcgaaaaaggccgcccaggggagcccggacuggacgguuuuccuggcccgagaggggaaaagggagauaggucagagcggggcgagaagggugaacgcggggugccaggaagaaaaggcguaaagggccagaaaggggagcccggaccucccggucucgaccaaccaugcccuguuggccccgacgggcugccagugccuggauguuggcacaaguga

SEQ ID NO: 1124 - RNA, 1623 nt, Artificial Sequence
  derived and/or modified sequence opt4 from collagen_XXIII__Homo_sapiens__AAO18361
augggccccggcgagagagccggcggcggcggcgacgccggcaagggcaacgccgccggcggcggcggcggcggcagaagcgccaccaccgccggcagcagagccgugagcgcccugugccugcugcugagcgugggcagcgccgccgccugccugcugcugggcgugcaggccgccgcccugcagggcagaguggccgcccuggaggaggagagagagcugcugagaagagccggcccccccggcgcccuggacgccugggccgagccccaccuggagagacugcugagagagaagcuggacggccuggccaagaucagaaccgccagagaggcccccagcgagugcgugugcccccccggcccccccggcagaagaggcaagcccggcagaagaggcgaccccggcccccccggccagagcggcagagacggcuaccccggcccccugggccuggacggcaagcccggccugcccggccccaagggcgagaagggcgcccccggcgacuucggccccagaggcgaccagggccaggacggcgccgccggcccccccggcccccccggcccccccggcgccagaggcccccccggcgacaccggcaaggacggccccagaggcgcccagggccccgccggccccaagggcgagcccggccaggacggcgagaugggccccaagggcccccccggccccaagggcgagcccggcgugcccggcaagaagggcgacgacggcacccccagccagcccggcccccccggccccaagggcgagcccggcagcaugggccccagaggcgagaacggcguggacggcgcccccggccccaagggcgagcccggccacagaggcaccgacggcgccgccggccccagaggcgcccccggccugaagggcgagcagggcgacaccguggugaucgacuacgacggcagaauccuggacgcccugaagggcccccccggcccccagggcccccccggcccccccggcauccccggcgccaagggcgagcugggccugcccggcgcccccggcaucgacggcgagaagggccccaagggccagaagggcgaccccggcgagcccggccccgccggccugaagggcgaggccggcgagaugggccugagcggccugcccggcgccgacggccugaagggcgagaagggcgagagcgccagcgacagccugcaggagagccuggcccagcugaucguggagcccggcccccccggcccccccggcccccccggccccaugggccugcagggcauccagggccccaagggccuggacggcgccaagggcgagaagggcgccagcggcgagagaggccccagcggccugcccggccccgugggcccccccggccugaucggccugcccggcaccaagggcgagaagggcagacccggcgagcccggccuggacggcuuccccggccccagaggcgagaagggcgacagaagcgagagaggcgagaagggcgagagaggcgugcccggcagaaagggcgugaagggccagaagggcgagcccggcccccccggccuggaccagcccugccccgugggccccgacggccugcccgugcccggcugcuggcacaaguga

SEQ ID NO: 1125 - RNA, 1623 nt, Artificial Sequence
  derived and/or modified sequence opt5 from collagen_XXIII__Homo_sapiens__AAO18361
augggccccggggagagagccggaggcgggggagacgcuggcaaggggaacgccgcgggaggcggcgggggaggccggagcgcuaccacagccgggucccgcgccgugucugcucugugccuccugcuuagcgucggauccgccgcugccugucugcuccugggcguucaggcggccgcccuucaagggagaguggcugcucuggaagaggaacgggagcuccugcgcagagccggaccuccgggcgcgcuggaugccugggcugaaccccaccucgagcggcugcuucgcgagaaacuggacggccucgccaagaucagaacggcucgggaagccccuucugagugcgugugucccccugggcccccuggacgcagaggcaaaccggggcggcgcggagaucccggcccucccgggcagagcggaagagacggcuacccuggcccccuggggcuugauggaaagccgggccugccugggcccaaaggagaaaagggcgccccuggggacuucggcccccggggagaucagggccaggacggggcugcgggacccccuggcccgcccgggccucccggagcccgcggcccucccggggauaccggcaaggacggaccgagaggcgcucaagggccugccggacccaaaggcgagccugggcaggauggagagaugggccccaaggggccucccggcccgaaaggagaaccuggcguccccgggaagaaaggagacgauggcacacccucccagccugggccgcccggaccuaagggcgagcccgggucuaugggcccucggggagaaaauggcguggacggggcccccggaccuaagggcgagcccgggcauagaggaaccgacggcgcugccggcccgcgcggggcgccuggacucaaaggcgaacagggggauacaguugugauugacuaugauggacggauccuggacgcucugaaggggcccccuggcccccaaggaccgccugggcccccuggcauucccggcgccaaaggagagcucggccugcccggggccccuggaaucgauggcgagaaggggccgaaaggacagaagggcgaccccggcgaaccugggcccgcuggacuuaaaggcgaggccggggaaaugggacugagcggccucccuggggcugauggacugaagggcgagaagggcgaauccgccagcgacucucuucaggagucccuggcgcagcucauugucgagcccgggccuccgggacccccugggcccccuggccccaugggacugcaaggcauccaggggccgaaaggacuggauggcgccaagggcgaaaaaggggcuagcggagagagaggcccuucugggcuccccggacccgugggcccucccgggcugaucggacuuccuggcaccaagggcgaaaaagggcgcccgggagagcccggccuggacggguuuccuggaccccggggcgaaaagggggauagauccgagcgcggagagaagggcgaacggggcguuccugggagaaaaggagugaagggccagaaaggggagcccggaccgccuggccucgaccaacccugcccugucgggcccgacggccugccugugcccggauguuggcacaaguga

SEQ ID NO: 1126 - protein, 163 aa, Artificial Sequence
  COX-2__Homo_sapiens__Q6ZYK7
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKALHASVFQDRS

SEQ ID NO: 1127 - RNA, 492 nt, Artificial Sequence
  COX-2__Homo_sapiens__CAG25548
augcucgcccgcgcccugcugcugugcgcgguccuggcgcucagccauacagcaaauccuugcuguucccacccaugucaaaaccgagguguauguaugagugugggauuugaccaguauaagugcgauuguacccggacaggauucuauggagaaaacugcucaacaccggaauuuuugacaagaauaaaauuauuucugaaacccacuccaaacacagugcacuacauacuuacccacuucaagggauuuuggaacguugugaauaacauucccuuccuucgaaaugcaauuaugaguuauguguugacauccagaucacauuugauugacaguccaccaacuuacaaugcugacuauggcuacaaaagcugggaagccuucucuaaccucuccuauuauacuagagcccuuccuccugugccugaugauugcccgacucccuugggugucaaagcacuucacgcaucaguuuuucaagacagaucauaa

SEQ ID NO: 1128 - RNA, 492 nt, Artificial Sequence
  derived and/or modified sequence opt1 from COX-2__Homo_sapiens__CAG25548
augcuggcccgcgcccuccugcugugcgcggugcucgcccugagccacaccgccaaccccugcugcucccaccccugccagaaccggggcgucugcaugagcgugggguucgaccaguacaagugcgacugcacccgcaccggcuucuacggggagaacugcuccacccccgaguuccugacccggaucaagcuguuccucaagcccacccccaacacggugcacuacauccugacccacuucaagggcuucuggaacgucgugaacaacaucccguuccuccgcaacgccaucaugagcuacgugcugaccucccggagccaccugaucgacuccccgcccaccuacaacgccgacuacggguacaagagcugggaggcguucuccaaccucagcuacuacacgcgcgcccugccgcccguccccgacgacugccccacgccccugggcgugaaggcccuccacgccuccguguuccaggaccggagcuga

SEQ ID NO: 1129 - RNA, 492 nt, Artificial Sequence
  derived and/or modified sequence opt2 from COX-2__Homo_sapiens__CAG25548
augcucgcccgcgcccuccuccucugcgccguccucgcccucucccacaccgccaaccccugcugcucccaccccugccagaaccgcggcgucugcauguccgucggcuucgaccaguacaagugcgacugcacccgcaccggcuucuacggcgagaacugcuccacccccgaguuccucacccgcaucaagcucuuccucaagcccacccccaacaccguccacuacauccucacccacuucaagggcuucuggaacgucgucaacaacauccccuuccuccgcaacgccaucauguccuacguccucaccucccgcucccaccucaucgacuccccccccaccuacaacgccgacuacggcuacaaguccugggaggccuucuccaaccucuccuacuacacccgcgcccucccccccguccccgacgacugccccaccccccucggcgucaaggcccuccacgccuccgucuuccaggaccgcuccuga

SEQ ID NO: 1130 - RNA, 492 nt, Artificial Sequence
  derived and/or modified sequence opt3 from COX-2__Homo_sapiens__CAG25548
augcuggccagagcucuccuucugugcgcaguguuggccuuaagccacaccgcgaaccccuguugcucccauccuugucagaauaggggcgucugcaugucuguuggguucgaccaauacaagugugauugcacacggacuggauuuuauggugagaacuguucaacgccagaguuccugacccgcaucaaacuauuucucaagccgacacccaauacugugcacuacauucugacccauuucaaaggcuuuuggaacguagugaauaacauaccuuuccuucgaaaugcuaucaugaguuauguccugacaagccguucccacuugauugacucuccacccaccuacaacgccgauuauggguacaagucgugggaagcauuuucaaaucucagcuauuacacuagagcccugccuccagugcccgacgauugcccuacaccacugggaguuaaagcucuccaugcaaguguguuccaggacagguccuga

SEQ ID NO: 1131 - RNA, 492 nt, Artificial Sequence
  derived and/or modified sequence opt4 from COX-2__Homo_sapiens__CAG25548
augcuggccagagcccugcugcugugcgccgugcuggcccugagccacaccgccaaccccugcugcagccaccccugccagaacagaggcgugugcaugagcgugggcuucgaccaguacaagugcgacugcaccagaaccggcuucuacggcgagaacugcagcacccccgaguuccugaccagaaucaagcuguuccugaagcccacccccaacaccgugcacuacauccugacccacuucaagggcuucuggaacguggugaacaacauccccuuccugagaaacgccaucaugagcuacgugcugaccagcagaagccaccugaucgacagcccccccaccuacaacgccgacuacggcuacaagagcugggaggccuucagcaaccugagcuacuacaccagagcccugccccccgugcccgacgacugccccaccccccugggcgugaaggcccugcacgccagcguguuccaggacagaagcuga

SEQ ID NO: 1132 - RNA, 492 nt, Artificial Sequence
  derived and/or modified sequence opt5 from COX-2__Homo_sapiens__CAG25548
augcuggccagagcucuccugcuuugcgccgugcuggcgcucagccacaccgcuaaccccuguugcucccauccuugucagaaucggggcgucugcaugucuguuggguucgaccaauacaagugugauugcacccgcacgggauuuuauggcgagaacuguagcaccccggaauuucugacaagaaucaaacuuuuccugaagcccaccccuaauacagugcacuacauucucacccauuucaaaggguuuuggaacguggucaauaacauccccuuccugcggaaugccauuauguccuaugugcugacaucucgcagccaccucaucgacuccccucccaccuacaacgccgauuauggauacaagucuugggaggcuuuuagcaaucuguccuauuacacgagagcccuuccuccgguucccgacgauugcccuacaccccugggcgugaaagcucuccaugccagcgucuuccaggaccggucuuga

SEQ ID NO: 1133 - protein, 543 aa, Artificial Sequence
  CP1B1__Homo_sapiens__Q16678
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 1134 - RNA, 1632 nt, Artificial Sequence
  CP1B1__Homo_sapiens__AAC50809
augggcaccagccucagcccgaacgacccuuggccgcuaaacccgcuguccauccagcagaccacgcuccugcuacuccugucggugcuggccacugugcaugugggccagcggcugcugaggcaacggaggcggcagcuccgguccgcgcccccgggcccguuugcguggccacugaucggaaacgcggcggcggugggccaggcggcucaccucucguucgcucgccuggcgcggcgcuacggcgacguuuuccagauccgccugggcagcugccccauaguggugcugaauggcgagcgcgccauccaccaggcccuggugcagcagggcucggccuucgccgaccggccggccuucgccuccuuccgugugguguccggcggccgcagcauggcuuucggccacuacucggagcacuggaaggugcagcggcgcgcagcccacagcaugaugcgcaacuucuucacgcgccagccgcgcagccgccaaguccucgagggccacgugcugagcgaggcgcgcgagcugguggcgcugcuggugcgcggcagcgcggacggcgccuuccucgacccgaggccgcugaccgucguggccguggccaacgucaugagugccguguguuucggcugccgcuacagccacgacgaccccgaguuccgugagcugcucagccacaacgaagaguucgggcgcacggugggcgcgggcagccugguggacgugaugcccuggcugcaguacuuccccaacccggugcgcaccguuuuccgcgaauucgagcagcucaaccgcaacuucagcaacuucauccuggacaaguucuugaggcacugcgaaagccuucggcccggggccgccccccgcgacaugauggacgccuuuauccucucugcggaaaagaaggcggccggggacucgcacggugguggcgcgcggcuggauuuggagaacguaccggccacuaucacugacaucuucggcgccagccaggacacccuguccaccgcgcugcaguggcugcuccuccucuucaccagguauccugaugugcagacucgagugcaggcagaauuggaucaggucguggggagggaccgucugccuuguaugggugaccagcccaaccugcccuauguccuggccuuccuuuaugaagccaugcgcuucuccagcuuugugccugucacuauuccucaugccaccacugccaacaccucugucuugggcuaccacauucccaaggacacugugguuuuugucaaccaguggucugugaaucaugacccacugaaguggccuaacccggagaacuuugauccagcucgauucuuggacaaggacggccucaucaacaaggaccugaccagcagagugaugauuuuuucagugggcaaaaggcggugcauuggcgaagaacuuucuaagaugcagcuuuuucucuucaucuccauccuggcucaccagugcgauuucagggccaacccaaaugagccugcgaaaaugaauuucaguuauggucuaaccauuaaacccaagucauuuaaagucaaugucacucucagagaguccauggagcuccuugauagugcuguccaaaauuuacaagccaaggaaacuugccaauaa

SEQ ID NO: 1135 - RNA, 1632 nt, Artificial Sequence
  derived and/or modified sequence opt1 from CP1B1__Homo_sapiens__AAC50809
augggcaccagccugucccccaacgacccguggccccucaacccccugagcauccagcagaccacgcugcuccugcugcucuccgugcuggccaccguccacguggggcagcgccugcuccggcagcgccggcgccagcugcggagcgcgcccccgggccccuucgccuggccccugaucgggaacgccgccgccgugggccaggccgcgcaccucuccuucgcccgccuggcccggcgcuacggggacgucuuccagauccggcugggcagcugccccaucguggugcucaacggcgagcgcgccauccaccaggcgcugguccagcagggguccgccuucgccgaccggccggccuucgccagcuuccgcgugguguccggcgggcggagcauggcguucggccacuacuccgagcacuggaagguccagcgccgggccgcccacagcaugaugcgcaacuucuucacccggcagccccgcucccgccaggugcuggaggggcacgugcucagcgaggcccgggagcuggucgcccugcucgugcggggcuccgcggacggcgccuuccuggacccccgcccccugaccguggucgccguggccaacgugaugagcgccgucugcuucgggugccgcuacucccacgacgacccggaguuccgggagcuccugagccacaacgaggaguucggccgcacggugggggcgggcucccugguggacgucaugcccuggcuccaguacuuccccaaccccgugcggaccguguuccgcgaguucgagcagcugaaccggaacuucagcaacuucauccuggacaaguuccuccgccacugcgagagccugcggccgggcgccgcgccccgcgacaugauggacgccuucauccuguccgccgagaagaaggccgccggggacagccacggcgggggcgcccggcucgaccuggagaacguccccgccaccaucaccgacaucuucggggcgucccaggacacgcugagcaccgcccuccaguggcugcugcuccuguucacccgcuaccccgacgugcagacccggguccaggccgagcuggaccagguggugggccgcgaccggcucccgugcaugggcgaccagcccaaccugcccuacguccuggccuuccucuacgaggccaugcgcuucuccagcuucgugcccgugacgaucccgcacgcgaccaccgccaacaccuccguccugggguaccacauccccaaggacacggugguguucgucaaccaguggagcgugaaccacgacccccugaaguggcccaacccggagaacuucgaccccgcccgguuccucgacaaggacggccugaucaacaaggaccugaccucccgcgugaugaucuucagcgucgggaagcggcgcugcaucggcgaggagcuguccaagaugcagcuguuccucuucaucagcauccuggcccaccagugcgacuuccgggccaaccccaacgagccggcgaagaugaacuucuccuacgggcucaccaucaagcccaagagcuucaaggugaacgugacccugcgcgaguccauggagcugcucgacagcgccguccagaaccugcaggccaaggagacgugccaguga

SEQ ID NO: 1136 - RNA, 1632 nt, Artificial Sequence
  derived and/or modified sequence opt2 from CP1B1__Homo_sapiens__AAC50809
augggcaccucccucucccccaacgaccccuggccccucaacccccucuccauccagcagaccacccuccuccuccuccucuccguccucgccaccguccacgucggccagcgccuccuccgccagcgccgccgccagcuccgcuccgccccccccggccccuucgccuggccccucaucggcaacgccgccgccgucggccaggccgcccaccucuccuucgcccgccucgcccgccgcuacggcgacgucuuccagauccgccucggcuccugccccaucgucguccucaacggcgagcgcgccauccaccaggcccucguccagcagggcuccgccuucgccgaccgccccgccuucgccuccuuccgcgucgucuccggcggccgcuccauggccuucggccacuacuccgagcacuggaagguccagcgccgcgccgcccacuccaugaugcgcaacuucuucacccgccagccccgcucccgccagguccucgagggccacguccucuccgaggcccgcgagcucgucgcccuccucguccgcggcuccgccgacggcgccuuccucgacccccgcccccucaccgucgucgccgucgccaacgucauguccgccgucugcuucggcugccgcuacucccacgacgaccccgaguuccgcgagcuccucucccacaacgaggaguucggccgcaccgucggcgccggcucccucgucgacgucaugcccuggcuccaguacuuccccaaccccguccgcaccgucuuccgcgaguucgagcagcucaaccgcaacuucuccaacuucauccucgacaaguuccuccgccacugcgagucccuccgccccggcgccgccccccgcgacaugauggacgccuucauccucuccgccgagaagaaggccgccggcgacucccacggcggcggcgcccgccucgaccucgagaacguccccgccaccaucaccgacaucuucggcgccucccaggacacccucuccaccgcccuccaguggcuccuccuccucuucacccgcuaccccgacguccagacccgcguccaggccgagcucgaccaggucgucggccgcgaccgccuccccugcaugggcgaccagcccaaccuccccuacguccucgccuuccucuacgaggccaugcgcuucuccuccuucguccccgucaccaucccccacgccaccaccgccaacaccuccguccucggcuaccacauccccaaggacaccgucgucuucgucaaccagugguccgucaaccacgacccccucaaguggcccaaccccgagaacuucgaccccgcccgcuuccucgacaaggacggccucaucaacaaggaccucaccucccgcgucaugaucuucuccgucggcaagcgccgcugcaucggcgaggagcucuccaagaugcagcucuuccucuucaucuccauccucgcccaccagugcgacuuccgcgccaaccccaacgagcccgccaagaugaacuucuccuacggccucaccaucaagcccaaguccuucaaggucaacgucacccuccgcgaguccauggagcuccucgacuccgccguccagaaccuccaggccaaggagaccugccaguga

SEQ ID NO: 1137 - RNA, 1632 nt, Artificial Sequence
  derived and/or modified sequence opt3 from CP1B1__Homo_sapiens__AAC50809
augggcaccagccugucccccaacgacccuuggccacucaauccgcuuucuauccagcaaacaacucuguuguuacugcuaucagugcucgccacgguccacguugggcagagacugcuuaggcagcggcgccgacagcugcguagugcucccccuggaccauucgcauggcccuugauugguaacgccgcggcugugggccaagccgcacaucucagcuuugccagacuggcuaggcgguacggggauguauuccagauacgccugggauccugcccuaucgugguccucaauggcgagagagcaauucaccaggccuuagugcagcaagguucugcuuuugccgacaggccagcguucgcaucguuucggguugugucagggggacgcagcauggccuucggccauuauagugaacacuggaagguccagagacgagcugcccauuccaugaugaggaacuuuuucacccggcagccccguucucgccaggugcuggagggccacguacuuagcgaagcaagagaguugguugcucugcuagugaggggguccgccgauggagcguuucucgacccucggccacugacagucguggccguggcaaaugucaugucagcuguuuguuucgguugccgauacagucacgaugacccggaauuucgcgagcuucugagccauaacgaggaguucggcagaacugugggggccggaucuuugguagaugugaugcccuggcuccaauauuuuccuaauccagucaggaccguguuccgggaguucgaacagcugaaccgcaauuuuuccaacuucaucuuagacaaauuucugagacacugugagucacucaggcccggcgcugccccucgugauaugauggacgcauucauucuuagcgccgagaagaaagcugcgggugauagucaugggggaggcgcacggcuggacuuggaaaauguuccagccacaaucaccgauauauuuggcgcuucucaggacacucuauccacagcccugcaauggcuccugcuucuguucacccgauaccccgacgugcagacgagaguccaggcagaguuggaucaggugguagggagggaccgccucccgugcaugggagaucaaccuaaccugcccuauguuuuagccuuucuguacgaagcuaugcgguucagcucguuugugccagucacuaucccucacgccaccacagcaaauacuucugugcuagguuaucacauucccaaggacaccgucguguucguuaaccagugguccgugaaucaugauccacucaaauggcccaacccugagaacuuugacccagcgagauuccuggauaaggacggccuuaucaauaaggauuugacaucaaggguaaugauuuuuagugucgggaaacgccgauguaucggagaagaacugagcaagaugcaacucuuccuguucauauccauucuugcucaccagugcgacuuucgggccaacccgaaugagcccgcaaaaaugaacuucucuuacggccugaccaucaagccuaagagcuuuaaagugaauguuacguugcgugaaucaauggagcuccuggauagugccgugcagaacuuacaggcuaaggaaacuugucaguga

SEQ ID NO: 1138 - RNA, 1632 nt, Artificial Sequence
  derived and/or modified sequence opt4 from CP1B1__Homo_sapiens__AAC50809
augggcaccagccugagccccaacgaccccuggccccugaacccccugagcauccagcagaccacccugcugcugcugcugagcgugcuggccaccgugcacgugggccagagacugcugagacagagaagaagacagcugagaagcgccccccccggccccuucgccuggccccugaucggcaacgccgccgccgugggccaggccgcccaccugagcuucgccagacuggccagaagauacggcgacguguuccagaucagacugggcagcugccccaucguggugcugaacggcgagagagccauccaccaggcccuggugcagcagggcagcgccuucgccgacagacccgccuucgccagcuucagaguggugagcggcggcagaagcauggccuucggccacuacagcgagcacuggaaggugcagagaagagccgcccacagcaugaugagaaacuucuucaccagacagcccagaagcagacaggugcuggagggccacgugcugagcgaggccagagagcugguggcccugcuggugagaggcagcgccgacggcgccuuccuggaccccagaccccugaccgugguggccguggccaacgugaugagcgccgugugcuucggcugcagauacagccacgacgaccccgaguucagagagcugcugagccacaacgaggaguucggcagaaccgugggcgccggcagccugguggacgugaugcccuggcugcaguacuuccccaaccccgugagaaccguguucagagaguucgagcagcugaacagaaacuucagcaacuucauccuggacaaguuccugagacacugcgagagccugagacccggcgccgcccccagagacaugauggacgccuucauccugagcgccgagaagaaggccgccggcgacagccacggcggcggcgccagacuggaccuggagaacgugcccgccaccaucaccgacaucuucggcgccagccaggacacccugagcaccgcccugcaguggcugcugcugcuguucaccagauaccccgacgugcagaccagagugcaggccgagcuggaccagguggugggcagagacagacugcccugcaugggcgaccagcccaaccugcccuacgugcuggccuuccuguacgaggccaugagauucagcagcuucgugcccgugaccaucccccacgccaccaccgccaacaccagcgugcugggcuaccacauccccaaggacaccgugguguucgugaaccaguggagcgugaaccacgacccccugaaguggcccaaccccgagaacuucgaccccgccagauuccuggacaaggacggccugaucaacaaggaccugaccagcagagugaugaucuucagcgugggcaagagaagaugcaucggcgaggagcugagcaagaugcagcuguuccuguucaucagcauccuggcccaccagugcgacuucagagccaaccccaacgagcccgccaagaugaacuucagcuacggccugaccaucaagcccaagagcuucaaggugaacgugacccugagagagagcauggagcugcuggacagcgccgugcagaaccugcaggccaaggagaccugccaguga

SEQ ID NO: 1139 - RNA, 1632 nt, Artificial Sequence
  derived and/or modified sequence opt5 from CP1B1__Homo_sapiens__AAC50809
augggcaccagccugucccccaacgacccuuggccgcucaauccccugucuauccagcaaacaacgcuucugcuccugcuuagcgugcuggccaccguccacguugggcagagacuccugcggcagcgcagacggcagcugcgcuccgcuccucccggaccuuucgccuggccccucauuggcaacgcggcugccguggggcaagccgcucaucugucuuuugccagacuugcucggcgcuacggagauguguuccagaucagacugggcagcugcccuauugucgugcucaauggggagcgggccauccaccaggcgcugguucagcaaggauccgccuuugcugaccgcccggccuucgcuucuuuuagaguggucagcggcggccgguccauggccuucgggcauuauagcgaacacuggaaggugcagcgcagagcggcccauucuaugaugcggaacuuuuucacacgccagcccagaucccggcagguucuugagggacacgugcugagcgaagcuagagagcucgucgcccugcuggugcgcggcucugcugauggggccuuucucgacccucggccccugaccguggucgccguugcuaaugugauguccgcgguguguuucggaugcagauacagccacgaugacccugaauuucgcgagcuucugucucauaacgaggaguucggccggacagucggggccggaucccucguggauguuaugcccuggcugcaauauuuuccgaauccugugagaaccgucuuccgcgaguucgaacagcuuaaccggaauuuuagcaacuucauucuggacaaauuucucagacacugugagucccugcgccccggcgcugccccucgggauaugauggacgccuucauccugucugcugagaagaaagccgcgggcgauagccaugggggaggcgcuagacucgaccuggaaaaugugcccgccacaaucaccgauauuuuuggggccucccaggacacgcuuagcaccgcucugcaauggcuccugcuucuguucacacgcuaccccgacguucagacccgggugcaggccgagcucgaucaggucgugggaagagaccggcugccuugcaugggcgaucaaccgaaccugcccuauguccucgcuuuucuguacgaagccaugcgcuucucuuccuuugugccuguuacaaucccccacgcgaccacggccaauacaagcgugcuuggguaucacauuccuaaggacaccgucguguucguuaaccaguggucugugaaucaugauccccugaaauggccgaacccugagaacuuugaccccgcuagauuccucgauaaggacggacugaucaauaaggaucugacaagccgggucaugauuuuuagcgugggcaaaagacgcuguaucggcgaagaacuuucuaagaugcaacucuuccuguucauuagcauccuggcccaccagugcgacuuucgggcuaacccuaaugagcccgccaaaaugaacuucuccuacgggcucaccaucaagccuaaauccuuuaaggugaauguuacccugagagaaucuauggagcuucuggauuccgcgguccagaaccuccaggccaaggaaacaugucaguga

SEQ ID NO: 1140 - protein, 110 aa, Artificial Sequence
  CSAG2__Homo_sapiens__Q9Y5P2-2
MWMGLIQLVEGVKRKDQGFLEKEFYHKTNIKMRCEFLACWPAFTVLGEAWRDQVDWSRLLRDAGLVKMSRKPRASSPLSNNHPPTPKRFPRQPGREKGPIKEVPGTKGSP

SEQ ID NO: 1141 - RNA, 333 nt, Artificial Sequence
  CSAG2__Homo_sapiens__NM_001129828
auguggaugggccucauccaauuaguugaagguguuaagagaaaagaccaagguuuccuggaaaaggaauucuaccacaagacuaacauaaaaaugcgcugugaguuucuagccugcuggccugccuucacuguccugggggaggcuuggagagaccagguggacuggaguagacuguugagagacgcuggucuggugaagauguccaggaaaccacgagccuccagcccauuguccaacaaccacccaccaacaccaaagagguucccaagacaacccggaagggaaaagggacccaucaaggaaguuccaggaacaaaaggcucucccuaa

SEQ ID NO: 1142 - RNA, 333 nt, Artificial Sequence
  derived and/or modified sequence opt1 from CSAG2__Homo_sapiens__NM_001129828
auguggaugggccugauccagcucguggagggggucaagcgcaaggaccagggcuuccuggagaaggaguucuaccacaagaccaacaucaagaugcggugcgaguuccuggccugcuggcccgccuucaccgugcucggggaggcguggcgcgaccagguggacuggagccggcugcugcgcgacgccggccucgucaagaugucccggaagccgcgcgccagcagcccccuguccaacaaccacccgcccacgcccaagcgguucccccgccagcccgggcgggagaagggccccaucaaggaggugccgggcaccaaggggucccccuga

SEQ ID NO: 1143 - RNA, 333 nt, Artificial Sequence
  derived and/or modified sequence opt2 from CSAG2__Homo_sapiens__NM_001129828
auguggaugggccucauccagcucgucgagggcgucaagcgcaaggaccagggcuuccucgagaaggaguucuaccacaagaccaacaucaagaugcgcugcgaguuccucgccugcuggcccgccuucaccguccucggcgaggccuggcgcgaccaggucgacuggucccgccuccuccgcgacgccggccucgucaagaugucccgcaagccccgcgccuccuccccccucuccaacaaccacccccccacccccaagcgcuucccccgccagcccggccgcgagaagggccccaucaaggagguccccggcaccaagggcucccccuga

SEQ ID NO: 1144 - RNA, 333 nt, Artificial Sequence
  derived and/or modified sequence opt3 from CSAG2__Homo_sapiens__NM_001129828
auguggaugggccugauccagcucguggagggggucaagagaaaagaccaaggauuccuugaaaaggaguuuuaccacaaaaccaacauuaagaugaggugcgaguuccuggccuguuggcccgcuuuuacaguuuugggugaagcauggcgggaucagguggacuggagccgcuuacugcgagaugccggccuaguaaaaaugucccguaagccuagagcgucuucaccacucaguaauaaccauccgcccacuccuaagagguucccacggcagcccgggcgcgaaaaaggaccuauaaaggaggugccaggcacgaaagguagccccuga

SEQ ID NO: 1145 - RNA, 333 nt, Artificial Sequence
  derived and/or modified sequence opt4 from CSAG2__Homo_sapiens__NM_001129828
auguggaugggccugauccagcugguggagggcgugaagagaaaggaccagggcuuccuggagaaggaguucuaccacaagaccaacaucaagaugagaugcgaguuccuggccugcuggcccgccuucaccgugcugggcgaggccuggagagaccagguggacuggagcagacugcugagagacgccggccuggugaagaugagcagaaagcccagagccagcagcccccugagcaacaaccacccccccacccccaagagauuccccagacagcccggcagagagaagggccccaucaaggaggugcccggcaccaagggcagccccuga

SEQ ID NO: 1146 - RNA, 333 nt, Artificial Sequence
  derived and/or modified sequence opt5 from CSAG2__Homo_sapiens__NM_001129828
auguggaugggccugauccagcucguggagggggucaagagaaaagaccaaggauuccuggaaaaggaguuuuaccacaaaaccaacauuaagaugcggugcgaguuccuugccuguuggcccgcuuuuacaguucugggcgaagccuggcgcgaucagguggacuggagcagacuccugcgggaugcggggcuugugaaaaugucccgcaagccuagagcuucuagcccgcuguccaauaaccaucccccuacgcccaagcgguucccucgccagcccggaagagaaaaaggcccuaucaaggaggucccggggaccaaaggaucucccuga

SEQ ID NO: 1147 - protein, 127 aa, Artificial Sequence
  CSAG2__Homo_sapiens__Q9Y5P2
MWMGLIQLVEGVKRKDQGFLEKEFYHKTNIKMRCEFLACWPAFTVLGEAWRDQVDWSRLLRDAGLVKMSRKPRASSPLSNNHPPTPKRRGSGRHPLNPGPEALSKFPRQPGREKGPIKEVPGTKGSP

SEQ ID NO: 1148 - RNA, 384 nt, Artificial Sequence
  CSAG2__Homo_sapiens__NM_001129826
auguggaugggccucauccaauuaguugaagguguuaagagaaaagaccaagguuuccuggaaaaggaauucuaccacaagacuaacauaaaaaugcgcugugaguuucuagccugcuggccugccuucacuguccugggggaggcuuggagagaccagguggacuggaguagacuguugagagacgcuggucuggugaagauguccaggaaaccacgagccuccagcccauuguccaacaaccacccaccaacaccaaagaggcgaggaaguggaaggcauccucucaacccuggcccagaagcccuaucaaaguucccaagacaacccggaagggaaaagggacccaucaaggaaguuccaggaacaaaaggcucucccuaa

SEQ ID NO: 1149 - RNA, 384 nt, Artificial Sequence
  derived and/or modified sequence opt1 from CSAG2__Homo_sapiens__NM_001129826
auguggaugggccugauccagcucguggagggggucaagcgcaaggaccagggcuuccuggagaaggaguucuaccacaagaccaacaucaagaugcggugcgaguuccuggccugcuggcccgccuucaccgugcucggggaggcguggcgcgaccagguggacuggagccggcugcugcgcgacgccggccucgucaagaugucccggaagccgcgcgccagcagcccccuguccaacaaccacccgcccacgcccaagcggcgcggguccggccggcacccccugaaccccggccccgaggcccucagcaaguucccgcgccagcccgggcgggagaagggccccaucaaggaggugcccgggaccaagggcuccccguga

SEQ ID NO: 1150 - RNA, 384 nt, Artificial Sequence
  derived and/or modified sequence opt2 from CSAG2__Homo_sapiens__NM_001129826
auguggaugggccucauccagcucgucgagggcgucaagcgcaaggaccagggcuuccucgagaaggaguucuaccacaagaccaacaucaagaugcgcugcgaguuccucgccugcuggcccgccuucaccguccucggcgaggccuggcgcgaccaggucgacuggucccgccuccuccgcgacgccggccucgucaagaugucccgcaagccccgcgccuccuccccccucuccaacaaccacccccccacccccaagcgccgcggcuccggccgccacccccucaaccccggccccgaggcccucuccaaguucccccgccagcccggccgcgagaagggccccaucaaggagguccccggcaccaagggcucccccuga

SEQ ID NO: 1151 - RNA, 384 nt, Artificial Sequence
  derived and/or modified sequence opt3 from CSAG2__Homo_sapiens__NM_001129826
auguggaugggccugauccagcucguggagggggucaagagaaaagaccaaggauuccuugaaaaggaguuuuaccacaaaaccaacauuaagaugaggugcgaguuccuggccuguuggcccgcuuuuacaguuuugggugaagcauggcgggaucagguggacuggagccgcuuacugcgagaugccggccuaguaaaaaugucccguaagccuagagcgucuucaccacucaguaauaaccauccgcccacuccuaagaggcgggggagcggacgccacccacugaaucccggcccugaagcucuuuccaaauucccaagacagcccgguagggagaaggggccuauaaaagaggugccaggaacgaagggcucuccguga

SEQ ID NO: 1152 - RNA, 384 nt, Artificial Sequence
  derived and/or modified sequence opt4 from CSAG2__Homo_sapiens__NM_001129826
auguggaugggccugauccagcugguggagggcgugaagagaaaggaccagggcuuccuggagaaggaguucuaccacaagaccaacaucaagaugagaugcgaguuccuggccugcuggcccgccuucaccgugcugggcgaggccuggagagaccagguggacuggagcagacugcugagagacgccggccuggugaagaugagcagaaagcccagagccagcagcccccugagcaacaaccacccccccacccccaagagaagaggcagcggcagacacccccugaaccccggccccgaggcccugagcaaguuccccagacagcccggcagagagaagggccccaucaaggaggugcccggcaccaagggcagccccuga

SEQ ID NO: 1153 - RNA, 384 nt, Artificial Sequence
  derived and/or modified sequence opt5 from CSAG2__Homo_sapiens__NM_001129826
auguggaugggccugauccagcucguggagggggucaagagaaaagaccaaggauuccuggaaaaggaguuuuaccacaaaaccaacauuaagaugcggugcgaguuccuugccuguuggcccgcuuuuacaguucugggcgaagccuggcgcgaucagguggacuggagcagacuccugcgggaugcggggcuugugaaaaugucccgcaagccuagagcuucuagcccgcuguccaauaaccaucccccuacgcccaagcggcgcggaucuggcagacacccucucaaucccgggccugaagcccugagcaaauucccgcggcagcccggacgcgagaagggcccuaucaaagagguccccggcaccaagggguccccuuga

SEQ ID NO: 1154 - protein, 189 aa, Artificial Sequence
  CT45A1__Homo_sapiens__Q5HYN5
MTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 1155 - RNA, 570 nt, Artificial Sequence
  CT45A1__Homo_sapiens__AAI40914
augaccgauaaaacagagaagguggcuguagauccugaaacuguguuuaaacgucccagggaaugugacaguccuucguaucagaaaaggcagaggauggcccuguuggcaaggaaacaaggagcaggagacagccuuauugcaggcucugccauguccaaagcaaagaagcuuaugacaggacaugcuauuccacccagccaauuggauucucagauugaugacuucacugguuucagcaaagauaggaugaugcagaaaccugguagcaaugcaccugugggaggaaacguuaccagcaguuucucuggagaugaccuagaaugcagagaaacagccuccucucccaaaagccaacgagaaauuaaugcugauauaaaacguaaauuagugaaggaacuccgaugcguuggacaaaaauaugaaaaaaucuucgaaaugcuugaaggagugcaaggaccuacugcagucaggaagcgauuuuuugaauccaucaucaaggaagcagcaagauguaugagacgagacuuuguuaagcaccuuaagaagaaacugaaacguaugauuuga

SEQ ID NO: 1156 - RNA, 570 nt, Artificial Sequence
  derived and/or modified sequence opt1 from CT45A1__Homo_sapiens__AAI40914
augaccgacaagaccgagaagguggccgucgaccccgagacgguguucaagcgcccgcgggagugcgacagccccuccuaccagaagcgccagcggauggcccugcucgcgcgcaagcagggcgccggggacagccugaucgccggcuccgccaugagcaaggccaagaagcugaugaccgggcacgcgaucccgcccucccagcucgacagccagaucgacgacuucaccggcuucuccaaggaccggaugaugcagaagcccgggagcaacgcccccgugggcggcaacgucaccuccagcuucuccggggacgaccuggagugccgcgagacggccagcucccccaagagccagcgggagaucaacgccgacaucaagcgcaagcuggugaaggagcuccggugcgugggccagaaguacgagaagaucuucgagaugcuggaggggguccagggccccaccgcggugcgcaagcgguucuucgaguccaucaucaaggaggccgcccgcugcaugcggcgcgacuucgugaagcaccugaagaagaagcucaagcggaugaucuga

SEQ ID NO: 1157 - RNA, 570 nt, Artificial Sequence
  derived and/or modified sequence opt2 from CT45A1__Homo_sapiens__AAI40914
augaccgacaagaccgagaaggucgccgucgaccccgagaccgucuucaagcgcccccgcgagugcgacucccccuccuaccagaagcgccagcgcauggcccuccucgcccgcaagcagggcgccggcgacucccucaucgccggcuccgccauguccaaggccaagaagcucaugaccggccacgccaucccccccucccagcucgacucccagaucgacgacuucaccggcuucuccaaggaccgcaugaugcagaagcccggcuccaacgcccccgucggcggcaacgucaccuccuccuucuccggcgacgaccucgagugccgcgagaccgccuccucccccaagucccagcgcgagaucaacgccgacaucaagcgcaagcucgucaaggagcuccgcugcgucggccagaaguacgagaagaucuucgagaugcucgagggcguccagggccccaccgccguccgcaagcgcuucuucgaguccaucaucaaggaggccgcccgcugcaugcgccgcgacuucgucaagcaccucaagaagaagcucaagcgcaugaucuga

SEQ ID NO: 1158 - RNA, 570 nt, Artificial Sequence
  derived and/or modified sequence opt3 from CT45A1__Homo_sapiens__AAI40914
augaccgacaagacagagaaaguggccgucgaucccgaaacuguuuucaagagaccuagggagugcgacagcccauccuaccagaaacggcaacgcauggcucugcucgcacgaaagcagggcgccggggauucucuuaucgcgggaucagcuaugaguaaagccaagaagcugaugacgggucacgcaauuccgcccagccaguuggacucccagauagaugacuuuaccggcuucucuaaagaucguaugaugcaaaagccugggucgaacgccccagugggaggcaauguaacaagcucauuuaguggugacgauuuagaauguagagagacugcuuccucucccaaaagccagagggaaaucaacgcagacauuaagcggaaacuggugaaggagcuacgcugcgucgggcagaaguaugagaaaaucuucgaaaugcucgagggagugcagggcccuaccgccguuagaaagagguuuuucgaauccauuaucaaagaggcugcccgguguaugcgccgagauuuugugaagcaucugaaaaagaaacuuaagagaaugauauga

SEQ ID NO: 1159 - RNA, 570 nt, Artificial Sequence
  derived and/or modified sequence opt4 from CT45A1__Homo_sapiens__AAI40914
augaccgacaagaccgagaagguggccguggaccccgagaccguguucaagagacccagagagugcgacagccccagcuaccagaagagacagagaauggcccugcuggccagaaagcagggcgccggcgacagccugaucgccggcagcgccaugagcaaggccaagaagcugaugaccggccacgccaucccccccagccagcuggacagccagaucgacgacuucaccggcuucagcaaggacagaaugaugcagaagcccggcagcaacgcccccgugggcggcaacgugaccagcagcuucagcggcgacgaccuggagugcagagagaccgccagcagccccaagagccagagagagaucaacgccgacaucaagagaaagcuggugaaggagcugagaugcgugggccagaaguacgagaagaucuucgagaugcuggagggcgugcagggccccaccgccgugagaaagagauucuucgagagcaucaucaaggaggccgccagaugcaugagaagagacuucgugaagcaccugaagaagaagcugaagagaaugaucuga

SEQ ID NO: 1160 - RNA, 570 nt, Artificial Sequence
  derived and/or modified sequence opt5 from CT45A1__Homo_sapiens__AAI40914
augaccgacaagacagagaaaguggccgucgaucccgaaacgguuuucaagagaccucgggagugcgacagcccguccuaccagaaacgccaaagaauggcucugcucgcccggaagcagggcgcgggggauucucugaucgcuggaagcgccauguccaaagccaagaaacuuaugaccggccacgcuauucccccuucucagcuggacagccagaucgaugacuuuacaggguucuccaaggaucgcaugaugcaaaagcccggaucuaacgccccugugggcgggaaugugaccagcuccuuuagcggagacgaucucgaauguagagagacagcuucuucccccaaaagccagcgggaaauuaacgccgacaucaagcgcaaacuggucaaggagcuuagaugcgugggccagaaguaugagaaaauuuucgaaaugcuggagggcguucaggggccuaccgcggugcggaagcgcuuuuucgaaucuaucaucaaagaggccgcuagauguaugcggcgcgauuuugucaagcaucucaaaaagaaacugaagagaaugauuuga

SEQ ID NO: 1161 - protein, 264 aa, Artificial Sequence
  CT55__Homo_sapiens__Q8WUE5
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKSSSGFQDDGGLGRPKRERRSQSI

SEQ ID NO: 1162 - RNA, 795 nt, Artificial Sequence
  CT55__Homo_sapiens__AAH20662
augcucaggcuucugagacuugcuuuggccuucuacgggaggacggccgacccugcagagcgacagggcccacagcagcagggccucccacaaggugacacccaguugacaacugugcagggaguugucacaaguuucuguggugauuauggcaugauugaugagucgaucuacuucaguagugauguugugacuggcaacgugccucuaaaaguuggacaaaaaguuaaugugguuguggaagaagauaaaccacauuauggauugagagcaaucaagguggauguugugccucgccaucuuuauggugcuggacccucagacucaggaaccagaguuuuaauuggauguguuacuucuauaaaugaagauaauauuuauauuaguaacagcauuuauuuuuccauagccauuguuucugaagauuuugugccuuauaagggugacuuguuagaaguugaauauuccacugagccaggcaucucaaacaucaaggcaacuucugugaagcccauccguuguauucauacggaagaggucugcauuacuagcguacauggaagaaauggggugauagauuauacuauuuuuuucaccuuggauucugugaaacuuccugauggauacguaccucaaguagaugauaucgucaauguggucaugguggagagcauucaguucugcuuuauuuggagagcgauuucuaucaccccagugcauaaauccagcagcggauuccaggaugacggaggccugggacggcccaaaagggaacgucggagccaaagcauuuaa

SEQ ID NO: 1163 - RNA, 795 nt, Artificial Sequence
  derived and/or modified sequence opt1 from CT55__Homo_sapiens__AAH20662
augcugcgccuccugcggcuggcccucgccuucuacggccgcaccgcggaccccgccgagcggcaggggccgcagcagcagggccugccccagggggacacccagcugacgaccgugcagggcgucgugaccagcuucugcggggacuacggcaugaucgacgaguccaucuacuucagcuccgacguggucaccggcaacgugccccucaagguggggcagaaggucaacgugguggucgaggaggacaagccccacuacggccugcgcgccaucaagguggacguggucccgcggcaccuguacggggccggccccagcgacuccgggacgcgcgugcucaucggcugcgugaccagcaucaacgaggacaacaucuacaucuccaacagcaucuacuucuccaucgccaucgucagcgaggacuucgugcccuacaagggcgaccugcuggagguggaguacuccaccgagcccgggaucagcaacaucaaggcgaccuccgucaagccgauccggugcauccacacggaggaggugugcaucaccagcgugcacggccgcaacggggucaucgacuacaccaucuucuucacccucgacuccgugaagcugcccgacggcuacgugccccaggucgacgacaucgugaacgucgugaugguggagagcauccaguucugcuucaucuggcgggccaucuccaucacgcccguccacaagagcuccagcggcuuccaggacgacgggggccuggggcgcccgaagcgggagcgccggagccaguccaucuga

SEQ ID NO: 1164 - RNA, 795 nt, Artificial Sequence
  derived and/or modified sequence opt2 from CT55__Homo_sapiens__AAH20662
augcuccgccuccuccgccucgcccucgccuucuacggccgcaccgccgaccccgccgagcgccagggcccccagcagcagggccucccccagggcgacacccagcucaccaccguccagggcgucgucaccuccuucugcggcgacuacggcaugaucgacgaguccaucuacuucuccuccgacgucgucaccggcaacgucccccucaaggucggccagaaggucaacgucgucgucgaggaggacaagccccacuacggccuccgcgccaucaaggucgacgucgucccccgccaccucuacggcgccggccccuccgacuccggcacccgcguccucaucggcugcgucaccuccaucaacgaggacaacaucuacaucuccaacuccaucuacuucuccaucgccaucgucuccgaggacuucguccccuacaagggcgaccuccucgaggucgaguacuccaccgagcccggcaucuccaacaucaaggccaccuccgucaagcccauccgcugcauccacaccgaggaggucugcaucaccuccguccacggccgcaacggcgucaucgacuacaccaucuucuucacccucgacuccgucaagcuccccgacggcuacgucccccaggucgacgacaucgucaacgucgucauggucgaguccauccaguucugcuucaucuggcgcgccaucuccaucacccccguccacaaguccuccuccggcuuccaggacgacggcggccucggccgccccaagcgcgagcgccgcucccaguccaucuga

SEQ ID NO: 1165 - RNA, 795 nt, Artificial Sequence
  derived and/or modified sequence opt3 from CT55__Homo_sapiens__AAH20662
augcugagacuccuuaggcuggccuuggcuuucuacggccggaccgcagaccccgccgagcgccaggggccucaacagcagggauuaccacagggugauacacaacugacuacggugcagggcgucguuaccagcuuuugcggggacuauggaaugaucgaugaauccauuuacuucucuucagacgugguaacaggcaacgugccgcuaaaggucggucagaaagugaauguuguggucgaggaagauaagccccacuaugggcuccgagcgauaaaaguggacguaguuccucgucaucuguacggagcuggcccaagugauagcggcacuagagugcuuaucgggugugucaccuccauuaacgaggacaauaucuauauuucuaacucgaucuacuuuucaauagccaucgugagcgaagauuucgugcccuauaagggagaccuguuggaggucgaguacaguacagaaccugguauuuccaauaucaaagcaaccucuguuaagccaauuaggugcauccacacugaggaaguguguauaacaagcguacauggccggaacggggugauugauuacaccaucuuuuucacgcucgacuccgucaagcugcccgauggauaugugccucagguugacgacauugugaaugucgugaugguagagucaauccaauuuugcuucaucuggcgcgccauuaguauaacuccaguucacaaaucuagcuccggcuuucaggaugacggugggcugggaagaccgaagagggagcggcgcucacagagcaucuga

SEQ ID NO: 1166 - RNA, 795 nt, Artificial Sequence
  derived and/or modified sequence opt4 from CT55__Homo_sapiens__AAH20662
augcugagacugcugagacuggcccuggccuucuacggcagaaccgccgaccccgccgagagacagggcccccagcagcagggccugccccagggcgacacccagcugaccaccgugcagggcguggugaccagcuucugcggcgacuacggcaugaucgacgagagcaucuacuucagcagcgacguggugaccggcaacgugccccugaaggugggccagaaggugaacguggugguggaggaggacaagccccacuacggccugagagccaucaagguggacguggugcccagacaccuguacggcgccggccccagcgacagcggcaccagagugcugaucggcugcgugaccagcaucaacgaggacaacaucuacaucagcaacagcaucuacuucagcaucgccaucgugagcgaggacuucgugcccuacaagggcgaccugcuggagguggaguacagcaccgagcccggcaucagcaacaucaaggccaccagcgugaagcccaucagaugcauccacaccgaggaggugugcaucaccagcgugcacggcagaaacggcgugaucgacuacaccaucuucuucacccuggacagcgugaagcugcccgacggcuacgugccccagguggacgacaucgugaacguggugaugguggagagcauccaguucugcuucaucuggagagccaucagcaucacccccgugcacaagagcagcagcggcuuccaggacgacggcggccugggcagacccaagagagagagaagaagccagagcaucuga

SEQ ID NO: 1167 - RNA, 795 nt, Artificial Sequence
  derived and/or modified sequence opt5 from CT55__Homo_sapiens__AAH20662
augcugagacuccugcggcuugcccuggcuuucuacggccgcaccgccgaccccgcggagagacaggggccucaacagcagggacucccgcagggcgauacacaacugacgaccgugcagggggucguuaccagcuuuugcggagacuauggcaugaucgaugaauccauuuacuucucuagcgacguggugacagggaacgucccccuuaaggugggacagaaaguuaauguggucguggaggaagauaagccucacuauggccugcgggcuaucaaaguugacguggucccccgccaucucuacggcgccgggccuuccgauucuggaacaagagugcugauuggcugugugaccagcaucaacgaggacaauauuuauaucuccaacucuaucuacuuuagcauugccaucgucuccgaagauuucguucccuauaagggggaccugcucgagguggaguacagcacagaaccuggaauuucuaauaucaaagcuaccuccgugaagccgauucggugcauccacacggaggaagucuguauuaccagcgugcauggccgcaacgggguuaucgauuacacaaucuuuuucacccuggacucugugaaacuucccgauggauaugucccucagguggacgacauuguuaauguggucaugguggaguccauccaauuuugcuucauuuggagagccaucagcauuacacccguccacaagucuuccagcggcuuucaggaugacggcgggcugggacggccuaagcgcgagagacggucccagucuaucuga

SEQ ID NO: 1168 - protein, 947 aa, Artificial Sequence
  CT-_9/BRD6__Homo_sapiens__Q58F21
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 1169 - RNA, 2844 nt, Artificial Sequence
  CT-_9/BRD6__Homo_sapiens__CCDS735.1
augucucugccaagucgacaaacagcuauuauuguuaacccuccuccaccagaauauauaaauacuaagaaaaaugggcgauugacaaaucaacuucaguaucuacaaaaaguuguccuaaaggauuuauggaagcauaguuuuucauggcccuuucaacguccuguggaugcugugaaacuacaguugccugauuauuauaccauuauaaaaaacccaauggauuuaaauacaauuaagaagcgcuuggagaauaaauauuaugcgaaggcuucagaauguauagaagacuucaauacaauguucucaaauuguuauuuauauaacaagccuggagaugacauuguucuuauggcacaagcucuagagaagcuguuuaugcagaaauuaucucagaugccacaagaagagcaaguuguggguguuaaggaaagaaucaagaaaggcacucaacagaauauagcuguuucuucugcuaaagaaaaaucaucacccagcgcaacagaaaaaguauuuaagcagcaagaaauuccuucuguauuuccuaagacaucuauuucucccuugaacgugguacagggagcuucagucaacuccaguucacaaacugcggcccaaguuacaaaaggugugaagaggaaagcagauacaacaacuccugcaacuucagcaguuaaagcaaguagugaauuuucuccaacauucacagaaaaaucaguggcacugccaccuauaaaagaaaauaugccaaagaauguuuugccagauucucagcaacaauauaauguugugaagacuguuaaaguaacugaacaauuaaggcacuguagugagauucuuaaagaaaugcuugcaaagaaacauuuuucauaugcauggcccuuuuauaauccuguugacguuaaugcuuugggacuccauaacuacuaugacguugucaaaaauccgauggaucuuggaacuauuaaggagaaaauggauaaccaagaauauaaggaugcauacaaauuugcggcagauguuagauuaauguucaugaauugcuacaaguacaauccuccagaucacgaaguugugacaauggcaagaaugcuucaggauguuuucgaaacgcauuuuucaaagaucccgauugaaccuguugagaguaugccuuuauguuacaucaaaacagauaucacagaaaccacugguagagagaacacuaaugaagccuccucugaagggaacucuucugaugauucugaagaugagcgaguuaagcgucuugcaaagcuucaggagcagcuuaaagcuguacaucaacagcuccagguuuugucccaaguaccuuuccguaagcuaaauaaaaagaaagagaagucuaaaaaggaaaagaaaaaagaaaagguuaauaacagcaaugaaaauccaagaaaaaugugugagcaaaugaggcuaaaggaaaaguccaagagaaaucagccaaagaaaaggaaacaacaguucauuggucuaaaaucugaagaugaagauaaugcuaaaccuaugaacuaugaugagaaaaggcaguuaagucugaauauaaacaaacucccuggagauaaacuugggcgaguaguucacauaauacaaucaagagagccuucucugagcaauuccaauccugaugagauagagauagacuuugaaacacugaaagcaucaacacuaagagaauuagaaaaauauguuucggcaugucuaagaaagagaccauuaaaaccuccugcuaagaaaauaaugauguccaaagaagaacuucacucacagaaaaaacaggaauuggaaaagcgguuacuggauguuaauaaucaguuaaauucuagaaaacgucaaacaaaaucugauaaaacgcaaccauccaaagcuguugaaaauguuucccgacugagugagagcagcagcagcagcagcagcucaucagagucugaaaguagcagcagugacuuaagcucuucagacagcagugauucugaaucagaaauguucccuaaguuuacagaaguaaaaccaaaugauucuccuucuaaagagaauguaaagaaaaugaagaaugaaugcauaccgccugaaggaagaacaggcgucacacagauaggauauugugugcaagacacaaccucugccaauacuacccuuguucaucagaccacaccuucacauguaaugccaccaaaucaccaccaauuagcauuuaauuaucaagaauuagaacauuuacagacugugaaaaacauuucaccuuuacaaauucugccucccucaggugauucugaacagcucucaaauggcauaacugugaugcauccaucuggugauagugacacaacgauguuagaaucugaaugucaagcuccuguacagaaggauauaaagauuaagaaugcagauucauggaaaaguuuaggcaaaccagugaaaccaucagguguaaugaaauccucagaugagcucuucaaccaauuuagaaaagcagccauagaaaaggaaguaaaagcucggacacaggaacucauacggaagcauuuggaacaaaauacaaaggaacuaaaagcaucucaagaaaaucagagggaucuugggaauggauugacuguagaaucuuuuucaaauaaaauacaaaacaagugcucuggagaagagcagaaagaacaucagcagucaucagaagcucaagauaaauccaaacucuggcuucucaaagaccgugauuuagcaaggcagaaagaacaagagaggaggaggagagaagcaaugguggguaccauugauaugacccuucaaagugacauuaugacaauguuugaaaacaacuuugauuaa

SEQ ID NO: 1170 - RNA, 2844 nt, Artificial Sequence
  derived and/or modified sequence opt1 from CT-_9/BRD6__Homo_sapiens__CCDS735.1
augagccugcccucccgccagaccgccaucaucgugaacccgcccccccccgaguacaucaacaccaagaagaacggccggcucacgaaccagcugcaguaccugcagaaggucgugcucaaggaccuguggaagcacagcuucuccuggccguuccagcgccccguggacgccgucaagcugcagcuccccgacuacuacaccaucaucaagaaccccauggaccugaacaccaucaagaagcggcuggagaacaaguacuacgcgaaggccagcgagugcaucgaggacuucaacaccauguucuccaacugcuaccucuacaacaagccgggggacgacaucgugcugauggcccaggcccuggagaagcucuucaugcagaagcugagccagaugccccaggaggagcagguggucggcgugaaggagcgcaucaagaaggggacgcagcagaacaucgccguguccagcgcgaaggagaaguccagccccuccgccaccgagaaggucuucaagcagcaggagauccccagcguguucccgaagaccuccaucagcccccugaacgugguccagggcgccuccgugaacagcuccagccagaccgccgcgcaggugacgaagggggucaagcggaaggccgacaccaccacccccgccacguccgccgugaaggccagcagcgaguucucccccaccuucaccgagaagagcguggcgcucccgcccaucaaggagaacaugcccaagaacguccugcccgacucccagcagcaguacaacguggugaagaccgucaaggugacggagcagcugcgccacugcagcgagauccucaaggagaugcuggccaagaagcacuucuccuacgccuggccguucuacaaccccguggacgucaacgcccugggccuccacaacuacuacgacguggucaagaaccccauggaccugggcaccaucaaggagaagauggacaaccaggaguacaaggacgccuacaaguucgcggccgacgugcggcugauguucaugaacugcuacaaguacaaccccccggaccacgagguggucaccauggcccgcaugcuccaggacguguucgagacccacuucagcaagauccccaucgagcccguggaguccaugccccugugcuacaucaagacggacaucaccgagaccaccgggcgggagaacacgaacgaggccagcuccgagggcaacagcuccgacgacagcgaggacgagcgcgucaagcggcuggccaagcuccaggagcagcugaaggcggugcaccagcagcugcaggugcucucccaggucccguuccgcaagcugaacaagaagaaggagaagagcaagaaggagaagaagaaggagaaggugaacaacuccaacgagaacccccggaagaugugcgagcagaugcgccugaaggagaagagcaagcggaaccagcccaagaagcgcaagcagcaguucaucgggcucaaguccgaggacgaggacaacgccaagccgaugaacuacgacgagaagcggcagcugagccugaacaucaacaagcuccccggcgacaagcuggggcgcgugguccacaucauccagucccgggagcccagccugagcaacuccaaccccgacgagaucgagaucgacuucgagacccucaaggccagcacccugcgcgagcuggagaaguacguguccgccugccuccggaagcgcccgcugaagccccccgccaagaagaucaugaugagcaaggaggagcugcacucccagaagaagcaggagcucgagaagcgccugcuggacgugaacaaccagcucaacagccggaagcgccagaccaaguccgacaagacgcagcccagcaaggcggucgagaacgugucccggcugagcgaguccagcuccagcuccagcuccagcagcgaguccgagagcuccagcuccgaccugagcuccagcgacuccagcgacuccgagagcgagauguucccgaaguucaccgaggugaagcccaacgacucccccagcaaggagaacgucaagaagaugaagaacgagugcauccccccggagggccgcaccggcgugacccagaucggguacugcgugcaggacacgaccuccgccaacaccacccugguccaccagacgacccccagccacgugaugccccccaaccaccaccagcucgccuucaacuaccaggagcuggagcaccugcagaccgugaagaacaucuccccgcuccagauccugccccccagcggcgacuccgagcagcugagcaacgggaucaccgucaugcaccccagcggcgacuccgacaccacgaugcucgagagcgagugccaggccccggugcagaaggacaucaagaucaagaacgcggacuccuggaagagccugggcaagcccgugaagcccuccggggucaugaagagcuccgacgagcuguucaaccaguuccggaaggccgccaucgagaaggaggugaaggcccgcacccaggagcucauccggaagcaccuggagcagaacaccaaggagcugaaggccagccaggagaaccagcgcgaccucggcaacgggcugaccguggaguccuucagcaacaagauccagaacaagugcuccggcgaggagcagaaggagcaccagcagagcuccgaggcgcaggacaagagcaagcuguggcuccugaaggaccgggaccuggcccgccagaaggagcaggagcggcgccggcgcgaggccauggucgggacgaucgacaugacccuccaguccgacaucaugaccauguucgagaacaacuucgacuga

SEQ ID NO: 1171 - RNA, 2844 nt, Artificial Sequence
  derived and/or modified sequence opt2 from CT-_9/BRD6__Homo_sapiens__CCDS735.1
augucccuccccucccgccagaccgccaucaucgucaacccccccccccccgaguacaucaacaccaagaagaacggccgccucaccaaccagcuccaguaccuccagaaggucguccucaaggaccucuggaagcacuccuucuccuggcccuuccagcgccccgucgacgccgucaagcuccagcuccccgacuacuacaccaucaucaagaaccccauggaccucaacaccaucaagaagcgccucgagaacaaguacuacgccaaggccuccgagugcaucgaggacuucaacaccauguucuccaacugcuaccucuacaacaagcccggcgacgacaucguccucauggcccaggcccucgagaagcucuucaugcagaagcucucccagaugccccaggaggagcaggucgucggcgucaaggagcgcaucaagaagggcacccagcagaacaucgccgucuccuccgccaaggagaaguccucccccuccgccaccgagaaggucuucaagcagcaggagauccccuccgucuuccccaagaccuccaucuccccccucaacgucguccagggcgccuccgucaacuccuccucccagaccgccgcccaggucaccaagggcgucaagcgcaaggccgacaccaccacccccgccaccuccgccgucaaggccuccuccgaguucucccccaccuucaccgagaaguccgucgcccucccccccaucaaggagaacaugcccaagaacguccuccccgacucccagcagcaguacaacgucgucaagaccgucaaggucaccgagcagcuccgccacugcuccgagauccucaaggagaugcucgccaagaagcacuucuccuacgccuggcccuucuacaaccccgucgacgucaacgcccucggccuccacaacuacuacgacgucgucaagaaccccauggaccucggcaccaucaaggagaagauggacaaccaggaguacaaggacgccuacaaguucgccgccgacguccgccucauguucaugaacugcuacaaguacaacccccccgaccacgaggucgucaccauggcccgcaugcuccaggacgucuucgagacccacuucuccaagauccccaucgagcccgucgaguccaugccccucugcuacaucaagaccgacaucaccgagaccaccggccgcgagaacaccaacgaggccuccuccgagggcaacuccuccgacgacuccgaggacgagcgcgucaagcgccucgccaagcuccaggagcagcucaaggccguccaccagcagcuccagguccucucccagguccccuuccgcaagcucaacaagaagaaggagaaguccaagaaggagaagaagaaggagaaggucaacaacuccaacgagaacccccgcaagaugugcgagcagaugcgccucaaggagaaguccaagcgcaaccagcccaagaagcgcaagcagcaguucaucggccucaaguccgaggacgaggacaacgccaagcccaugaacuacgacgagaagcgccagcucucccucaacaucaacaagcuccccggcgacaagcucggccgcgucguccacaucauccagucccgcgagcccucccucuccaacuccaaccccgacgagaucgagaucgacuucgagacccucaaggccuccacccuccgcgagcucgagaaguacgucuccgccugccuccgcaagcgcccccucaagccccccgccaagaagaucaugauguccaaggaggagcuccacucccagaagaagcaggagcucgagaagcgccuccucgacgucaacaaccagcucaacucccgcaagcgccagaccaaguccgacaagacccagcccuccaaggccgucgagaacgucucccgccucuccgaguccuccuccuccuccuccuccuccuccgaguccgaguccuccuccuccgaccucuccuccuccgacuccuccgacuccgaguccgagauguuccccaaguucaccgaggucaagcccaacgacucccccuccaaggagaacgucaagaagaugaagaacgagugcaucccccccgagggccgcaccggcgucacccagaucggcuacugcguccaggacaccaccuccgccaacaccacccucguccaccagaccacccccucccacgucaugccccccaaccaccaccagcucgccuucaacuaccaggagcucgagcaccuccagaccgucaagaacaucuccccccuccagauccucccccccuccggcgacuccgagcagcucuccaacggcaucaccgucaugcaccccuccggcgacuccgacaccaccaugcucgaguccgagugccaggcccccguccagaaggacaucaagaucaagaacgccgacuccuggaagucccucggcaagcccgucaagcccuccggcgucaugaaguccuccgacgagcucuucaaccaguuccgcaaggccgccaucgagaaggaggucaaggcccgcacccaggagcucauccgcaagcaccucgagcagaacaccaaggagcucaaggccucccaggagaaccagcgcgaccucggcaacggccucaccgucgaguccuucuccaacaagauccagaacaagugcuccggcgaggagcagaaggagcaccagcaguccuccgaggcccaggacaaguccaagcucuggcuccucaaggaccgcgaccucgcccgccagaaggagcaggagcgccgccgccgcgaggccauggucggcaccaucgacaugacccuccaguccgacaucaugaccauguucgagaacaacuucgacuga

SEQ ID NO: 1172 - RNA, 2844 nt, Artificial Sequence
  derived and/or modified sequence opt3 from CT-_9/BRD6__Homo_sapiens__CCDS735.1
augagccugcccuccagacagaccgccaucauugugaacccuccaccgcccgaguacauaaauacaaagaaaaacggcaggcucacuaaucaacuucaguaucugcagaaggucguuuugaaagacuuauggaagcacucuuucucauggccuuuucagcggccaguggaugcuguaaaacugcaacuacccgacuacuauacgaucauuaagaacccuauggaucucaauaccaucaagaaacgccuggaaaacaaguacuaugcaaaagccagugagugcauugaagacuucaauacaauguuuagcaacuguuaccuuuauaauaagccaggggaugacaucgugcugauggcgcaggcuuuggagaaacucuucaugcagaagcugucccagaugccccaagaagaacaggucgugggaguuaaggagcgaaucaaaaaggguacucagcagaacauagccgugucuucggcaaaagaaaagucaagcccuagugccaccgagaaagucuuuaagcaacaggaaauuccauccguguucccgaaaacaucuaucagcccccugaauguaguucagggcgcuuccgugaacucaaguagccaaaccgcagcccaggucacuaagggggugaagcguaaagcugauacaaccacgccugccacuucugcggugaaggcauccucagaguuuagcccaaccuucacagagaaaagugucgcccucccaccuauuaaggaaaauaugcccaaaaacguuuuacccgacucucagcagcaauacaaugugguaaagacugugaaggucaccgagcagcugagacauugcuccgaaauccuuaaagagauguuggcuaagaaacacuuuagcuacgccuggccguucuauaacccuguggauguuaacgcacugggacuacauaauuacuaugacguggucaagaaccccauggaucucggcacaauaaaagaaaagauggacaaucaggaguacaaggaugcuuauaaauuugccgcggacgugaggcugauguucaugaacuguuacaaguauaauccaccugaccacgagguaguuaccauggcccggaugcuucaggauguguuugaaacgcauuucucgaaaauucccaucgagccagucgaaucuaugccccugugcuacauuaagacugacaucacagagaccacuggucgcgaaaacacaaaugaggcauccucagaggggaacaguagcgaugacuccgaagaugagagagugaaaagguuggcuaagcuccaagaacagcugaaggccguccaccagcaguuacaagugcugucucagguuccuuuccggaaacucaauaagaaaaaggagaaaagcaagaaagaaaagaagaaagagaaggugaacaauucaaacgagaauccacgcaaaaugugugaacagaugcgacuuaaggagaaaaguaagagaaaccagccgaagaaaaggaagcaacaguuuaucggacugaaauccgaagacgaggauaaugcuaagcccaugaacuacgacgagaaacggcaguugagccuaaacauuaauaagcugccuggcgauaagcucggccguguaguccacauaauccaaucucgcgaaccaucacugaguaacagcaaucccgacgagauugaaaucgauuucgagacccuuaaagccuccacgcugagagaauuggagaaguaugugucugcaugccucaggaaacggccucugaagccacccgccaaaaagauaaugaugucgaaggaggaauuacauagccagaaaaagcaggagcuggaaaaacgacuacucgacguuaacaaucagcugaacucccgcaagagacaaaccaaaucagacaagacacagccgaguaaagcuguggagaaugucucuaggcuuagcgaauccucaagcagcuccaguucuucuuccgagucagagaguagcucguccgauuugucuagcucagacaguuccgauucugaaagcgagauguuuccuaaguucacugaagugaagccaaacgacucccccucaaaagagaauguaaagaaaaugaagaacgaauguauuccucccgaggggcggaccggagugacacagaucgguuacugcguucaggauacuaccagcgcgaauacaacccugguccaccaaacuacgccaagucaugugaugccucccaaccaccaccagcucgcauuuaauuaucaggagcuggaacaucuucagacagugaaaaacaucucuccacugcaaauuuugccgccuuccggcgacagcgagcagcucucgaaugggaucaccgucaugcaccccucaggagauucugacacuaccaugcuggaaagugagugucaggccccaguucaaaaggauauuaagaucaaaaacgcugacuccuggaagucuuuaggcaaacccgugaagccuagcggugugaugaaaagcuccgaugagcuguucaaccaguuucgcaaggccgcaauagaaaaggagguaaaagccagaacacaggaacuaauuaggaagcaucucgagcagaauaccaaagaacugaaggcuucacaagagaaccagcgugaccuugggaauggauugacugucgagaguuucagcaacaaaauccagaauaagugcucuggcgaggagcagaaggaacaccaacaguccucagaggcccaggauaaaaguaagcuguggcuccugaaagaccgggacuuagcacgacagaaggaacaagagagaaggcgccgggaggcgauggugggcacaaucgauaugacgcugcagagcgacauuaugaccauguuugaaaacaauuucgauuga

SEQ ID NO: 1173 - RNA, 2844 nt, Artificial Sequence
  derived and/or modified sequence opt4 from CT-_9/BRD6__Homo_sapiens__CCDS735.1
augagccugcccagcagacagaccgccaucaucgugaacccccccccccccgaguacaucaacaccaagaagaacggcagacugaccaaccagcugcaguaccugcagaagguggugcugaaggaccuguggaagcacagcuucagcuggcccuuccagagacccguggacgccgugaagcugcagcugcccgacuacuacaccaucaucaagaaccccauggaccugaacaccaucaagaagagacuggagaacaaguacuacgccaaggccagcgagugcaucgaggacuucaacaccauguucagcaacugcuaccuguacaacaagcccggcgacgacaucgugcugauggcccaggcccuggagaagcuguucaugcagaagcugagccagaugccccaggaggagcagguggugggcgugaaggagagaaucaagaagggcacccagcagaacaucgccgugagcagcgccaaggagaagagcagccccagcgccaccgagaagguguucaagcagcaggagauccccagcguguuccccaagaccagcaucagcccccugaacguggugcagggcgccagcgugaacagcagcagccagaccgccgcccaggugaccaagggcgugaagagaaaggccgacaccaccacccccgccaccagcgccgugaaggccagcagcgaguucagccccaccuucaccgagaagagcguggcccugccccccaucaaggagaacaugcccaagaacgugcugcccgacagccagcagcaguacaacguggugaagaccgugaaggugaccgagcagcugagacacugcagcgagauccugaaggagaugcuggccaagaagcacuucagcuacgccuggcccuucuacaaccccguggacgugaacgcccugggccugcacaacuacuacgacguggugaagaaccccauggaccugggcaccaucaaggagaagauggacaaccaggaguacaaggacgccuacaaguucgccgccgacgugagacugauguucaugaacugcuacaaguacaacccccccgaccacgagguggugaccauggccagaaugcugcaggacguguucgagacccacuucagcaagauccccaucgagcccguggagagcaugccccugugcuacaucaagaccgacaucaccgagaccaccggcagagagaacaccaacgaggccagcagcgagggcaacagcagcgacgacagcgaggacgagagagugaagagacuggccaagcugcaggagcagcugaaggccgugcaccagcagcugcaggugcugagccaggugcccuucagaaagcugaacaagaagaaggagaagagcaagaaggagaagaagaaggagaaggugaacaacagcaacgagaaccccagaaagaugugcgagcagaugagacugaaggagaagagcaagagaaaccagcccaagaagagaaagcagcaguucaucggccugaagagcgaggacgaggacaacgccaagcccaugaacuacgacgagaagagacagcugagccugaacaucaacaagcugcccggcgacaagcugggcagaguggugcacaucauccagagcagagagcccagccugagcaacagcaaccccgacgagaucgagaucgacuucgagacccugaaggccagcacccugagagagcuggagaaguacgugagcgccugccugagaaagagaccccugaagccccccgccaagaagaucaugaugagcaaggaggagcugcacagccagaagaagcaggagcuggagaagagacugcuggacgugaacaaccagcugaacagcagaaagagacagaccaagagcgacaagacccagcccagcaaggccguggagaacgugagcagacugagcgagagcagcagcagcagcagcagcagcagcgagagcgagagcagcagcagcgaccugagcagcagcgacagcagcgacagcgagagcgagauguuccccaaguucaccgaggugaagcccaacgacagccccagcaaggagaacgugaagaagaugaagaacgagugcaucccccccgagggcagaaccggcgugacccagaucggcuacugcgugcaggacaccaccagcgccaacaccacccuggugcaccagaccacccccagccacgugaugccccccaaccaccaccagcuggccuucaacuaccaggagcuggagcaccugcagaccgugaagaacaucagcccccugcagauccugccccccagcggcgacagcgagcagcugagcaacggcaucaccgugaugcaccccagcggcgacagcgacaccaccaugcuggagagcgagugccaggcccccgugcagaaggacaucaagaucaagaacgccgacagcuggaagagccugggcaagcccgugaagcccagcggcgugaugaagagcagcgacgagcuguucaaccaguucagaaaggccgccaucgagaaggaggugaaggccagaacccaggagcugaucagaaagcaccuggagcagaacaccaaggagcugaaggccagccaggagaaccagagagaccugggcaacggccugaccguggagagcuucagcaacaagauccagaacaagugcagcggcgaggagcagaaggagcaccagcagagcagcgaggcccaggacaagagcaagcuguggcugcugaaggacagagaccuggccagacagaaggagcaggagagaagaagaagagaggccauggugggcaccaucgacaugacccugcagagcgacaucaugaccauguucgagaacaacuucgacuga

SEQ ID NO: 1174 - RNA, 2844 nt, Artificial Sequence
  derived and/or modified sequence opt5 from CT-_9/BRD6__Homo_sapiens__CCDS735.1
augagccugcccuccagacagaccgccaucauugugaacccuccgcccccugaguacaucaauacaaagaaaaacggccggcucacgaaucaacugcaguaucuucagaaggucguucugaaagaccucuggaagcacucuuucagcuggcccuuucagcgcccuguggaugcugugaaacugcaacuucccgacuacuauaccauuaucaagaacccuauggaucugaauacaauuaagaaaagacucgaaaacaaguacuaugccaaagcguccgagugcaucgaagacuucaauaccauguuuucuaacuguuaccuguauaauaagccgggggaugacaucguccugauggcucaggcccucgagaaacuguucaugcagaagcucagccagaugccccaagaagaacaggugguuggagugaaggagcggauuaaaaagggcacacagcagaacaucgccgucuccucugcuaaagaaaagagcuccccuagcgccaccgagaaaguguuuaagcaacaggaaauucccucuguuuucccuaaaacauccaucagcccccugaaugugguccagggggcuucugugaacuccagcucucaaaccgccgcccaggugacgaagggagucaagcgcaaagcggauaccacaaccccggcuacauccgccguuaaggcuagcuccgaguuuucuccuaccuucacggagaaaagcguggcccuucccccuauuaaggaaaauaugcccaaaaacgugcugcccgacucccagcagcaauacaaugucgugaagacaguuaaggugaccgagcagcuuagacauugcagcgaaauccugaaagagaugcucgcgaagaaacacuuuucuuacgccuggccuuucuauaacccggucgaugugaacgcucugggccugcauaauuacuaugacguugugaagaaccccauggaucucgggacaauuaaagaaaagauggacaaucaggaguacaaggaugccuauaaauuugcugccgacguccggcugauguucaugaacuguuacaaguauaauccucccgaccacgagguggucaccauggcccgcaugcuucaggauguguuugaaacccauuucuccaaaaucccuaucgagcccguugaaagcaugccgcugugcuacauuaagacagacaucacggagaccacaggaagagaaaacaccaaugaggcuucuagcgagggcaacuccucugaugacagcgaagaugagcgggugaaacgccucgcgaagcugcaagaacagcuuaaggccguccaccagcagcugcaagugcucucccagguuccuuucagaaaacugaauaagaaaaaggagaaaagcaagaaagaaaagaagaaagagaaggugaacaauucuaacgagaauccccggaaaaugugugaacagaugcgccugaaggagaaauccaagagaaaccagccuaagaaacggaagcaacaguuuauuggccucaaaagcgaagacgaggauaaugcuaagcccaugaacuacgacgagaaacgccagcugucucuuaacaucaauaagcugccuggggauaagcucggaagagucgugcacauuauccaaucccgggaacccagccuguccaacucuaauccggacgagaucgaaauugauuucgagacacuuaaagccagcacccugagagaacucgagaaguauguguccgccugccugcgcaaacggccucugaagccucccgcuaaaaagaucaugaugucuaaggaggaacuccauagccagaaaaagcaggagcuggaaaagagacuucuggacguuaacaaucagcucaacucccgcaagcggcaaacgaaaagcgacaagacacagcccucuaaagccgucgagaauguguccagacugagcgaaucuuccagcucuagcuccucuagcuccgagagcgaguccucuagcuccgaucugucuagcuccgacucuagcgauuccgaaagcgagauguuuccgaaguucaccgaagugaagcccaacgacucuccuuccaaagagaaugucaagaaaaugaagaacgaauguauucccccugagggccgcaccggggugacacagaucggauacugcguucaggauaccacaagcgcgaauacgacccuugugcaccaaacaacccccucucaugucaugccucccaaccaccaccagcucgcuuuuaauuaucaggagcuggaacaucugcagacagugaaaaacauuuccccgcuccaaauccugccucccagcggcgacucugagcagcuuuccaaugggaucaccguuaugcacccuagcggagauuccgacacgaccaugcuggaaagcgagugucaggcccccgugcaaaaggauauuaagaucaaaaacgccgacucuuggaaaagccucggcaaaccggucaagccuuccggcgugaugaaaucuagcgaugagcuguucaaccaguuucggaaggcugccauugaaaaggagguuaaagcuagaacacaggaacugauccgcaagcaucuugagcagaauaccaaagaacucaaggccucccaagagaaccagcgggaccuggggaauggacugacaguggagucuuucagcaacaaaauucagaauaagugcuccggcgaggagcagaaggaacaccaacagucuagcgaggcgcaggauaaauccaagcucuggcugcuuaaagacagagaccuggcccgccagaaggaacaagagcggagacggcgcgaggcuauggucgggaccaucgauaugacgcuccagagcgacauuaugacaauguuugaaaacaauuucgauuga

SEQ ID NO: 1175 - protein, 180 aa, Artificial Sequence
  CTAG2_Isoform_LAGE-1A__Homo_sapiens__O75638-2
MQAEGRGTGGSTGDADGPGGPGIPDGPGGNAGGPGEAGATGGRGPRGAGAARASGPRGGAPRGPHGGAASAQDGRCPCGARRPDSRLLELHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 1176 - RNA, 543 nt, Artificial Sequence
  CTAG2_Isoform_LAGE-1A__Homo_sapiens__CCDS35455.1
augcaggccgaaggccggggcacaggggguucgacgggcgaugcugauggcccaggaggcccuggcauuccugauggcccagggggcaaugcuggcggcccaggagaggcgggugccacgggcggcagagguccccggggcgcaggggcagcaagggccucggggccgagaggaggcgccccgcgggguccgcauggcggugccgcuucugcgcaggauggaaggugccccugcggggccaggaggccggacagccgccugcuugaguugcacaucacgaugccuuucucgucgcccauggaagcggagcugguccgcaggauccugucccgggaugccgcaccgcucccccgaccaggggcgguucugaaggacuucaccguguccggcaaccuacuguuuauccgacugacugcugcagaccaccgccaacugcagcucuccaucagcuccugucuccagcagcuuucccuguugauguggaucacgcagugcuuucugcccguguuuuuggcucaggcucccucagggcagaggcgcuaa

SEQ ID NO: 1177 - RNA, 543 nt, Artificial Sequence
  derived and/or modified sequence opt1 from CTAG2_Isoform_LAGE-1A__Homo_sapiens__CCDS35455.1
augcaggccgagggccgcgggaccggcgggagcaccggcgacgccgacgggcccggcggcccggggauccccgacggccccgggggcaacgccgggggccccggcgaggccggggccacgggcgggcggggcccgcgcggcgccggggccgcgcgggccuccggcccccgcgggggcgcgccccgggggccccacggcggcgccgcgagcgcccaggacgggcgcugcccgugcggcgcccggcgccccgacucccggcugcucgagcugcacaucaccaugcccuucagcucccccauggaggccgagcuggugcgccggauccucagccgcgacgccgcgccgcugccccggcccggggccguccugaaggacuucaccguguccggcaaccuccuguucauccgccugaccgccgccgaccaccggcagcuccagcugagcaucuccagcugccugcagcagcucucccugcugauguggaucacgcagugcuuccuccccguguuccuggcccaggcgccgagcgggcagcgccgguga

SEQ ID NO: 1178 - RNA, 543 nt, Artificial Sequence
  derived and/or modified sequence opt2 from CTAG2_Isoform_LAGE-1A__Homo_sapiens__CCDS35455.1
augcaggccgagggccgcggcaccggcggcuccaccggcgacgccgacggccccggcggccccggcauccccgacggccccggcggcaacgccggcggccccggcgaggccggcgccaccggcggccgcggcccccgcggcgccggcgccgcccgcgccuccggcccccgcggcggcgccccccgcggcccccacggcggcgccgccuccgcccaggacggccgcugccccugcggcgcccgccgccccgacucccgccuccucgagcuccacaucaccaugcccuucuccucccccauggaggccgagcucguccgccgcauccucucccgcgacgccgccccccucccccgccccggcgccguccucaaggacuucaccgucuccggcaaccuccucuucauccgccucaccgccgccgaccaccgccagcuccagcucuccaucuccuccugccuccagcagcucucccuccucauguggaucacccagugcuuccuccccgucuuccucgcccaggcccccuccggccagcgccgcuga

SEQ ID NO: 1179 - RNA, 543 nt, Artificial Sequence
  derived and/or modified sequence opt3 from CTAG2_Isoform_LAGE-1A__Homo_sapiens__CCDS35455.1
augcaggccgagggcagagggaccggagguagcacaggcgacgcugaugggcccggaggcccugguaucccagacgggccgggaggcaacgcaggcgggcccggagaagccggugcgacuggcgggaggggaccucggggcgcuggugccgcacgcgccuccgggccacgaggaggcgcuccccguggcccucacgggggagcagccucugcucaagaugguagaugcccauguggcgccaggcggcccgacucacgccugcucgagcuucauauuacgaugccuuucaguagcccaauggaagcggagcuggugagaaggauauugucccgggaugcagccccguuaccccgcccuggggcuguccugaaggacuuuaccguuucuggaaaucuacucuucauccgacugacagccgcagaucacagacagcuucagcugucgauuucaagcugcuugcagcaacucagucugcugauguggaucacucaguguuuucucccaguguucuuagcucaggcccccuccggccagaggcgguga

SEQ ID NO: 1180 - RNA, 543 nt, Artificial Sequence
  derived and/or modified sequence opt4 from CTAG2_Isoform_LAGE-1A__Homo_sapiens__CCDS35455.1
augcaggccgagggcagaggcaccggcggcagcaccggcgacgccgacggccccggcggccccggcauccccgacggccccggcggcaacgccggcggccccggcgaggccggcgccaccggcggcagaggccccagaggcgccggcgccgccagagccagcggccccagaggcggcgcccccagaggcccccacggcggcgccgccagcgcccaggacggcagaugccccugcggcgccagaagacccgacagcagacugcuggagcugcacaucaccaugcccuucagcagccccauggaggccgagcuggugagaagaauccugagcagagacgccgccccccugcccagacccggcgccgugcugaaggacuucaccgugagcggcaaccugcuguucaucagacugaccgccgccgaccacagacagcugcagcugagcaucagcagcugccugcagcagcugagccugcugauguggaucacccagugcuuccugcccguguuccuggcccaggcccccagcggccagagaagauga

SEQ ID NO: 1181 - RNA, 543 nt, Artificial Sequence
  derived and/or modified sequence opt5 from CTAG2_Isoform_LAGE-1A__Homo_sapiens__CCDS35455.1
augcaggccgagggcagagggaccggaggcagcacaggggacgcugauggacccggcgggccuggaaucccggacggccccggcgggaacgccggaggcccuggggaagcgggagcuacgggcgggcggggaccccgcggcgccggcgccgcuagagccuccgggccucggggaggcgcuccccgcgggccucacggaggcgccgcgucugcccaagaugggagaugcccguguggagcucggcgccccgacagcagacugcucgagcugcauauuaccaugccuuucuccucucccauggaagccgagcuugugcggcgcauccugagcagagaugcugccccucucccccggccgggcgcgguccugaaggacuuuacaguuuccggcaaucuucuguucauucgccucaccgccgcugaucacagacagcugcagcugucuaucagcuccugccuccagcaacugagccuucugauguggauuacacaguguuuucucccuguguuccuggcccaggcucccucugggcagcggcgcuga

SEQ ID NO: 1182 - protein, 210 aa, Artificial Sequence
  CTAG2_Isoform_LAGE-1B__Homo_sapiens__O75638
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 1183 - RNA, 633 nt, Artificial Sequence
  CTAG2_Isoform_LAGE-1B__Homo_sapiens__CAA10196
augcaggccgaaggccagggcacaggggguucgacgggcgaugcugauggcccaggaggcccuggcauuccugauggcccagggggcaaugcuggcggcccaggagaggcgggugccacgggcggcagagguccccggggcgcaggggcagcaagggccucggggccgagaggaggcgccccgcgggguccgcauggcggugccgcuucugcgcaggauggaaggugccccugcggggccaggaggccggacagccgccugcuucaguugcacaucacgaugccuuucucgucgcccauggaagcggagcugguccgcaggauccugucccgggaugccgcaccucucccccgaccaggggcgguucugaaggacuucaccguguccggcaaccuacuguuuaugucaguucgggaccaggacagggaaggcgcugggcggaugagggugguggguugggggcugggauccgccuccccggaggggcagaaagcuagagaucucagaacacccaaacacaaggucucagaacagagaccugguacaccaggcccgccgccacccgagggagcccagggagaugggugcagaggugucgccuuuaaugugauguucucugccccucacauuuag

SEQ ID NO: 1184 - RNA, 633 nt, Artificial Sequence
  derived and/or modified sequence opt1 from CTAG2_Isoform_LAGE-1B__Homo_sapiens__CAA10196
augcaggccgagggccaggggaccggcgggagcaccggcgacgccgacgggcccggcggccccgggauccccgacggccccgggggcaacgccgggggccccggcgaggccggggccacgggcgggcgcggcccgcggggcgccggggccgcccgcgccuccggcccccgcgggggcgcgccccgggggccccacggcggcgccgcgagcgcccaggacgggcggugcccgugcggcgcccgccggcccgacucccgccugcuccagcugcacaucaccaugcccuucagcucccccauggaggccgagcuggugcggcgcauccucagccgggacgccgcgccgcugccccgccccggggccguccugaaggacuucaccguguccggcaaccuccuguucaugagcgugcgggaccaggaccgcgagggggccggccggaugcgcgucgugggcugggggcugggcuccgccagccccgaggggcagaaggcccgggaccuccgcaccccgaagcacaagguguccgagcagcggcccggcacgcccgggcccccgccgcccgagggcgcgcagggcgacgggugccgcggcgucgccuucaacgugauguucagcgcgccccacaucuga

SEQ ID NO: 1185 - RNA, 633 nt, Artificial Sequence
  derived and/or modified sequence opt2 from CTAG2_Isoform_LAGE-1B__Homo_sapiens__CAA10196
augcaggccgagggccagggcaccggcggcuccaccggcgacgccgacggccccggcggccccggcauccccgacggccccggcggcaacgccggcggccccggcgaggccggcgccaccggcggccgcggcccccgcggcgccggcgccgcccgcgccuccggcccccgcggcggcgccccccgcggcccccacggcggcgccgccuccgcccaggacggccgcugccccugcggcgcccgccgccccgacucccgccuccuccagcuccacaucaccaugcccuucuccucccccauggaggccgagcucguccgccgcauccucucccgcgacgccgccccccucccccgccccggcgccguccucaaggacuucaccgucuccggcaaccuccucuucauguccguccgcgaccaggaccgcgagggcgccggccgcaugcgcgucgucggcuggggccucggcuccgccucccccgagggccagaaggcccgcgaccuccgcacccccaagcacaaggucuccgagcagcgccccggcacccccggcccccccccccccgagggcgcccagggcgacggcugccgcggcgucgccuucaacgucauguucuccgccccccacaucuga

SEQ ID NO: 1186 - RNA, 633 nt, Artificial Sequence
  derived and/or modified sequence opt3 from CTAG2_Isoform_LAGE-1B__Homo_sapiens__CAA10196
augcaggccgagggccaagggaccggagguagcacaggcgacgcugaugggcccggaggcccugguaucccagacgggccgggaggcaacgcaggcgggcccggagaagccggugcgacuggcgggagaggaccuaggggcgcuggugccgcacgggccuccgggccacgcggaggcgcuccccgaggcccucacgggggagcagccucugcucaggauggucguugcccauguggcgccagaaggcccgacucacggcugcuccagcuucauauuacgaugccuuucaguagcccaauggaggcggaacuggugcgcagaauauuguccagggaugcagccccguuaccccggccuggggcuguccugaaggacuuuaccguuucuggaaaucuacucuucaugucggugcgcgaucaggaccgagagggcgccgguagaaugaggguagugggguggggccugggaucagcaagcccagaaggccaaaaagcucgggaucuucguacacccaagcacaaagucagugagcagcgcccugggacuccaggacccccgccucccgagggugcccagggcgacgggugcagaggaguggcguuuaacguuauguucuccgccccacauaucuga

SEQ ID NO: 1187 - RNA, 633 nt, Artificial Sequence
  derived and/or modified sequence opt4 from CTAG2_Isoform_LAGE-1B__Homo_sapiens__CAA10196
augcaggccgagggccagggcaccggcggcagcaccggcgacgccgacggccccggcggccccggcauccccgacggccccggcggcaacgccggcggccccggcgaggccggcgccaccggcggcagaggccccagaggcgccggcgccgccagagccagcggccccagaggcggcgcccccagaggcccccacggcggcgccgccagcgcccaggacggcagaugccccugcggcgccagaagacccgacagcagacugcugcagcugcacaucaccaugcccuucagcagccccauggaggccgagcuggugagaagaauccugagcagagacgccgccccccugcccagacccggcgccgugcugaaggacuucaccgugagcggcaaccugcuguucaugagcgugagagaccaggacagagagggcgccggcagaaugagaguggugggcuggggccugggcagcgccagccccgagggccagaaggccagagaccugagaacccccaagcacaaggugagcgagcagagacccggcacccccggcccccccccccccgagggcgcccagggcgacggcugcagaggcguggccuucaacgugauguucagcgccccccacaucuga

SEQ ID NO: 1188 - RNA, 633 nt, Artificial Sequence
  derived and/or modified sequence opt5 from CTAG2_Isoform_LAGE-1B__Homo_sapiens__CAA10196
augcaggccgagggccaagggaccggaggcagcacaggggacgcugauggacccggcgggccuggaaucccggacggccccggcgggaacgccggaggcccuggggaagcgggagcuacgggcgggagaggaccccggggcgccggcgccgcucgcgccuccgggccuagaggaggcgcuccccgggggccucacggaggcgccgcgucugcccaggaugggcgcugcccguguggagcuagacggcccgacagccgccugcuccagcugcauauuaccaugccuuucuccucucccauggaggccgaacuugugagacggauccugagccgcgaugcugccccucuccccagaccgggcgcgguccugaaggacuuuacaguuuccggcaaucuucuguucaugucugugcgggaucaggaccgcgagggggccggaagaaugcggguggucggcugggggcucggaagcgcuuccccugaaggccaaaaagcccgcgaucugagaacccccaagcacaaagugagcgagcagcggccugggacacccggacccccuccgcccgagggcgcucagggcgacgggugcagaggaguugccuuuaacgugauguucucugccccucauauuuga

SEQ ID NO: 1189 - protein, 663 aa, Artificial Sequence
  CTCFL__Homo_sapiens__Q8NI51
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 1190 - RNA, 1992 nt, Artificial Sequence
  CTCFL__Homo_sapiens__CCDS13459.1
auggcagccacugagaucucuguccuuucugagcaauucaccaagaucaaagaacucgaguugaugccggaaaaaggccugaaggaggaggaaaaagacggagugugcagagagaaagaccaucggagcccuagugaguuggaggccgagcguaccucuggggccuuccaggacagcguccuggaggaagaaguggagcuggugcuggcccccucggaggagagcgagaaguacauccugacccugcagacggugcacuucacuucugaagcuguggaguugcaggauaugagcuugcugagcauacagcagcaagaaggggugcaggugguggugcaacagccuggcccuggguugcuguggcuugaggaagggccccggcagagccugcagcaguguguggccauuaguauccagcaagagcuguacuccccgcaagagauggagguguugcaguuccacgcucuagaggagaaugugaugguggccagugaagacaguaaguuagcggugagccuggcugaaacuacuggacugaucaagcucgaggaagagcaggagaagaaccaguuauuggcugaaagaacaaaggagcagcucuuuuuuguggaaacaaugucaggagaugaaagaagugacgaaauuguucucacaguuucaaauucaaauguggaagaacaagaggaucaaccuacagcuggucaagcagaugcugaaaaggccaaaucuacaaaaaaucaaagaaagacaaagggagcaaaaggaaccuuccacugugaugucugcauguucaccucuucuagaaugucaaguuuuaaucgucauaugaaaacucacaccagugagaagccucaccugugucaccucugccugaaaaccuuccguacggucacucugcugcggaaccauguuaacacccacacaggaaccaggcccuacaaguguaacgacugcaacauggcauuugucaccaguggagaacucguccgacacaggcgcuauaaacauacucaugagaaacccuuuaaauguuccaugugcaaguaugccaguguggaggcaaguaaauugaagcgccauguccgaucccacacuggggagcgccccuuucaguguugccagugcagcuaugccagcagagauaccuacaagcugaaacgccacaugagaacgcacucaggugagaagccuuacgaaugccacaucugccacacccgcuucacccagagcgggaccaugaaaauacauauucugcagaaacacggcgaaaauguccccaaauaccaguguccccauugugccaccaucauugcacggaaaagcgaccuacgugugcauaugcgcaacuugcaugcuuacagcgcugcagagcugaaaugccgcuacuguucugcugucuuccaugaacgcuaugcccucauucagcaccagaaaacucauaagaaugagaagagguucaagugcaaacacugcaguuaugccugcaagcaggaacgucauaugaccgcucacauucguacccacacuggagagaaaccauucaccugccuuucuugcaauaaauguuuccgacagaagcaacuucuaaacgcucacuucaggaaauaccacgaugcaaauuucaucccgacuguuuacaaaugcuccaaguguggcaaaggcuuuucccgcuggauuaaccugcacagacauucggagaaguguggaucaggggaagcaaagucggcugcuucaggaaagggaagaagaacaagaaagaggaagcagaccauccugaaggaagccacaaagggucagaaggaagcugcgaagggauggaaggaagccgcgaacggagacgaagcugcugcugaggaggcuuccaccacgaagggagaacaguucccaggagagauguuuccugucgccugcagagaaaccacagccagagucaaagaggaaguggaugaaggcgugaccugugaaaugcuccucaacacgauggauaaguga

SEQ ID NO: 1191 - RNA, 1992 nt, Artificial Sequence
  derived and/or modified sequence opt1 from CTCFL__Homo_sapiens__CCDS13459.1
auggccgccaccgagaucagcgugcuguccgagcaguucaccaagaucaaggagcucgagcugaugcccgagaagggccugaaggaggaggagaaggacggggucugccgcgagaaggaccaccggagcccguccgagcucgaggcggagcgcacgagcggcgccuuccaggacuccgugcuggaggaggagguggagcugguccucgcccccagcgaggaguccgagaaguacauccugacccugcagaccgugcacuucaccagcgaggccguggagcuccaggacaugucccugcugagcauccagcagcaggaggggguccagguggugguccagcagcccggccccgggcuccuguggcuggaggagggcccgcggcagucccuccagcagugcguggccaucagcauccagcaggagcuguacagcccccaggagauggaggugcugcaguuccacgcgcucgaggagaacgucaugguggccuccgaggacuccaagcuggccgugagccuggccgagacgaccggccucaucaagcuggaggaggagcaggagaagaaccagcugcucgcggagcgcaccaaggagcagcuguucuucgucgagaccauguccggggacgagcggagcgacgagaucgugcugacgguguccaacagcaacgucgaggagcaggaggaccagcccaccgccggccaggccgacgccgagaaggccaagagcaccaagaaccagcgcaagaccaagggggcgaagggcacguuccacugcgacgugugcauguucaccuccagccggauguccagcuucaaccgccacaugaagacccacaccuccgagaagccccaccucugccaccugugccugaagacguuccggaccgugacccuccugcgcaaccacgucaacacccacacggggacccggccguacaagugcaacgacugcaacauggccuucgugaccagcggcgagcuggugcgccaccggcgcuacaagcacacccacgagaagcccuucaagugcuccaugugcaaguacgccagcgucgaggccuccaagcucaagcggcacgugcgcagccacacgggcgagcggcccuuccagugcugccagugcuccuacgccagccgcgacaccuacaagcugaagcggcacaugcgcacccacuccggggagaagcccuacgagugccacaucugccacacccgguucacgcagagcggcaccaugaagauccacauccugcagaagcacggggagaacgucccgaaguaccagugcccccacugcgcgaccaucaucgcccgcaaguccgaccuccgcgugcacaugcggaaccugcacgccuacagcgccgccgagcugaagugccgcuacugcuccgcgguguuccacgagcgguacgcccucauccagcaccagaagacccacaagaacgagaagcgcuucaagugcaagcacugcagcuacgccugcaagcaggagcggcacaugacggcccacauccgcacccacaccggcgagaagcccuucacgugccuguccugcaacaagugcuuccggcagaagcagcugcucaacgcccacuuccgcaaguaccacgacgcgaacuucauccccaccgucuacaagugcagcaagugcggcaagggguucagccgguggaucaaccugcaccgccacuccgagaagugcggcagcggggaggccaaguccgccgccagcggcaaggggcggcgcacccggaagcgcaagcagaccauccugaaggaggcgaccaagggccagaaggaggccgccaagggcuggaaggaggccgccaacggggacgaggcggccgccgaggaggccuccaccacgaagggcgagcaguucccgggggagauguuccccguggccugccgggagaccaccgcgcgcgugaaggaggaggucgacgagggcgugaccugcgagaugcuccugaacacgauggacaaguga

SEQ ID NO: 1192 - RNA, 1992 nt, Artificial Sequence
  derived and/or modified sequence opt2 from CTCFL__Homo_sapiens__CCDS13459.1
auggccgccaccgagaucuccguccucuccgagcaguucaccaagaucaaggagcucgagcucaugcccgagaagggccucaaggaggaggagaaggacggcgucugccgcgagaaggaccaccgcucccccuccgagcucgaggccgagcgcaccuccggcgccuuccaggacuccguccucgaggaggaggucgagcucguccucgcccccuccgaggaguccgagaaguacauccucacccuccagaccguccacuucaccuccgaggccgucgagcuccaggacaugucccuccucuccauccagcagcaggagggcguccaggucgucguccagcagcccggccccggccuccucuggcucgaggagggcccccgccagucccuccagcagugcgucgccaucuccauccagcaggagcucuacuccccccaggagauggagguccuccaguuccacgcccucgaggagaacgucauggucgccuccgaggacuccaagcucgccgucucccucgccgagaccaccggccucaucaagcucgaggaggagcaggagaagaaccagcuccucgccgagcgcaccaaggagcagcucuucuucgucgagaccauguccggcgacgagcgcuccgacgagaucguccucaccgucuccaacuccaacgucgaggagcaggaggaccagcccaccgccggccaggccgacgccgagaaggccaaguccaccaagaaccagcgcaagaccaagggcgccaagggcaccuuccacugcgacgucugcauguucaccuccucccgcauguccuccuucaaccgccacaugaagacccacaccuccgagaagccccaccucugccaccucugccucaagaccuuccgcaccgucacccuccuccgcaaccacgucaacacccacaccggcacccgccccuacaagugcaacgacugcaacauggccuucgucaccuccggcgagcucguccgccaccgccgcuacaagcacacccacgagaagcccuucaagugcuccaugugcaaguacgccuccgucgaggccuccaagcucaagcgccacguccgcucccacaccggcgagcgccccuuccagugcugccagugcuccuacgccucccgcgacaccuacaagcucaagcgccacaugcgcacccacuccggcgagaagcccuacgagugccacaucugccacacccgcuucacccaguccggcaccaugaagauccacauccuccagaagcacggcgagaacguccccaaguaccagugcccccacugcgccaccaucaucgcccgcaaguccgaccuccgcguccacaugcgcaaccuccacgccuacuccgccgccgagcucaagugccgcuacugcuccgccgucuuccacgagcgcuacgcccucauccagcaccagaagacccacaagaacgagaagcgcuucaagugcaagcacugcuccuacgccugcaagcaggagcgccacaugaccgcccacauccgcacccacaccggcgagaagcccuucaccugccucuccugcaacaagugcuuccgccagaagcagcuccucaacgcccacuuccgcaaguaccacgacgccaacuucauccccaccgucuacaagugcuccaagugcggcaagggcuucucccgcuggaucaaccuccaccgccacuccgagaagugcggcuccggcgaggccaaguccgccgccuccggcaagggccgccgcacccgcaagcgcaagcagaccauccucaaggaggccaccaagggccagaaggaggccgccaagggcuggaaggaggccgccaacggcgacgaggccgccgccgaggaggccuccaccaccaagggcgagcaguuccccggcgagauguuccccgucgccugccgcgagaccaccgcccgcgucaaggaggaggucgacgagggcgucaccugcgagaugcuccucaacaccauggacaaguga

SEQ ID NO: 1193 - RNA, 1992 nt, Artificial Sequence
  derived and/or modified sequence opt3 from CTCFL__Homo_sapiens__CCDS13459.1
auggccgcuaccgagaucagcgugcuguccgaacaguucacaaagauuaaagagcucgaacuuaugcccgagaagggccugaaagaagaggagaaggacggggucugcagagaaaaagaucacaggucuccuucagaguuggaagcagagcggacgaguggagccuuucaagacagcguuuuagaggaagagguggaacugguacuagcgccauccgaggaaucugagaaguacauacucacucugcagaccgugcauuucacaucggaggcugucgaacuucaggauaugucacuguugagcauccagcaacaggagggugugcagguugugguccagcaaccgggccccgggcuccuguggcuggaagagggaccucgccagagucuccagcaguguguggccauuuccauccaacaggaauuauauucuccacaggagauggagguacugcaauuucacgcacuugaagagaacguuaugguggccagcgaagacuccaaguuggcugucucacuggcagagacuaccggccuaauuaaacucgaagaggagcaggaaaagaaucagcugcuugccgagcgaacaaaagaacagcuguucuuuguggagaccaugaguggugaugagcguagcgacgaaaucguguugacugucucuaacuccaauguugaggaacaagaggaucagcccacagcugggcaggccgacgcggaaaaggcaaaaucaaccaagaaccagagaaagacgaaaggagccaagggcacuuuccauugcgauguguguauguuuaccagcaguaggaugucuuccuucaaucggcacaugaaaacacauacuagcgagaagccucaccucugccaccuguguuuaaaaaccuuucgcacaguaacccugcucagaaaccaugugaauacgcacacuggcacaaggccauacaagugcaacgacuguaauauggcuuucgucaccucgggggagcuugugcggcaucgccgauauaaacacacucacgaaaagcccuuuaagugcucuauguguaaauacgccuccguugaggcaucaaagcugaaaagacaugugaggagucacacaggagaacggccuuuccaaugcugucagugcagcuaugcuucccgugauaccuacaaguugaaacgccauaugagaacgcacucuggugagaagccauaugaaugccauauaugucacaccagguuuacacagagcggcacuaugaagauccacauucuacagaaacauggggagaacgucccgaaguaccaaugcccccacugugccaccaucauugcgcggaaaucagaccugcgagugcauaugcgcaaucuccacgccuacagugcagcugagcugaagugcagauauuguuccgccguauuccacgaaagguacgcucuuauccagcaucagaaaacacacaagaacgagaagcgguucaaaugcaagcauuguagcuaugccugcaaacaggaacgccacaugacugcacauauaagaacccacacaggagagaagccuuuuaccugucugucuugcaauaaauguuucaggcaaaagcaguugcucaacgcccacuuucguaaguaccaugaugcuaauuucauuccaacuguuuauaaaugcucaaagugcggcaaagguuuuagucgguggaucaaccugcaccgacauagcgaaaaguguggguccggagaggcgaaaucugcagccucgggcaagggcagaaggacgcgcaaacggaagcagacaauuuuaaaggaggcuaccaaagggcaaaaggaagccgcaaaaggauggaaggaggccgcuaacggugacgaagccgcagcggaggaggcuagcacuaccaaaggcgaacaguuccccggggagauguuuccuguggccugcagagaaacaaccgcaagggucaaggaggaaguggacgagggagucacuugugagaugcugcuaaauacaauggauaaguga

SEQ ID NO: 1194 - RNA, 1992 nt, Artificial Sequence
  derived and/or modified sequence opt4 from CTCFL__Homo_sapiens__CCDS13459.1
auggccgccaccgagaucagcgugcugagcgagcaguucaccaagaucaaggagcuggagcugaugcccgagaagggccugaaggaggaggagaaggacggcgugugcagagagaaggaccacagaagccccagcgagcuggaggccgagagaaccagcggcgccuuccaggacagcgugcuggaggaggagguggagcuggugcuggcccccagcgaggagagcgagaaguacauccugacccugcagaccgugcacuucaccagcgaggccguggagcugcaggacaugagccugcugagcauccagcagcaggagggcgugcaggugguggugcagcagcccggccccggccugcuguggcuggaggagggccccagacagagccugcagcagugcguggccaucagcauccagcaggagcuguacagcccccaggagauggaggugcugcaguuccacgcccuggaggagaacgugaugguggccagcgaggacagcaagcuggccgugagccuggccgagaccaccggccugaucaagcuggaggaggagcaggagaagaaccagcugcuggccgagagaaccaaggagcagcuguucuucguggagaccaugagcggcgacgagagaagcgacgagaucgugcugaccgugagcaacagcaacguggaggagcaggaggaccagcccaccgccggccaggccgacgccgagaaggccaagagcaccaagaaccagagaaagaccaagggcgccaagggcaccuuccacugcgacgugugcauguucaccagcagcagaaugagcagcuucaacagacacaugaagacccacaccagcgagaagccccaccugugccaccugugccugaagaccuucagaaccgugacccugcugagaaaccacgugaacacccacaccggcaccagacccuacaagugcaacgacugcaacauggccuucgugaccagcggcgagcuggugagacacagaagauacaagcacacccacgagaagcccuucaagugcagcaugugcaaguacgccagcguggaggccagcaagcugaagagacacgugagaagccacaccggcgagagacccuuccagugcugccagugcagcuacgccagcagagacaccuacaagcugaagagacacaugagaacccacagcggcgagaagcccuacgagugccacaucugccacaccagauucacccagagcggcaccaugaagauccacauccugcagaagcacggcgagaacgugcccaaguaccagugcccccacugcgccaccaucaucgccagaaagagcgaccugagagugcacaugagaaaccugcacgccuacagcgccgccgagcugaagugcagauacugcagcgccguguuccacgagagauacgcccugauccagcaccagaagacccacaagaacgagaagagauucaagugcaagcacugcagcuacgccugcaagcaggagagacacaugaccgcccacaucagaacccacaccggcgagaagcccuucaccugccugagcugcaacaagugcuucagacagaagcagcugcugaacgcccacuucagaaaguaccacgacgccaacuucauccccaccguguacaagugcagcaagugcggcaagggcuucagcagauggaucaaccugcacagacacagcgagaagugcggcagcggcgaggccaagagcgccgccagcggcaagggcagaagaaccagaaagagaaagcagaccauccugaaggaggccaccaagggccagaaggaggccgccaagggcuggaaggaggccgccaacggcgacgaggccgccgccgaggaggccagcaccaccaagggcgagcaguuccccggcgagauguuccccguggccugcagagagaccaccgccagagugaaggaggagguggacgagggcgugaccugcgagaugcugcugaacaccauggacaaguga

SEQ ID NO: 1195 - RNA, 1992 nt, Artificial Sequence
  derived and/or modified sequence opt5 from CTCFL__Homo_sapiens__CCDS13459.1
auggccgcuaccgagaucagcgugcuguccgaacaguucacaaagauuaaagagcucgaacugaugcccgagaagggccuuaaagaagaggagaaggacggggucugcagagaaaaagaucaccggucuccuagcgagcuggaagccgagcgcacguccggagcguuucaagacucuguucucgaggaagagguggaacuggugcuugcuccgagcgaggaauccgagaaguacauccugacccuccagacaguccauuucaccucugaggccguggaacugcaggauaugagccugcucuccauucagcaacaggagggcguucagguggucgugcagcaacccgggccuggacugcuuuggcuggaagagggccccagacagagccuccagcaguguguugccaucucuauucaacaggaacuguauuccccucaggagauggaggugcuucaauuucacgcucuggaagagaacgucaugguggccagcgaagacucuaagcucgcugugucccuggccgagacaaccgggcugaucaaacucgaagaggagcaggaaaagaaucagcugcuugcggagcggacaaaagaacagcuguucuuugucgagaccaugagcggagaugagcgcucugacgaaaucguucucacgguguccaacagcaauguggaggaacaagaggaucagcccaccgccggccaggcugacgccgaaaaggcuaaauccacaaagaaccagagaaagaccaaaggcgccaaggggacauuccauugcgaugucuguauguuuaccucuagccggauguccagcuucaaucgccacaugaaaacgcauacaucugagaagccucaccugugccaccuuugucugaaaaccuuuagaacagugacccuccugcggaaccauguuaauacccacacaggaacgcgcccguacaagugcaacgacuguaauauggcguucgugaccuccggcgagcuggucagacaucggcgcuauaaacacacacacgaaaagcccuuuaagugcagcauguguaaauacgccucuguggaggcuagcaagcucaaaagacauguucggucccacaccggggaacgcccuuuccaaugcugucagugcucuuaugccagcagagauacauacaagcugaaacggcauaugagaacccacuccggagagaagcccuaugaaugccauauuugucacacgcgcuuuacacagagcggcaccaugaagauccacauucuucagaaacauggggagaacgugccuaaguaccaaugcccccacugugcuaccaucauugcccggaaaucugaccugagaguccauaugcgcaaucuccacgccuacuccgcugcggagcugaagugccgguauuguagcgccguguuccacgaaagauacgcucuuauccagcaucagaaaacacacaagaacgagaagcgcuucaaaugcaagcauuguucuuaugccugcaaacaggaacggcacaugaccgcccauauuagaacacacacgggagagaagccguuuaccugucuguccugcaauaaauguuuccgccaaaagcagcuccugaacgcucacuuucggaaguaccaugaugccaauuucaucccuacagucuauaaaugcagcaagugcggcaaaggcuuuuccagauggaucaaccugcaccgccauucugaaaagugugggagcggagaggcgaaauccgcugccucuggcaaggggcggagaacccggaaacgcaagcagacaauucucaaggaggccaccaaaggacaaaaggaagcugccaaaggcuggaaggaggcugccaacggggacgaagcggccgcugaggaggccagcacgaccaaaggagaacaguuccccggcgagauguuuccuguggcuugcagagaaacaaccgcccggguuaaggaggaaguggacgagggcgucacaugugagaugcugcuuaauaccauggauaaguga

SEQ ID NO: 1196 - protein, 715 aa, Artificial Sequence
  Cten__Homo_sapiens__Q8IZW8
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLESPANSSSSLHSLGSVSLCTRPSDFQAPRNPTLTMGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 1197 - RNA, 2148 nt, Artificial Sequence
  Cten__Homo_sapiens__CCDS11368.1
augucccaggugauguccagcccacugcuggcaggaggccaugcugucagcuuggcgccuugugaugagcccaggaggacccugcacccagcacccagccccagccugccaccccaguguucuuacuacaccacggaaggcuggggagcccaggcccugauggcccccgugcccugcauggggcccccuggccgacuccagcaagccccacagguggaggccaaagccaccugcuuccugccguccccuggugagaaggccuuggggaccccagaggaccuugacuccuacauugacuucucacuggagagccucaaucagaugauccuggaacuggaccccaccuuccagcugcuucccccagggacugggggcucccaggcugagcuggcccagagcaccaugucaaugagaaagaaggaggaaucugaagccuuggacauaaaguacaucgaggugaccuccgccagaucaaggugccacgauggcccccagcacugcuccagccccucugucaccccgcccuucggcucccuucgcagugguggccuccuccuuuccagagacgucccccgagagacacgaagcagcagugagagccucaucuucucugggaaccagggcagggggcaccagcgcccucugccccccucagagggucucuccccucgacccccaaauucccccagcaucucaaucccuugcauggggagcaaggccucgagcccccaugguuugggcuccccgcugguggcuucuccaagacuggagaagcggcugggaggccuggccccacagcggggcagcaggaucucugugcugucagccagcccagugucugaugucagcuauauguuuggaagcagccagucccuccugcacuccagcaacuccagccaucagucaucuuccagauccuuggaaaguccagccaacucuuccuccagccuccacagccuuggcucagugucccuguguacaagacccagugacuuccaggcucccagaaaccccacccuaaccaugggccaacccagaacaccccacucuccaccacuggccaaagaacaugccagcagcugccccccauccaucaccaacuccaugguggacauacccauugugcugaucaacggcugcccagaaccagggucuucuccaccccagcggaccccaggacaccagaacuccguucaaccuggagcugcuucucccagcaaccccuguccagccaccaggagcaacagccagacccugucagaugcccccuuuaccacaugcccagagggucccgccagggacaugcagcccaccaugaaguucgugauggacacaucuaaauacugguuuaagccaaacaucacccgagagcaagcaaucgagcugcugaggaaggaggagccaggggcuuuugucauaagggacagcucuucauaccgaggcuccuucggccuggcccugaaggugcaggagguucccgcgucugcucagagucgaccaggugaggacagcaaugaccucauccgacacuuccucaucgagucgucugccaaaggagugcaucucaaaggagcagaugaggagcccuacuuugggagccucucugccuucgugugccagcauuccaucauggcccuggcccugcccugcaaacucaccaucccacagagagaacugggaggugcagauggggccucggacucuacagacagcccagccuccugccagaagaaaucugcgggcugccacacccuguaccugagcucagugagcguggagacccugacuggagcccuggccgugcagaaagccaucuccaccaccuuugagagggacauccuccccacgcccaccgugguccacuucaaagucacagagcagggcaucacucugacugauguccagaggaagguguuuuuccggcgccauuacccacucaccacccuccgcuucugugguauggacccugagcaacggaaguggcagaaguacugcaaacccuccuggaucuuuggguuuguggccaagagccagacagagccucaggagaacguaugccaccucuuugcggaguaugacaugguccagccagccucgcaggucaucggccuggugacugcucugcugcaggacgcagaaaggauguag

SEQ ID NO: 1198 - RNA, 2148 nt, Artificial Sequence
  derived and/or modified sequence opt1 from Cten__Homo_sapiens__CCDS11368.1
augagccaggugauguccagcccccugcucgccggcgggcacgccgucucccuggcgccgugcgacgagccccgccggacccugcaccccgcccccagcccgucccuccccccccagugcagcuacuacaccacggagggcuggggggcccaggcccugauggcccccgugccgugcaugggcccccccgggcgccugcagcaggcgccccagguggaggccaaggccaccugcuuccucccgucccccggcgagaaggcccugggcacccccgaggaccuggacagcuacaucgacuucucccucgagagccugaaccagaugauccuggagcucgaccccaccuuccagcugcugccgcccgggacgggcgggucccaggcggagcucgcccagagcaccauguccaugcggaagaaggaggagagcgaggcccuggacaucaaguacaucgaggucaccuccgcccgcagccggugccacgacggcccccagcacugcuccagccccuccgugaccccgcccuucgggagccugcgcagcggcggccuccugcugucccgggacgugccccgcgagacgcggagcuccagcgagucccucaucuucagcgggaaccagggccgcgggcaccagcggccccugccgcccuccgagggccugagcccccgccccccgaacucccccagcaucuccauccccugcaugggcagcaaggccuccagcccgcacgggcucggcuccccccuggucgcgagcccccggcuggagaagcgccucgggggccuggccccccagcgggggucccgcaucagcgugcuguccgccagcccggugagcgacgucuccuacauguucggcagcucccagagccuccugcacuccagcaacuccagccaccaguccagcucccggagccuggagucccccgccaacagcuccagcucccuccacagccugggcagcgugucccugugcacccgccccagcgacuuccaggccccccggaacccgacccucaccauggggcagccccgcacgccccacucccccccgcuggcgaaggagcacgccagcuccugcccccccagcaucaccaacuccaugguggacauccccaucguccugaucaacggcugcccggagcccgggagcucccccccccagcggaccccgggccaccagaacagcgugcagcccggggccgccucccccagcaaccccugcccggccacccgcuccaacagccagacgcucuccgacgcgcccuucaccaccugccccgagggcccggcccgcgacaugcagcccaccaugaaguucgugauggacacgagcaaguacugguucaagcccaacaucacccgggagcaggccaucgagcugcugcgcaaggaggagcccggcgccuucgucauccgggacuccagcuccuaccgcgggagcuucggccucgcccugaaggugcaggaggugccggcgagcgcccagucccggcccggggaggacagcaacgaccugauccgccacuuccucaucgaguccagcgccaagggcguccaccugaagggggccgacgaggagcccuacuucggcucccugagcgcguucgugugccagcacuccaucauggcccucgcccugcccugcaagcugaccaucccgcagcgggagcugggcggggccgacggcgccagcgacuccaccgacagccccgcguccugccagaagaagagcgccgggugccacacgcucuaccuguccagcguguccgucgagacccugaccggcgcccucgccgugcagaaggccaucagcaccacguucgagcgcgacauccugcccacccccaccgugguccacuucaaggugaccgagcagggcaucacgcugaccgacguccagcggaagguguucuuccgccggcacuacccgcucaccacccugcgcuucugcgggauggaccccgagcagcggaaguggcagaaguacugcaagcccuccuggaucuucggcuucguggcgaagagccagacggagccccaggagaacgucugccaccuguucgccgaguacgacauggugcagccggccucccaggugaucgggcucgucaccgcccugcugcaggacgccgagcgcauguga

SEQ ID NO: 1199 - RNA, 2148 nt, Artificial Sequence
  derived and/or modified sequence opt2 from Cten__Homo_sapiens__CCDS11368.1
augucccaggucauguccuccccccuccucgccggcggccacgccgucucccucgcccccugcgacgagccccgccgcacccuccaccccgcccccucccccucccuccccccccagugcuccuacuacaccaccgagggcuggggcgcccaggcccucauggcccccguccccugcaugggcccccccggccgccuccagcaggccccccaggucgaggccaaggccaccugcuuccuccccucccccggcgagaaggcccucggcacccccgaggaccucgacuccuacaucgacuucucccucgagucccucaaccagaugauccucgagcucgaccccaccuuccagcuccucccccccggcaccggcggcucccaggccgagcucgcccaguccaccauguccaugcgcaagaaggaggaguccgaggcccucgacaucaaguacaucgaggucaccuccgcccgcucccgcugccacgacggcccccagcacugcuccucccccuccgucaccccccccuucggcucccuccgcuccggcggccuccuccucucccgcgacgucccccgcgagacccgcuccuccuccgagucccucaucuucuccggcaaccagggccgcggccaccagcgcccccucccccccuccgagggccucuccccccgcccccccaacucccccuccaucuccauccccugcaugggcuccaaggccuccuccccccacggccucggcuccccccucgucgccuccccccgccucgagaagcgccucggcggccucgccccccagcgcggcucccgcaucuccguccucuccgccucccccgucuccgacgucuccuacauguucggcuccucccagucccuccuccacuccuccaacuccucccaccaguccuccucccgcucccucgagucccccgccaacuccuccuccucccuccacucccucggcuccgucucccucugcacccgccccuccgacuuccaggccccccgcaaccccacccucaccaugggccagccccgcaccccccacucccccccccucgccaaggagcacgccuccuccugcccccccuccaucaccaacuccauggucgacauccccaucguccucaucaacggcugccccgagcccggcuccucccccccccagcgcacccccggccaccagaacuccguccagcccggcgccgccucccccuccaaccccugccccgccacccgcuccaacucccagacccucuccgacgcccccuucaccaccugccccgagggccccgcccgcgacaugcagcccaccaugaaguucgucauggacaccuccaaguacugguucaagcccaacaucacccgcgagcaggccaucgagcuccuccgcaaggaggagcccggcgccuucgucauccgcgacuccuccuccuaccgcggcuccuucggccucgcccucaagguccaggagguccccgccuccgcccagucccgccccggcgaggacuccaacgaccucauccgccacuuccucaucgaguccuccgccaagggcguccaccucaagggcgccgacgaggagcccuacuucggcucccucuccgccuucgucugccagcacuccaucauggcccucgcccuccccugcaagcucaccaucccccagcgcgagcucggcggcgccgacggcgccuccgacuccaccgacucccccgccuccugccagaagaaguccgccggcugccacacccucuaccucuccuccgucuccgucgagacccucaccggcgcccucgccguccagaaggccaucuccaccaccuucgagcgcgacauccuccccacccccaccgucguccacuucaaggucaccgagcagggcaucacccucaccgacguccagcgcaaggucuucuuccgccgccacuacccccucaccacccuccgcuucugcggcauggaccccgagcagcgcaaguggcagaaguacugcaagcccuccuggaucuucggcuucgucgccaagucccagaccgagccccaggagaacgucugccaccucuucgccgaguacgacaugguccagcccgccucccaggucaucggccucgucaccgcccuccuccaggacgccgagcgcauguga

SEQ ID NO: 1200 - RNA, 2148 nt, Artificial Sequence
  derived and/or modified sequence opt3 from Cten__Homo_sapiens__CCDS11368.1
augagccaggugauguccucuccccugcucgccggcgggcacgcugucucacuugcaccuugcgacgagccaagaaggacccugcauccggcccccaguccuagcuugccaccccaauguuccuacuauacaacugaaggauggggugcgcaggcuuuaauggccccuguuccaugcauggggcccccuggccggcugcagcaggcaccacaaguggaggccaaggcuacguguuuccuaccgucucccggagaaaaagcacucggcaccccugaggaucuggacucguacaucgauuuuucacuugaaagccugaaccagaugauuuuggagcucgacccaacauuccagcugcugcccccugguacugggggaagucaggccgagcucgcucaauccaccaugucuaugcgcaagaaagaagagagcgaagccuuagauauaaaguauaucgagguaacauccgcgcgaucacguugccacgacggcccacagcauuguaguagccccucugugaccccgccuuuuggcucccugagaucagggggacuuuugcugagcagggaugucccccgggagacucgcaguucuuccgaaagccuaauuuucucggguaaucagggcagagggcaccagaggccacucccucccucugagggacuguccccacggcccccuaacucaccaaguaucagcauuccgugcaugggcuccaaagcaucuagcccccauggucuugggucaccucugguggccaguccacgcuuggaaaagcgacucggaggccuggcuccccaaagaggcuccaggaucagcguuuuaucugccucaccugugagugacgucagcuacauguuuggguccucucagucgcugcuccacagcuccaauucaagucaccagucuagcucccggucacuugagagcccagcaaacucuuccaguagccugcauucuuugggauccgugucacuauguacacgucccagugauuuccaagcuccgcgcaauccuacccugacgaugggucagccaagaacuccccacagcccuccccucgccaaggaacaugcgucguccugcccaccuucuauaaccaacagcaugguagacauccccauuguucugaucaauggcuguccagagccggggucaaguccuccccagaggacaccaggacaccagaacuccgugcaacccggcgccgcaucuccuagcaauccaugccccgcuacucgguccaacucacagacccuuagcgaugccccuuuuacaaccuguccggaggguccagcucgagacaugcagcccacgaugaaauucgucauggauacaaguaaguauugguuuaaaccuaauauuacucgcgaacaggccaucgagcuguugagaaaggaagaaccaggggcauucgugauaagggacucuuccagcuaccggggcucguuuggacucgcccugaaagugcaagaaguccccgcuucagcgcagucucgcccuggcgaggacaguaacgauuuaauuagacacuuccugaucgaguccagcgcaaaggggguucaucuaaagggagccgacgaggagccguauuuugguucucucagcgcuuucgugugccagcacuccauuauggcccuggcacuucccugcaaauugaccaucccacagagggaacugggcggggccgauggagcuucagacaguacugauagcccugccucuugucaaaagaaauccgcaggcugccauacacucuaccugucaaguguaagcguggagacccuuacgggugcgcuggcuguccagaaggccaucuccaccacauucgaacgugacauuuugcccacuccaaccgugguucacuuuaaagugacagagcaggggauaacucucaccgauguccagcggaagguguucuuucgaagacauuacccucugacaaccuuaagguucuguggcauggaccccgagcaacgcaaauggcagaaguauugcaagccaucuuggaucuuuggauucguagcaaaaucgcagacugaaccgcaagagaauguuugucaccuguuugccgaauacgauauggugcagccugcuagccaggucauuggccuagugacggcccuccugcaggacgcagagcggauguga

SEQ ID NO: 1201 - RNA, 2148 nt, Artificial Sequence
  derived and/or modified sequence opt4 from Cten__Homo_sapiens__CCDS11368.1
augagccaggugaugagcagcccccugcuggccggcggccacgccgugagccuggcccccugcgacgagcccagaagaacccugcaccccgcccccagccccagccugcccccccagugcagcuacuacaccaccgagggcuggggcgcccaggcccugauggcccccgugcccugcaugggcccccccggcagacugcagcaggccccccagguggaggccaaggccaccugcuuccugcccagccccggcgagaaggcccugggcacccccgaggaccuggacagcuacaucgacuucagccuggagagccugaaccagaugauccuggagcuggaccccaccuuccagcugcugccccccggcaccggcggcagccaggccgagcuggcccagagcaccaugagcaugagaaagaaggaggagagcgaggcccuggacaucaaguacaucgaggugaccagcgccagaagcagaugccacgacggcccccagcacugcagcagccccagcgugaccccccccuucggcagccugagaagcggcggccugcugcugagcagagacgugcccagagagaccagaagcagcagcgagagccugaucuucagcggcaaccagggcagaggccaccagagaccccugccccccagcgagggccugagccccagaccccccaacagccccagcaucagcauccccugcaugggcagcaaggccagcagcccccacggccugggcagcccccugguggccagccccagacuggagaagagacugggcggccuggccccccagagaggcagcagaaucagcgugcugagcgccagccccgugagcgacgugagcuacauguucggcagcagccagagccugcugcacagcagcaacagcagccaccagagcagcagcagaagccuggagagccccgccaacagcagcagcagccugcacagccugggcagcgugagccugugcaccagacccagcgacuuccaggcccccagaaaccccacccugaccaugggccagcccagaaccccccacagccccccccuggccaaggagcacgccagcagcugcccccccagcaucaccaacagcaugguggacauccccaucgugcugaucaacggcugccccgagcccggcagcagccccccccagagaacccccggccaccagaacagcgugcagcccggcgccgccagccccagcaaccccugccccgccaccagaagcaacagccagacccugagcgacgcccccuucaccaccugccccgagggccccgccagagacaugcagcccaccaugaaguucgugauggacaccagcaaguacugguucaagcccaacaucaccagagagcaggccaucgagcugcugagaaaggaggagcccggcgccuucgugaucagagacagcagcagcuacagaggcagcuucggccuggcccugaaggugcaggaggugcccgccagcgcccagagcagacccggcgaggacagcaacgaccugaucagacacuuccugaucgagagcagcgccaagggcgugcaccugaagggcgccgacgaggagcccuacuucggcagccugagcgccuucgugugccagcacagcaucauggcccuggcccugcccugcaagcugaccaucccccagagagagcugggcggcgccgacggcgccagcgacagcaccgacagccccgccagcugccagaagaagagcgccggcugccacacccuguaccugagcagcgugagcguggagacccugaccggcgcccuggccgugcagaaggccaucagcaccaccuucgagagagacauccugcccacccccaccguggugcacuucaaggugaccgagcagggcaucacccugaccgacgugcagagaaagguguucuucagaagacacuacccccugaccacccugagauucugcggcauggaccccgagcagagaaaguggcagaaguacugcaagcccagcuggaucuucggcuucguggccaagagccagaccgagccccaggagaacgugugccaccuguucgccgaguacgacauggugcagcccgccagccaggugaucggccuggugaccgcccugcugcaggacgccgagagaauguga

SEQ ID NO: 1202 - RNA, 2148 nt, Artificial Sequence
  derived and/or modified sequence opt5 from Cten__Homo_sapiens__CCDS11368.1
augagccaggugauguccucuccccugcucgccggcgggcacgcugucagccuggccccuugcgacgagccgagacggacccuucaucccgcgccuucccccucucugccuccccaauguagcuacuauacaacggaaggauggggcgcucaggcccucauggccccuguuccgugcauggggcccccuggacgccugcagcaggcuccccaaguggaggccaaggcuaccuguuuccuuccuucccccggcgaaaaagcccuggggacaccggaggaucucgacucuuacaucgauuuuagccuggaaucccugaaccagaugauucucgagcuggacccuaccuuccagcuucugcccccuggaacaggcggcagccaggcggagcucgcccaaucuaccauguccaugagaaagaaagaagagagcgaagcucuggauaucaaguauauugaggugacaucugcccggucccgcugccacgacgggccccagcauuguagcucucccuccgucaccccuccguuuggaagccuuagauccggcgggcugcuccugucucgggaugugccccgcgagacgagaagcuccagcgaaucucugaucuucuccggaaaucagggccgggggcaccagcgcccucuucccccuagcgagggacugucucccagaccgccuaacagccccuccauuucuaucccuugcaugggcagcaaggcuuccagcccccauggccuugggucuccucugguugccagcccccggcucgaaaaacgccugggaggccuugcgccgcaaagagggucccggaucucugugcuguccgccagcccugucuccgacgugucuuacauguuuggaagcucccagucucuccugcacagcuccaauagcucucaccaguccagcucucgcucccuggagagccccgcuaacucuagcuccagccuccauucucugggcuccguuagccuuuguaccagacccuccgauuuccaagccccucggaauccgacacugaccauggggcagcccagaacaccucacucucccccucucgcuaaggaacaugccagcuccugucccccuucuauuaccaacagcaugguggacauccccauuguccugaucaauggaugcccggagccuggcuccucucccccucagcgcacgcccggccaccagaacagcgugcaaccgggggccgcuuccccuagcaaucccugcccugcgacacggucuaacucccagacccuuagcgaugcccccuuuacaaccugucccgagggaccugcuagagacaugcagccgaccaugaaauucgugauggauacaucuaaguauugguuuaaacccaauauuacgcgcgaacaggccaucgagcugcuccggaaggaagaaccuggcgccuucgucauuagagacuccagcucuuaccgcggguccuuuggacuggcucugaaaguucaagaagugcccgccagcgcgcagucccggccuggcgaggacagcaacgaucucaucagacacuuccugaucgagucuagcgcuaagggggugcaucuuaagggcgccgacgaggagcccuauuuuggaucccugucugccuucgucugccagcacagcauuauggcucucgcccugccuugcaaacugaccaucccgcagcgcgaacuuggcggggcugauggagccuccgacucuacagauagccccgcguccugucaaaagaaaucugccggcugccauacccucuaccugagcuccgugagcguugagacacugaccggggcucucgccgugcagaaggcuauuucuacgacauucgaacgggacauccugccuacccccaccgucgugcacuuuaaaguuacagagcagggaauuacccuuacagaugugcagagaaaggucuucuuucgccggcauuacccucugacgacccucagauucuguggcauggaccccgagcaacggaaauggcagaaguauugcaagccguccuggaucuuuggguucguggccaaaagccagacagaaccucaagagaaugucugucaccuguuugcggaauacgauauggugcagcccgccucucagguuaucggccuggugaccgcucuccuccaggacgccgagcgcauguga

SEQ ID NO: 1203 - protein, 433 aa, Artificial Sequence
  cyclin_B1__Homo_sapiens__P14635
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 1204 - RNA, 1302 nt, Artificial Sequence
  cyclin_B1__Homo_sapiens__AAH06510
auggcgcuccgagucaccaggaacucgaaaauuaaugcugaaaauaaggcgaagaucaacauggcaggcgcaaagcgcguuccuacggccccugcugcaaccuccaagcccggacugaggccaagaacagcucuuggggacauugguaacaaagucagugaacaacugcaggccaaaaugccuaugaagaaggaagcaaaaccuucagcuacuggaaaagucauugauaaaaaacuaccaaaaccucuugaaaagguaccuaugcuggugccagugccagugucugagccagugccagagccagaaccugagccagaaccugagccuguuaaagaagaaaaacuuucgccugagccuauuuugguugauacugccucuccaagcccaauggaaacaucuggaugugccccugcagaagaagaccugugucaggcuuucucugauguaauucuugcaguaaaugauguggaugcagaagauggagcugauccaaaccuuuguagugaauaugugaaagauauuuaugcuuaucugagacaacuugaggaagagcaagcagucagaccaaaauaccuacugggucgggaagucacuggaaacaugagagccauccuaauugacuggcuaguacagguucaaaugaaauucagguuguugcaggagaccauguacaugacugucuccauuauugaucgguucaugcagaauaauugugugcccaagaagaugcugcagcugguuggugucacugccauguuuauugcaagcaaauaugaagaaauguacccuccagaaauuggugacuuugcuuuugugacugacaacacuuauacuaagcaccaaaucagacagauggaaaugaagauucuaagagcuuuaaacuuuggucugggucggccucuaccuuugcacuuccuucggagagcaucuaagauuggagagguugaugucgagcaacauacuuuggccaaauaccugauggaacuaacuauguuggacuaugacauggugcacuuuccuccuucucaaauugcagcaggagcuuuuugcuuagcacugaaaauucuggauaauggugaauggacaccaacucuacaacauuaccugucauauacugaagaaucucuucuuccaguuaugcagcaccuggcuaagaauguagucaugguaaaucaaggacuuacaaagcacaugacugucaagaacaaguaugccacaucgaagcaugcuaagaucagcacucuaccacagcugaauucugcacuaguucaagauuuagccaaggcuguggcaaagguguaa

SEQ ID NO: 1205 - RNA, 1302 nt, Artificial Sequence
  derived and/or modified sequence opt1 from cyclin_B1__Homo_sapiens__AAH06510
auggcccugcgcgugacccggaacagcaagaucaacgccgagaacaaggcgaagaucaacauggccggcgccaagcgcguccccaccgccccggccgcgacguccaagcccgggcuccggccccgcaccgcccugggcgacaucgggaacaaggugagcgagcagcugcaggccaagaugcccaugaagaaggaggccaagccguccgcgaccggcaaggugaucgacaagaagcuccccaagccccuggagaagguccccaugcuggugccggugcccgucagcgagcccgugcccgagccggagcccgagcccgagcccgagccggugaaggaggagaagcucucccccgagcccauccuggucgacaccgccagccccuccccgauggagacgagcgggugcgcccccgccgaggaggaccugugccaggccuucuccgacgugauccucgcggugaacgacgucgacgccgaggacggcgccgaccccaaccugugcagcgaguacgugaaggacaucuacgccuaccugcggcagcucgaggaggagcaggccgugcgccccaaguaccugcugggccgggaggucaccgggaacaugcgcgcgauccucaucgacuggcugguccaggugcagaugaaguuccggcugcuccaggagaccauguacaugaccguguccaucaucgaccgcuucaugcagaacaacugcgugccgaagaagaugcugcagcuggugggcgucacggccauguucaucgccagcaaguacgaggagauguacccgcccgagaucggggacuucgccuucgugaccgacaacaccuacaccaagcaccagauccggcagauggagaugaagauccuccgcgcccugaacuucggccuggggcggccccucccccugcacuuccugcgccgggcguccaagaucggcgagguggacgucgagcagcacacgcucgccaaguaccugauggagcugaccaugcucgacuacgacauggugcacuucccgcccagccagaucgccgccggcgccuucugccuggcgcugaagauccucgacaacggggaguggacccccacccugcagcacuaccuguccuacacggaggagagccuccugcccgucaugcagcaccuggccaagaacguggugauggucaaccagggccucaccaagcacaugaccgugaagaacaaguacgccaccuccaagcacgccaagaucagcacgcugccccagcugaacuccgcgcucgugcaggaccuggccaaggccgucgccaagguguga

SEQ ID NO: 1206 - RNA, 1302 nt, Artificial Sequence
  derived and/or modified sequence opt2 from cyclin_B1__Homo_sapiens__AAH06510
auggcccuccgcgucacccgcaacuccaagaucaacgccgagaacaaggccaagaucaacauggccggcgccaagcgcguccccaccgcccccgccgccaccuccaagcccggccuccgcccccgcaccgcccucggcgacaucggcaacaaggucuccgagcagcuccaggccaagaugcccaugaagaaggaggccaagcccuccgccaccggcaaggucaucgacaagaagcuccccaagccccucgagaagguccccaugcucguccccguccccgucuccgagcccguccccgagcccgagcccgagcccgagcccgagcccgucaaggaggagaagcucucccccgagcccauccucgucgacaccgccucccccucccccauggagaccuccggcugcgcccccgccgaggaggaccucugccaggccuucuccgacgucauccucgccgucaacgacgucgacgccgaggacggcgccgaccccaaccucugcuccgaguacgucaaggacaucuacgccuaccuccgccagcucgaggaggagcaggccguccgccccaaguaccuccucggccgcgaggucaccggcaacaugcgcgccauccucaucgacuggcucguccagguccagaugaaguuccgccuccuccaggagaccauguacaugaccgucuccaucaucgaccgcuucaugcagaacaacugcguccccaagaagaugcuccagcucgucggcgucaccgccauguucaucgccuccaaguacgaggagauguacccccccgagaucggcgacuucgccuucgucaccgacaacaccuacaccaagcaccagauccgccagauggagaugaagauccuccgcgcccucaacuucggccucggccgcccccucccccuccacuuccuccgccgcgccuccaagaucggcgaggucgacgucgagcagcacacccucgccaaguaccucauggagcucaccaugcucgacuacgacaugguccacuucccccccucccagaucgccgccggcgccuucugccucgcccucaagauccucgacaacggcgaguggacccccacccuccagcacuaccucuccuacaccgaggagucccuccuccccgucaugcagcaccucgccaagaacgucgucauggucaaccagggccucaccaagcacaugaccgucaagaacaaguacgccaccuccaagcacgccaagaucuccacccucccccagcucaacuccgcccucguccaggaccucgccaaggccgucgccaaggucuga

SEQ ID NO: 1207 - RNA, 1302 nt, Artificial Sequence
  derived and/or modified sequence opt3 from cyclin_B1__Homo_sapiens__AAH06510
auggcccugagagugaccaggaacagcaagaucaaugcugagaacaaagcaaagauuaauauggccggcgcgaaacggguccccacagcuccugccgcaacuuccaagccagggcuccgcccgcgaacggcccuuggagacauagguaacaaaguuucugaacagcugcaagcuaagaugcccaugaagaaagaggcaaagccuucagccaccggcaaagugaucgauaagaaauugccaaagcccuuagaaaagguaccuaugcuggugccaguccccgugagugagccuguuccagaaccggagcccgagccugaaccagagcccgugaaagaagagaagcuaagcccugagccaauucucgucgacacagcuucccccucuccgauggaaacuucggggugcgccccugcggaggaagaucugugucaggcauucucagacgugauccuugccguaaaugauguugacgcugaggauggagccgaccccaaccugugcagcgaauacgugaaagauauuuaugcauacuugcgucagcucgaggaggaacaggcugucagaccaaaguaucugcugggcagggaggugaccgguaauaugcgggccauccucauagacugguuagugcaaguccagaugaaauuucgccugcuucaggaaacaauguacaugaccguuaguaucauugauagauucaugcagaacaauugugugccuaagaaaauguugcaacugguaggggugacugcgauguuuaucgccuccaaguaugaggaaauguaucccccagagauuggagacuucgcauuugucacagauaacaccuacacgaagcaccagaucaggcagauggagaugaaaauacuacgggcucucaauuucggccugggccgcccccuuccucugcacuuuuugagacgagccucuaagauuggggaaguggacguugagcagcauacucucgcuaaauaccugauggaauuaaccaugcuggacuacgauauggugcauuucccaccgagccaaaucgccgcaggagccuuuugccucgcucuuaagauucuggacaacggugaguggacacccacuuugcagcacuaucuauccuacaccgaagagucacugcucccugucaugcagcaucuggcgaaaaaugugguaaugguuaaccaaggccuuacaaagcacaugaccgugaagaauaaauaugcaacgaguaagcacgccaaaaucagcacucugccacaguugaacucugcucucguccaggaucuggccaaggcaguggccaaagucuga

SEQ ID NO: 1208 - RNA, 1302 nt, Artificial Sequence
  derived and/or modified sequence opt4 from cyclin_B1__Homo_sapiens__AAH06510
auggcccugagagugaccagaaacagcaagaucaacgccgagaacaaggccaagaucaacauggccggcgccaagagagugcccaccgcccccgccgccaccagcaagcccggccugagacccagaaccgcccugggcgacaucggcaacaaggugagcgagcagcugcaggccaagaugcccaugaagaaggaggccaagcccagcgccaccggcaaggugaucgacaagaagcugcccaagccccuggagaaggugcccaugcuggugcccgugcccgugagcgagcccgugcccgagcccgagcccgagcccgagcccgagcccgugaaggaggagaagcugagccccgagcccauccugguggacaccgccagccccagccccauggagaccagcggcugcgcccccgccgaggaggaccugugccaggccuucagcgacgugauccuggccgugaacgacguggacgccgaggacggcgccgaccccaaccugugcagcgaguacgugaaggacaucuacgccuaccugagacagcuggaggaggagcaggccgugagacccaaguaccugcugggcagagaggugaccggcaacaugagagccauccugaucgacuggcuggugcaggugcagaugaaguucagacugcugcaggagaccauguacaugaccgugagcaucaucgacagauucaugcagaacaacugcgugcccaagaagaugcugcagcuggugggcgugaccgccauguucaucgccagcaaguacgaggagauguacccccccgagaucggcgacuucgccuucgugaccgacaacaccuacaccaagcaccagaucagacagauggagaugaagauccugagagcccugaacuucggccugggcagaccccugccccugcacuuccugagaagagccagcaagaucggcgagguggacguggagcagcacacccuggccaaguaccugauggagcugaccaugcuggacuacgacauggugcacuucccccccagccagaucgccgccggcgccuucugccuggcccugaagauccuggacaacggcgaguggacccccacccugcagcacuaccugagcuacaccgaggagagccugcugcccgugaugcagcaccuggccaagaacguggugauggugaaccagggccugaccaagcacaugaccgugaagaacaaguacgccaccagcaagcacgccaagaucagcacccugccccagcugaacagcgcccuggugcaggaccuggccaaggccguggccaagguguga

SEQ ID NO: 1209 - RNA, 1302 nt, Artificial Sequence
  derived and/or modified sequence opt5 from cyclin_B1__Homo_sapiens__AAH06510
auggcccugagagugacccggaacagcaagaucaaugcugagaacaaagccaagauuaauauggcgggcgcuaaacgcguccccacagccccugccgcuacguccaagccggggcucagaccccggaccgcccugggagacaucggcaacaaaguuucugaacagcuucaagcuaagaugccuaugaagaaagaggccaagcccagcgcgacagggaaagugauugauaagaaacugccuaagccccucgaaaaggugccuaugcuggucccggugcccguuuccgagccugugcccgaaccugagcccgagccggaaccugagcccgucaaagaagagaaacuuucuccugagcccauccugguggacaccgccagccccuccccuauggaaacaucuggaugcgcuccggccgaggaagaucucugucaggcuuucagcgacguuauucuggccgugaaugaugucgacgcggaggauggcgccgaccccaaccugugcuccgaauacgugaaggauaucuaugcuuaccuccgccagcuggaggaggaacaggccgugagaccuaaguaucuucuggggcgggaggucaccggaaauaugcgcgcuauccucauugacuggcugguucaagugcagaugaaauuuagacuucugcaggaaacaauguacaugaccgugagcaucauugaucgguucaugcagaacaauuguguccccaagaaaaugcuccaacuggugggcguuacggccauguuuaucgccucuaaguaugaggaaauguacccucccgagauuggcgacuucgcuuuugugaccgauaacacauauaccaagcaccagauccgccagauggagaugaaaauucugagagcgcucaauuucgggcugggacggccgcuuccucugcauuuucuccgcagagccuccaagaucggcgaagucgacguggagcagcacacacuggcuaaauaccuuauggaacugaccaugcucgacuacgauaugguucauuuucccccuagccaaaucgccgccggggcuuucugccuggcccugaagauucucgacaacggagaguggacgcccacacugcagcacuaucuuucuuacaccgaagagucccugcucccugugaugcagcaucuggcgaaaaaugucgugauggucaaccaaggccuuacaaagcacaugaccgugaagaauaaauaugcuaccagcaagcacgccaaaaucucuacacugccccagcucaacuccgcccugguucaggaucuggcuaaggccguggcuaaagucuga

SEQ ID NO: 1210 - protein, 295 aa, Artificial Sequence
  cyclin_D1__Homo_sapiens__P24385
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 1211 - RNA, 888 nt, Artificial Sequence
  cyclin_D1__Homo_sapiens__AAA58392
auggaacaccagcuccugugcugcgaaguggaaaccauccgccgcgcguaccccgaugccaaccuccucaacgaccgggugcugcgggccaugcugaaggcggaggagaccugcgcgcccucgguguccuacuucaaaugugugcagaaggagguccugccguccaugcggaagaucgucgccaccuggaugcuggaggucugcgaggaacagaagugcgaggaggaggucuucccgcuggccaugaacuaccuggaccgcuuccugucgcuggagcccgugaaaaagagccgccugcagcugcugggggccacuugcauguucguggccucuaagaugaaggagaccaucccccugacggccgagaagcugugcaucuacaccgacaacuccauccggcccgaggagcugcugcaaauggagcugcuccuggugaacaagcucaaguggaaccuggccgcaaugaccccgcacgauuucauugaacacuuccucuccaaaaugccagaggcggaggagaacaaacagaucauccgcaaacacgcgcagaccuucguugcccucugugccacagaugugaaguucauuuccaauccgcccuccaugguggcagcggggagcgugguggccgcagugcaaggccugaaccugaggagccccaacaacuuccuguccuacuaccgccucacacgcuuccucuccagagugaucaagugugacccggacugccuccgggccugccaggagcagaucgaagcccugcuggagucaagccugcgccaggcccagcagaacauggaccccaaggccgccgaggaggaggaagaggaggaggaggagguggaccuggcuugcacacccaccgacgugcgggacguggacaucuga

SEQ ID NO: 1212 - RNA, 888 nt, Artificial Sequence
  derived and/or modified sequence opt1 from cyclin_D1__Homo_sapiens__AAA58392
auggagcaccagcugcucugcugcgagguggagaccauccgccgggccuaccccgacgccaaccugcugaacgaccgcguccuccgggcgaugcugaaggccgaggagaccugcgccccgagcguguccuacuucaagugcgugcagaaggagguccugcccagcaugcgcaagaucguggccacguggaugcucgaggugugcgaggagcagaagugcgaggaggaggucuucccccuggccaugaacuaccuggaccgguuccucucccuggagcccgugaagaagucccgccugcagcuccugggcgcgaccugcauguucguggccagcaagaugaaggagaccaucccgcugaccgccgagaagcucugcaucuacacggacaacagcauccggcccgaggagcugcugcagauggagcuccugcuggucaacaagcucaaguggaaccuggccgcgaugacgccccacgacuucaucgagcacuuccuguccaagaugcccgaggccgaggagaacaagcagaucauccgcaagcacgcccagaccuucguggcccucugcgccaccgacgugaaguucaucagcaacccgcccuccauggucgcggccgggagcgugguggccgccguccagggccugaaccugcggucccccaacaacuuccucagcuacuaccgccugacccgguuccugucccgcgugaucaagugcgaccccgacugccuccgggccugccaggagcagaucgaggcgcugcuggagagcucccuccgccaggcccagcagaacauggacccgaaggccgccgaggaggaggaggaggaggaggaggagguggaccuggccugcacccccaccgacguccgggacguggacaucuga

SEQ ID NO: 1213 - RNA, 888 nt, Artificial Sequence
  derived and/or modified sequence opt2 from cyclin_D1__Homo_sapiens__AAA58392
auggagcaccagcuccucugcugcgaggucgagaccauccgccgcgccuaccccgacgccaaccuccucaacgaccgcguccuccgcgccaugcucaaggccgaggagaccugcgcccccuccgucuccuacuucaagugcguccagaaggagguccuccccuccaugcgcaagaucgucgccaccuggaugcucgaggucugcgaggagcagaagugcgaggaggaggucuucccccucgccaugaacuaccucgaccgcuuccucucccucgagcccgucaagaagucccgccuccagcuccucggcgccaccugcauguucgucgccuccaagaugaaggagaccaucccccucaccgccgagaagcucugcaucuacaccgacaacuccauccgccccgaggagcuccuccagauggagcuccuccucgucaacaagcucaaguggaaccucgccgccaugaccccccacgacuucaucgagcacuuccucuccaagaugcccgaggccgaggagaacaagcagaucauccgcaagcacgcccagaccuucgucgcccucugcgccaccgacgucaaguucaucuccaacccccccuccauggucgccgccggcuccgucgucgccgccguccagggccucaaccuccgcucccccaacaacuuccucuccuacuaccgccucacccgcuuccucucccgcgucaucaagugcgaccccgacugccuccgcgccugccaggagcagaucgaggcccuccucgaguccucccuccgccaggcccagcagaacauggaccccaaggccgccgaggaggaggaggaggaggaggaggaggucgaccucgccugcacccccaccgacguccgcgacgucgacaucuga

SEQ ID NO: 1214 - RNA, 888 nt, Artificial Sequence
  derived and/or modified sequence opt3 from cyclin_D1__Homo_sapiens__AAA58392
auggagcaccagcugcucugcugugaaguggagaccaucagaagggccuaccccgacgcuaaccuucugaaugaucgggucuugcgcgcaauguuaaaggccgaagagacaugcgcgccuagcguuuccuauuucaaaugugugcaaaaggaaguacugccaucuaugcgaaaaauuguggcuacuuggaugcuagaggucugcgaggaacagaagugugaggaagagguguuuccgcucgccaugaacuaccuggaccguuuccuuucacuggagcccguuaaaaagaguagauugcagcuccugggcgcaacgugcauguuuguggccagcaagaugaaagaaaccauaccucugacagcugagaagcucuguaucuauacugauaauuccauuaggccagaagaguuacugcagauggaacuuuugcuggucaacaaacuaaaguggaaucucgcagccaugacaccccaugacuucaucgagcacuuucugucuaaaaugccugaggcugaagagaacaagcaaauuauccggaagcaugcccagaccuucguggcgcuuugcgcaaccgauguaaaauuuauaucgaauccacccucaaugguugccgcugggagcguggucgccgcagugcagggacugaacuugcgcaguccuaauaacuuccucuccuacuauagacugacuagguuuuuaucucgggugaucaagugugacccagauugccugcgcgcuugucaggaacaaauugaggcccuccuugaaagcucccugcgacaggcgcagcagaauauggacccgaaagccgcagaggaggaagaggaagaggaagaggaggucgauuuggcuugcacacccaccgacguuagagauguggacaucuga

SEQ ID NO: 1215 - RNA, 888 nt, Artificial Sequence
  derived and/or modified sequence opt4 from cyclin_D1__Homo_sapiens__AAA58392
auggagcaccagcugcugugcugcgagguggagaccaucagaagagccuaccccgacgccaaccugcugaacgacagagugcugagagccaugcugaaggccgaggagaccugcgcccccagcgugagcuacuucaagugcgugcagaaggaggugcugcccagcaugagaaagaucguggccaccuggaugcuggaggugugcgaggagcagaagugcgaggaggagguguucccccuggccaugaacuaccuggacagauuccugagccuggagcccgugaagaagagcagacugcagcugcugggcgccaccugcauguucguggccagcaagaugaaggagaccaucccccugaccgccgagaagcugugcaucuacaccgacaacagcaucagacccgaggagcugcugcagauggagcugcugcuggugaacaagcugaaguggaaccuggccgccaugaccccccacgacuucaucgagcacuuccugagcaagaugcccgaggccgaggagaacaagcagaucaucagaaagcacgcccagaccuucguggcccugugcgccaccgacgugaaguucaucagcaacccccccagcaugguggccgccggcagcgugguggccgccgugcagggccugaaccugagaagccccaacaacuuccugagcuacuacagacugaccagauuccugagcagagugaucaagugcgaccccgacugccugagagccugccaggagcagaucgaggcccugcuggagagcagccugagacaggcccagcagaacauggaccccaaggccgccgaggaggaggaggaggaggaggaggagguggaccuggccugcacccccaccgacgugagagacguggacaucuga

SEQ ID NO: 1216 - RNA, 888 nt, Artificial Sequence
  derived and/or modified sequence opt5 from cyclin_D1__Homo_sapiens__AAA58392
auggagcaccagcugcucugcugugaaguggagaccaucagacgggccuaccccgacgcuaaccugcuuaaugaucgcguccugagagccaugcucaaggcggaagagacaugcgcuccuagcguuuccuauuucaaaugugugcaaaaggaagugcugccgucuaugcggaaaauugucgccacguggaugcuugaggugugcgaggaacagaagugugaggaagagguuuuuccccuggccaugaacuaccucgaccgcuuccugagccuggagccugugaaaaaguccagacuccagcugcuuggcgcuaccugcauguuugucgccucuaagaugaaagaaacaaucccccugaccgcugagaagcucuguauuuauacagauaauagcauccggccugaggaacugcuucagauggaacugcuccuggugaacaaacugaaguggaaucucgccgcgaugacaccccaugacuucauugagcacuuucuguccaaaaugccugaggccgaagagaacaagcaaaucauccgcaagcaugcucagaccuucguugcccuuugcgcuaccgaugugaaauuuauuucuaauccgcccagcauggucgccgcgggguccgugguggccgcuguccagggacugaaccucagaagcccuaauaacuuccugucuuacuaucggcuuacgcgcuuucuguccagaguuaucaagugugaccccgauugccuccgggccugucaggaacaaauugaggcucugcuggaaagcucucuccgccaggcccagcagaauauggacccuaaagccgcugaggaggaagaggaagaggaagaggagguggaucuggcgugcacccccacagacgugagagaugucgacaucuga

SEQ ID NO: 1217 - protein, 216 aa, Artificial Sequence
  cyp-B__Homo_sapiens__P23284
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 1218 - RNA, 651 nt, Artificial Sequence
  cyp-B__Homo_sapiens__AAA36601
augcugcgccucuccgaacgcaacaugaaggugcuccuugccgccgcccucaucgcgggguccgucuucuuccugcugcugccgggaccuucugcggccgaugagaagaagaaggggcccaaagucaccgucaagguguauuuugaccuacgaauuggagaugaagauguaggccgggugaucuuuggucucuucggaaagacuguuccaaaaacaguggauaauuuuguggccuuagcuacaggagagaaaggauuuggcuacaaaaacagcaaauuccaucguguaaucaaggacuucaugauccagggcggagacuucaccaggggagauggcacaggaggaaagagcaucuacggugagcgcuuccccgaugagaacuucaaacugaagcacuacgggccuggcugggugagcauggccaacgcaggcaaagacaccaacggcucccaguucuucaucacgacagucaagacagccuggcuagauggcaagcaugugguguuuggcaaaguucuagagggcauggagguggugcggaagguggagagcaccaagacagacagccgggauaaaccccugaaggaugugaucaucgcagacugcggcaagaucgagguggagaagcccuuugccaucgccaaggaguag

SEQ ID NO: 1219 - RNA, 651 nt, Artificial Sequence
  derived and/or modified sequence opt1 from cyp-B__Homo_sapiens__AAA36601
augcugcgccucagcgagcggaacaugaaggugcugcuggccgccgcgcucaucgccggcuccgucuucuuccugcugcuccccgggccgagcgccgccgacgagaagaagaagggccccaaggugaccgugaaggucuacuucgaccugcgcaucggggacgaggacgugggccgggugaucuucgggcuguucggcaagaccguccccaagacgguggacaacuucguggcccucgcgaccggcgagaagggguucggcuacaagaacuccaaguuccaccgcgucaucaaggacuucaugauccagggcggggacuucacccgcggggacggcaccggcggcaagagcaucuacggggagcgguuccccgacgagaacuucaagcugaagcacuacgggccgggcuggguguccauggccaacgccggcaaggacacgaacgggagccaguucuucaucaccaccgugaagaccgccuggcuggacggcaagcacgucguguucgggaaggugcucgagggcauggaggucgugcggaagguggaguccacgaagaccgacagccgcgacaagccccugaaggacgucaucaucgcggacugcgggaagaucgagguggagaagcccuucgccaucgccaaggaguga

SEQ ID NO: 1220 - RNA, 651 nt, Artificial Sequence
  derived and/or modified sequence opt2 from cyp-B__Homo_sapiens__AAA36601
augcuccgccucuccgagcgcaacaugaagguccuccucgccgccgcccucaucgccggcuccgucuucuuccuccuccuccccggccccuccgccgccgacgagaagaagaagggccccaaggucaccgucaaggucuacuucgaccuccgcaucggcgacgaggacgucggccgcgucaucuucggccucuucggcaagaccguccccaagaccgucgacaacuucgucgcccucgccaccggcgagaagggcuucggcuacaagaacuccaaguuccaccgcgucaucaaggacuucaugauccagggcggcgacuucacccgcggcgacggcaccggcggcaaguccaucuacggcgagcgcuuccccgacgagaacuucaagcucaagcacuacggccccggcugggucuccauggccaacgccggcaaggacaccaacggcucccaguucuucaucaccaccgucaagaccgccuggcucgacggcaagcacgucgucuucggcaagguccucgagggcauggaggucguccgcaaggucgaguccaccaagaccgacucccgcgacaagccccucaaggacgucaucaucgccgacugcggcaagaucgaggucgagaagcccuucgccaucgccaaggaguga

SEQ ID NO: 1221 - RNA, 651 nt, Artificial Sequence
  derived and/or modified sequence opt3 from cyp-B__Homo_sapiens__AAA36601
augcugagacucagcgagaggaacaugaaggugcuucuggccgcugcauugaucgccggcuccgucuucuuuuuacugcuacccgggccuucugcggcugacgagaaaaagaaaggaccaaagguuaccgugaaaguauacuucgaucuccggauuggugacgaagaugugggccgcgucauauuugggcuguucggaaagacagugccgaagacuguugacaauuuuguggcccuugcaacgggcgaaaaagguuucggguauaagaacucaaaauuucaccgagucaucaaggauuucaugauucagggaggcgacuuuacccguggcgaugggacaggagguaaaaguaucuacggcgagagauuccccgacgaaaauuuuaagcugaagcauuaugggccuggaugggugagcauggccaacgcuggcaaagauacuaaugguucccaauucuuuauuaccacaguaaagaccgcaugguuggacgggaaacacguuguguucggaaagguccucgagggcauggagguggugaggaaagucgaaucuacuaagacagauucgcgggacaaaccacugaaggauguuaucauagccgacugcggcaagaucgagguggaaaaacccuucgcuauugccaaggaguga

SEQ ID NO: 1222 - RNA, 651 nt, Artificial Sequence
  derived and/or modified sequence opt4 from cyp-B__Homo_sapiens__AAA36601
augcugagacugagcgagagaaacaugaaggugcugcuggccgccgcccugaucgccggcagcguguucuuccugcugcugcccggccccagcgccgccgacgagaagaagaagggccccaaggugaccgugaagguguacuucgaccugagaaucggcgacgaggacgugggcagagugaucuucggccuguucggcaagaccgugcccaagaccguggacaacuucguggcccuggccaccggcgagaagggcuucggcuacaagaacagcaaguuccacagagugaucaaggacuucaugauccagggcggcgacuucaccagaggcgacggcaccggcggcaagagcaucuacggcgagagauuccccgacgagaacuucaagcugaagcacuacggccccggcugggugagcauggccaacgccggcaaggacaccaacggcagccaguucuucaucaccaccgugaagaccgccuggcuggacggcaagcacgugguguucggcaaggugcuggagggcauggagguggugagaaagguggagagcaccaagaccgacagcagagacaagccccugaaggacgugaucaucgccgacugcggcaagaucgagguggagaagcccuucgccaucgccaaggaguga

SEQ ID NO: 1223 - RNA, 651 nt, Artificial Sequence
  derived and/or modified sequence opt5 from cyp-B__Homo_sapiens__AAA36601
augcugagacucagcgagcggaacaugaaggugcugcuugccgcugcccugaucgcgggcuccgucuucuuucuccugcuucccgggccuucugcugccgacgagaaaaagaaaggaccgaagguuaccgugaaaguguacuucgaucugcgcauuggcgacgaagaugucgggagagugaucuuuggacucuucggcaagacaguucccaagacgguggacaauuuugucgcccuggcuaccggggaaaaaggauucggcuauaagaacagcaaauuucaccgggugauuaaggauuucaugauccagggcggggacuuuacacgcggagauggcaccgggggaaaauccauuuacggcgagagauucccugacgaaaauuuuaagcugaagcauuaugggcccggauggguuucuauggccaacgcuggcaaagauacaaauggcagccaauucuuuaucaccacagugaagaccgccuggcucgacgggaaacacgucguguucggaaaggugcuggagggcauggaggucguucggaaaguggaauccacgaagaccgauucucgcgacaaaccucuuaaggaugugaucauugcggacugcgggaagaucgaggucgaaaaacccuucgccauugcuaaggaguga

SEQ ID NO: 1224 - protein, 347 aa, Artificial Sequence
  DAM-10__Homo_sapiens__P43366
MPRGQKSKLRAREKRRKAREETQGLKVAHATAAEKEECPSSSPVLGDTPTSSPAAGIPQKPQGAPPTTTAAAAVSCTESDEGAKCQGEENASFSQATTSTESSVKDPVAWEAGMLMHFILRKYKMREPIMKADMLKVVDEKYKDHFTEILNGASRRLELVFGLDLKEDNPSGHTYTLVSKLNLTNDGNLSNDWDFPRNGLLMPLLGVIFLKGNSATEEEIWKFMNVLGAYDGEEHLIYGEPRKFITQDLVQEKYLKYEQVPNSDPPRYQFLWGPRAYAETTKMKVLEFLAKMNGATPRDFPSHYEEALRDEEERAQVRSSVRARRRTTATTFRARSRAPFSRSSHPM

SEQ ID NO: 1225 - RNA, 1044 nt, Artificial Sequence
  DAM-10__Homo_sapiens__AAD10634
augccucggggucagaagaguaagcuccgugcucgugagaaacgccgcaaggcgcgagaggagacccagggucucaagguugcucacgccacugcagcagagaaagaggagugccccuccuccucuccuguuuuaggggauacucccacaagcuccccugcugcuggcauuccccagaagccucagggagcuccacccaccaccacugcugcugcagcugugucauguaccgaaucugacgaaggugccaaaugccaaggugaggaaaaugcaaguuucucccaggccacaacauccacugagagcucagucaaagauccuguagccugggaggcaggaaugcugaugcacuucauucuacguaaguauaaaaugagagagcccauuaugaaggcagauaugcugaagguuguugaugaaaaguacaaggaucacuucacugagauccucaauggagccucucgccgcuuggagcucgucuuuggccuugauuugaaggaagacaacccuaguggccacaccuacacccucgucaguaagcuaaaccucaccaaugauggaaaccugagcaaugauugggacuuucccaggaaugggcuucugaugccucuccugggugugaucuucuuaaagggcaacucugccaccgaggaagagaucuggaaauucaugaauguguugggagccuaugauggagaggagcacuuaaucuauggggaaccccguaaguucaucacccaagaucuggugcaggaaaaauaucugaaguacgagcaggugcccaacagugaucccccacgcuaucaauuccuaugggguccgagagccuaugcugaaaccaccaagaugaaaguccucgaguuuuuggccaagaugaauggugccacuccccgugacuucccaucccauuaugaagaggcuuugagagaugaggaagagagagcccaaguccgauccaguguuagagccaggcgucgcacuacugccacgacuuuuagagcgcguucuagagccccauucagcagguccucccaccccauguga

SEQ ID NO: 1226 - RNA, 1044 nt, Artificial Sequence
  derived and/or modified sequence opt1 from DAM-10__Homo_sapiens__AAD10634
augccccgcggccagaaguccaagcugcgggcccgcgagaagcggcgcaaggcccgggaggagacccaggggcucaagguggcgcacgccaccgccgccgagaaggaggagugcccgagcagcucccccguccugggcgacacgcccaccagcucccccgccgcggggaucccgcagaagccccagggcgccccgcccaccaccacggccgccgcggccgugagcugcaccgaguccgacgagggggccaagugccagggcgaggagaacgccagcuucucccaggccaccaccagcacggaguccagcgugaaggaccccgucgcgugggaggccggcaugcugaugcacuucauccuccgcaaguacaagaugcgggagcccaucaugaaggccgacaugcugaaggugguggacgagaaguacaaggaccacuucaccgagauccugaacggggccucccgccggcucgagcuggucuucggccuggaccucaaggaggacaaccccagcgggcacaccuacacccugguguccaagcugaaccucacgaacgacggcaaccugagcaacgacugggacuucccccgcaacgggcugcucaugccgcugcugggcgugaucuuccucaagggcaacuccgccaccgaggaggagaucuggaaguucaugaacguccugggggcguacgacggcgaggagcaccugaucuacggggagccccggaaguucaucacccaggaccucgugcaggagaaguaccugaaguacgagcagguccccaacagcgacccgccccgcuaccaguuccuguggggcccccgggccuacgccgagaccacgaagaugaaggugcucgaguuccuggccaagaugaacggcgccacgccccgcgacuuccccucccacuacgaggaggcgcugcgggacgaggaggagcgcgcccaggugcggagcagcgugcgcgcccggcgccggaccaccgccaccaccuuccgcgcccgcucccgggcgccguucagccgcuccagccaccccauguga

SEQ ID NO: 1227 - RNA, 1044 nt, Artificial Sequence
  derived and/or modified sequence opt2 from DAM-10__Homo_sapiens__AAD10634
augccccgcggccagaaguccaagcuccgcgcccgcgagaagcgccgcaaggcccgcgaggagacccagggccucaaggucgcccacgccaccgccgccgagaaggaggagugccccuccuccucccccguccucggcgacacccccaccuccucccccgccgccggcaucccccagaagccccagggcgccccccccaccaccaccgccgccgccgccgucuccugcaccgaguccgacgagggcgccaagugccagggcgaggagaacgccuccuucucccaggccaccaccuccaccgaguccuccgucaaggaccccgucgccugggaggccggcaugcucaugcacuucauccuccgcaaguacaagaugcgcgagcccaucaugaaggccgacaugcucaaggucgucgacgagaaguacaaggaccacuucaccgagauccucaacggcgccucccgccgccucgagcucgucuucggccucgaccucaaggaggacaaccccuccggccacaccuacacccucgucuccaagcucaaccucaccaacgacggcaaccucuccaacgacugggacuucccccgcaacggccuccucaugccccuccucggcgucaucuuccucaagggcaacuccgccaccgaggaggagaucuggaaguucaugaacguccucggcgccuacgacggcgaggagcaccucaucuacggcgagccccgcaaguucaucacccaggaccucguccaggagaaguaccucaaguacgagcagguccccaacuccgaccccccccgcuaccaguuccucuggggcccccgcgccuacgccgagaccaccaagaugaagguccucgaguuccucgccaagaugaacggcgccaccccccgcgacuuccccucccacuacgaggaggcccuccgcgacgaggaggagcgcgcccagguccgcuccuccguccgcgcccgccgccgcaccaccgccaccaccuuccgcgcccgcucccgcgcccccuucucccgcuccucccaccccauguga

SEQ ID NO: 1228 - RNA, 1044 nt, Artificial Sequence
  derived and/or modified sequence opt3 from DAM-10__Homo_sapiens__AAD10634
augcccagaggccaaaagagcaaacugagggcccgggagaagcgccgaaaagcucgugaagagacccaggggcucaagguggcacacgccacagcggcugaaaaagaggaaugcccuuccucuucaccaguccuuggagacacuccgacgaguagccccgccgcagguaucccucagaagccacagggcgcucccccuaccacaacugccgcagccgcuguuuccuguaccgagucugaugagggggccaagugccagggagaagagaacgcgucguucucacaagcaacaaccagcacugaaaguuccgugaaagacccaguagccugggaggcuggcaugcugaugcauuuuauuuugagaaaguacaaaaugagggagcccauaaugaaggccgauauguuaaaaguggucgacgaaaaguauaaggaucacuucacagagauccugaauggugcaucucggcgccuagaacucguguuugggcuggaccuuaaagaggauaacccuagcggacauaccuacacgcugguuuccaaguugaaucucacuaacgacggcaaucugucaaacgauugggacuucccaagaaauggccugcucaugccguuacugggggugauuuuucuuaaaggaaacagugcuaccgaagaggagaucuggaaguucaugaaugucuugggugccuaugauggcgaggaacaccugauuuacggggaacccaggaaauuuaucacacaggaccuagugcaggagaaguaucucaaauacgaacagguaccuaacagcgauccaccccgguaucaauuccuguggggaccucgcgcguacgccgagacuaccaagaugaagguucuugaguuucuggcaaaaaugaauggcgcuacaccacgagacuuccccucucauuacgaagaggccuugagagacgaagaggaaagggcucaggugcgguccucaguccgugcccgcagaaggaccacggcaacuacauuucgggcccgaagccgcgcuccguucaguagaucuucccacccuauguga

SEQ ID NO: 1229 - RNA, 1044 nt, Artificial Sequence
  derived and/or modified sequence opt4 from DAM-10__Homo_sapiens__AAD10634
augcccagaggccagaagagcaagcugagagccagagagaagagaagaaaggccagagaggagacccagggccugaagguggcccacgccaccgccgccgagaaggaggagugccccagcagcagccccgugcugggcgacacccccaccagcagccccgccgccggcaucccccagaagccccagggcgccccccccaccaccaccgccgccgccgccgugagcugcaccgagagcgacgagggcgccaagugccagggcgaggagaacgccagcuucagccaggccaccaccagcaccgagagcagcgugaaggaccccguggccugggaggccggcaugcugaugcacuucauccugagaaaguacaagaugagagagcccaucaugaaggccgacaugcugaaggugguggacgagaaguacaaggaccacuucaccgagauccugaacggcgccagcagaagacuggagcugguguucggccuggaccugaaggaggacaaccccagcggccacaccuacacccuggugagcaagcugaaccugaccaacgacggcaaccugagcaacgacugggacuuccccagaaacggccugcugaugccccugcugggcgugaucuuccugaagggcaacagcgccaccgaggaggagaucuggaaguucaugaacgugcugggcgccuacgacggcgaggagcaccugaucuacggcgagcccagaaaguucaucacccaggaccuggugcaggagaaguaccugaaguacgagcaggugcccaacagcgacccccccagauaccaguuccuguggggccccagagccuacgccgagaccaccaagaugaaggugcuggaguuccuggccaagaugaacggcgccacccccagagacuuccccagccacuacgaggaggcccugagagacgaggaggagagagcccaggugagaagcagcgugagagccagaagaagaaccaccgccaccaccuucagagccagaagcagagcccccuucagcagaagcagccaccccauguga

SEQ ID NO: 1230 - RNA, 1044 nt, Artificial Sequence
  derived and/or modified sequence opt5 from DAM-10__Homo_sapiens__AAD10634
augcccagaggccaaaagagcaaacugcgggcccgcgagaagagacggaaagcucgcgaagagacccaggggcucaagguggcccacgcgacagcugccgaaaaagaggaaugcccuuccucuagcccgguccugggagacacgcccaccuccucuccugccgcuggcaucccccagaagccucagggggcucccccuacaaccacagccgccgcggccguuagcuguaccgaguccgaugagggagcuaagugccagggcgaagagaacgccucuuucagccaagcuacaaccuccacggaaagcucugugaaagacccgguggccugggaggcggggaugcuuaugcauuuuauucugagaaaguacaaaaugcgggagcccaucaugaaggccgauaugcucaaagucguggacgaaaaguauaaggaucacuucaccgagauucugaauggagcuucccgcagacuugaacugguuuuuggccucgaccugaaagaggauaacccuagcggccauacauacacccuggugucuaagcucaaucugacaaacgacgggaaucuuuccaacgauugggacuucccccggaauggacugcucaugccucugcuuggcgucaucuuucugaaagggaacagcgccaccgaagaggagauuuggaaguucaugaaugugcucggagcuuaugauggcgaggaacaccugaucuacggggaaccccgcaaauuuaucacgcaggaccugguucaggagaaguaucucaaauacgaacaggugccgaacucugauccucccagauaucaauuccuguggggaccucgggccuacgccgagacaaccaagaugaagguccuugaguuucuggcuaaaaugaauggcgcgacaccccgcgacuuccccucccauuacgaagaggcccucagagacgaagaggaacgggcucaggugcgcagcuccgugagagcccggagacgcaccaccgccacaacguuucgggcuagaucucgcgccccuuucagccgguccagccacccgauguga

SEQ ID NO: 1231 - protein, 811 aa, Artificial Sequence
  DEP1A__Homo_sapiens__Q5TB30
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQSLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 1232 - RNA, 2436 nt, Artificial Sequence
  DEP1A__Homo_sapiens__BAF91373
auggagagucagggugugccucccgggccuuaucgggccaccaagcuguggaaugaaguuaccacaucuuuucgagcaggaaugccucuaagaaaacacagacaacacuuuaaaaaauauggcaauuguuucacagcaggagaagcaguggauuggcuuuaugaccuauuaagaaauaauagcaauuuugguccugaaguuacaaggcaacagacuauccaacuguugaggaaauuucuuaagaaucauguaauugaagauaucaaagggagguggggaucagaaaauguugaugauaacaaccagcucuucagauuuccugcaacuucgccacuuaaaacucuaccacgaagguauccagaauugagaaaaaacaacauagagaacuuuuccaaagauaaagauagcauuuuuaaauuacgaaacuuaucucguagaacuccuaaaaggcauggauuacauuuaucucaggaaaauggcgagaaaauaaagcaugaaauaaucaaugaagaucaagaaaaugcaauugauaauagagaacuaagccaggaagauguugaagaaguuuggagauauguuauucugaucuaccugcaaaccauuuuaggugugccaucccuagaagaagucauaaauccaaaacaaguaauuccccaauauauaauguacaacauggccaauacaaguaaacguggaguaguuauacuacaaaacaaaucagaugaccucccucacuggguauuaucugccaugaagugccuagcaaauuggccaagaagcaaugauaugaauaauccaacuuauguuggauuugaacgagauguauucagaacaaucgcagauuauuuucuagaucucccugaaccucuacuuacuuuugaauauuacgaauuauuuguaaacauuuugguuguuuguggcuacaucacaguuucagauagauccagugggauacauaaaauucaagaugauccacagucuucaaaauuccuucacuuaaacaauuugaauuccuucaaaucaacugagugccuucuucucagucugcuucauagagaaaaaaacaaagaagaaucagauucuacugagagacuacagauaagcaauccaggauuucaagaaagaugugcuaagaaaaugcagcuaguuaauuuaagaaacagaagagugagugcuaaugacauaaugggaggaaguugucauaauuuaauaggguuaaguaauaugcaugaucuauccucuaacagcaaaccaaggugcuguucuuuggaaggaauuguagaugugccagggaauucaaguaaagaggcauccagugucuuucaucaaucuuuuccgaacauagaaggacaaaauaauaaacuguuuuuagagucuaagcccaaacaggaauuccuguugaaucuucauucagaggaaaauauucaaaagccauucagugcugguuuuaagagaaccucuacuuugacuguucaagaccaagaggaguuguguaaugggaaaugcaagucaaaacagcuuuguaggucucagaguuugcuuuuaagaaguaguacaagaaggaauaguuauaucaauacaccaguggcugaaauuaucaugaaaccaaauguuggacaaggcagcacaagugugcaaacagcuauggaaagugaacucggagagucuagugccacaaucaauaaaagacucugcaaaaguacaauagaacuuucagaaaauucuuuacuuccagcuucuucuauguugacuggcacacaaagcuugcugcaaccucauuuagagaggguugccaucgaugcucuacaguuauguuguuuguuacuucccccaccaaaucguagaaagcuucaacuuuuaaugcguaugauuucccgaaugagucaaaauguugauaugcccaaacuucaugaugcaauggguacgaggucacugaugauacauaccuuuucucgauguguguuaugcugugcugaagaaguggaucuugaugagcuucuugcuggaagauuaguuucuuucuuaauggaucaucaucaggaaauucuucaaguacccucuuacuuacagacugcaguggaaaaacaucuugacuacuuaaaaaagggacauauugaaaauccuggagauggacuauuugcuccuuugccaacuuacucauacuguaagcagauuagugcucaggaguuugaugagcaaaaaguuucuaccucucaagcugcaauugcagaacuuuuagaaaauauuauuaaaaacaggaguuuaccucuaaaggagaaaagaaaaaaacuaaaacaguuucagaaggaauauccuuugauauaucagaaaagauuuccaaccacggagagugaagcagcacuuuuuggugacaaaccuacaaucaagcaaccaaugcugauuuuaagaaaaccaaaguuccguagucuaagauaa

SEQ ID NO: 1233 - RNA, 2436 nt, Artificial Sequence
  derived and/or modified sequence opt1 from DEP1A__Homo_sapiens__BAF91373
auggagagccagggcgugcccccggggcccuaccgcgccaccaagcuguggaacgaggucaccacguccuuccgggccggcaugccccuccgcaagcaccggcagcacuucaagaaguacgggaacugcuucaccgcgggcgaggccguggacuggcuguacgaccugcuccgcaacaacagcaacuucgggcccgaggugacccggcagcagaccauccagcugcugcgcaaguuccucaagaaccacgucaucgaggacaucaagggccgguggggcuccgagaacguggacgacaacaaccagcuguuccgcuucccggccacgagcccccugaagacccucccccggcgcuaccccgagcugcggaagaacaacaucgagaacuucuccaaggacaaggacagcaucuucaagcugcgcaaccucucccggcgcaccccgaagcggcacgggcugcaccugagccaggagaacggcgagaagaucaagcacgagaucaucaacgaggaccaggagaacgccaucgacaaccgcgagcucucccaggaggacguggaggaggucuggcgguacgugauccugaucuaccugcagaccauccucggggugcccagccuggaggaggucaucaaccccaagcaggucaucccccaguacaucauguacaacauggccaacacguccaagcgcggcguggugauccugcagaacaagagcgacgaccucccgcacugggugcuguccgcgaugaagugccuggccaacuggccccggagcaacgacaugaacaaccccaccuacgugggguucgagcgcgacgucuuccggaccaucgccgacuacuuccucgaccugcccgagccgcugcucaccuucgaguacuacgagcuguucgugaacauccugguggucugcggcuacaucacgguguccgaccgcagcuccggcauccacaagauccaggacgacccccagagcuccaaguuccuccaccugaacaaccugaacagcuucaagagcaccgagugccuccugcugucccuccugcaccgcgagaagaacaaggaggagagcgacuccaccgagcggcugcagaucagcaaccccggguuccaggagcgcugcgccaagaagaugcagcucgugaaccugcggaaccgccgggucuccgcgaacgacaucaugggcgggagcugccacaaccugaucggccucuccaacaugcacgaccugagcuccaacagcaagccccgcugcugcucccuggagggcaucguggacgugccggggaacagcuccaaggaggccagcuccgucuuccaccagagcuuccccaacaucgagggccagaacaacaagcuguuccuggaguccaagcccaagcaggaguuccugcucaaccugcacagcgaggagaacauccagaagcccuucuccgccggguucaagcggaccagcacgcugaccgugcaggaccaggaggagcugugcaacggcaagugcaagagcaagcagcucugccgcucccagagccugcugcuccgguccagcacccgccggaacuccuacaucaacaccccggucgccgagaucaucaugaagcccaacguggggcagggcagcacguccgugcagaccgccauggagagcgagcugggcgaguccagcgcgaccaucaacaagcgccugugcaaguccaccaucgagcucagcgagaacucccugcugcccgccagcuccaugcucacggggacccagagccugcugcagccccaccucgagcgggucgccaucgacgcccugcagcugugcugccuccugcugccgccgcccaaccgccggaagcuccagcugcugaugcgcaugaucucccggaugagccagaacguggacaugcccaagcuccacgacgccaugggcacccgcagccugaugauccacaccuucucccggugcgugcugugcugcgcggaggaggucgaccucgacgagcugcuggccgggcgccucgugagcuuccugauggaccaccaccaggagauccuccaggugcccuccuaccuccagacggccgucgagaagcaccuggacuaccugaagaagggccacaucgagaaccccggggacggccucuucgcgccccugccgaccuacagcuacugcaagcagaucuccgcccaggaguucgacgagcagaaggugagcaccucccaggccgccaucgccgagcugcucgagaacaucaucaagaaccgcagccugccccugaaggagaagcggaagaagcucaagcaguuccagaaggaguacccccugaucuaccagaagcgcuuccccaccacggaguccgaggccgcccuguucggcgacaagccgaccaucaagcagcccaugcucauccugcggaagcccaaguuccgcagccugcgguga

SEQ ID NO: 1234 - RNA, 2436 nt, Artificial Sequence
  derived and/or modified sequence opt2 from DEP1A__Homo_sapiens__BAF91373
auggagucccagggcgucccccccggccccuaccgcgccaccaagcucuggaacgaggucaccaccuccuuccgcgccggcaugccccuccgcaagcaccgccagcacuucaagaaguacggcaacugcuucaccgccggcgaggccgucgacuggcucuacgaccuccuccgcaacaacuccaacuucggccccgaggucacccgccagcagaccauccagcuccuccgcaaguuccucaagaaccacgucaucgaggacaucaagggccgcuggggcuccgagaacgucgacgacaacaaccagcucuuccgcuuccccgccaccuccccccucaagacccucccccgccgcuaccccgagcuccgcaagaacaacaucgagaacuucuccaaggacaaggacuccaucuucaagcuccgcaaccucucccgccgcacccccaagcgccacggccuccaccucucccaggagaacggcgagaagaucaagcacgagaucaucaacgaggaccaggagaacgccaucgacaaccgcgagcucucccaggaggacgucgaggaggucuggcgcuacgucauccucaucuaccuccagaccauccucggcguccccucccucgaggaggucaucaaccccaagcaggucaucccccaguacaucauguacaacauggccaacaccuccaagcgcggcgucgucauccuccagaacaaguccgacgaccucccccacuggguccucuccgccaugaagugccucgccaacuggccccgcuccaacgacaugaacaaccccaccuacgucggcuucgagcgcgacgucuuccgcaccaucgccgacuacuuccucgaccuccccgagccccuccucaccuucgaguacuacgagcucuucgucaacauccucgucgucugcggcuacaucaccgucuccgaccgcuccuccggcauccacaagauccaggacgacccccaguccuccaaguuccuccaccucaacaaccucaacuccuucaaguccaccgagugccuccuccucucccuccuccaccgcgagaagaacaaggaggaguccgacuccaccgagcgccuccagaucuccaaccccggcuuccaggagcgcugcgccaagaagaugcagcucgucaaccuccgcaaccgccgcgucuccgccaacgacaucaugggcggcuccugccacaaccucaucggccucuccaacaugcacgaccucuccuccaacuccaagccccgcugcugcucccucgagggcaucgucgacguccccggcaacuccuccaaggaggccuccuccgucuuccaccaguccuuccccaacaucgagggccagaacaacaagcucuuccucgaguccaagcccaagcaggaguuccuccucaaccuccacuccgaggagaacauccagaagcccuucuccgccggcuucaagcgcaccuccacccucaccguccaggaccaggaggagcucugcaacggcaagugcaaguccaagcagcucugccgcucccagucccuccuccuccgcuccuccacccgccgcaacuccuacaucaacacccccgucgccgagaucaucaugaagcccaacgucggccagggcuccaccuccguccagaccgccauggaguccgagcucggcgaguccuccgccaccaucaacaagcgccucugcaaguccaccaucgagcucuccgagaacucccuccuccccgccuccuccaugcucaccggcacccagucccuccuccagccccaccucgagcgcgucgccaucgacgcccuccagcucugcugccuccuccuccccccccccaaccgccgcaagcuccagcuccucaugcgcaugaucucccgcaugucccagaacgucgacaugcccaagcuccacgacgccaugggcacccgcucccucaugauccacaccuucucccgcugcguccucugcugcgccgaggaggucgaccucgacgagcuccucgccggccgccucgucuccuuccucauggaccaccaccaggagauccuccagguccccuccuaccuccagaccgccgucgagaagcaccucgacuaccucaagaagggccacaucgagaaccccggcgacggccucuucgccccccuccccaccuacuccuacugcaagcagaucuccgcccaggaguucgacgagcagaaggucuccaccucccaggccgccaucgccgagcuccucgagaacaucaucaagaaccgcucccucccccucaaggagaagcgcaagaagcucaagcaguuccagaaggaguacccccucaucuaccagaagcgcuuccccaccaccgaguccgaggccgcccucuucggcgacaagcccaccaucaagcagcccaugcucauccuccgcaagcccaaguuccgcucccuccgcuga

SEQ ID NO: 1235 - RNA, 2436 nt, Artificial Sequence
  derived and/or modified sequence opt3 from DEP1A__Homo_sapiens__BAF91373
auggagagccagggcgugcccccugggccauacagagccaccaagcuguggaacgaagucacaacuuccuucagggcuggaaugccgcuccggaaacaccgccaacauuuuaagaaauaugguaauugcuucacggcaggcgaggccguugacuggcuuuacgaucuguugcgaaacaauucuaacuuugggcccgaagugacccgucagcagacaauccaguuacugagaaaguuccugaaaaaucacguaauugaggacauaaagggaagguggggcucagaaaacguggaugacaauaaccaacucuuucgguucccugcgaccaguccacugaagacucuuccccgcagauauccugagcugaggaaaaauaacaucgagaauuuuagcaaggauaaagacuccauuuucaaguugcggaaccucucucgccgaacaccaaaaagacauggucugcaccugucgcaggaaaauggggagaagaucaagcaugaaauuaucaacgaggaucaggagaaugcuauagacaacagggaacucucacaggaggaugucgaagagguguggcgguacguuaucuuaauuuaucugcaaaccauccuuggagugcccagcuuggaagaggucauuaacccuaaacaggugaucccacaguacauaauguauaauauggccaacacaaguaagcguggcguaguuauucugcagaauaaauccgacgaucuaccgcacugggugcucucugcaaugaagugucuggccaacuggccccgcagcaaugacaugaacaauccuacuuacgucggcuuugagagagauguguucaggaccaucgcugacuacuuucuugaccugccagaacccuugcucacguucgaguauuacgaacuguuugugaacauuuuagucguuugcggguauaucacuguguccgaucggucaaguggaauccacaaaauucaagacgauccucagagcucuaaguuccugcaucucaauaaccuuaauuccuucaaaucaaccgagugucuguugcuaagccugcuccaccgagaaaagaacaaggaggagagugacucuacagaacgccugcagauauccaauccagguuuucaagagagaugcgccaaaaagaugcagcuuguaaaccugaggaaucggcgcgugagcgcaaacgauaucaugggcgggucgugucauaacuugauuggacucucuaauaugcacgaccuguccucaaacaguaaacccagaugcuguagcuuagaaggcaucgucgaugugccggguaauuccucuaaggaggcuagcucaguuuuccaccagaguuuuccuaacauagaagggcagaauaacaaacuguuccuagaguccaagcccaagcaagaguuucuccugaaucuucauagcgaagagaacauucagaaaccauucucugccggauuuaagaggacuucaaccuugacagugcaggaccaggaggaacugugcaauggcaaauguaagaguaaacaacucugccguagccagucccugcuucugcggucuucgacccgaagaaacagcuacaucaauacgccugucgcggagaucauuaugaagcccaacgugggccagggguccacuucaguacagacagcaauggaaagugaguugggagaaucuagcgccaccaucaauaagaggcucuguaaauccacuauugagcugucagaaaacagcuuacugccagcuucuuccaugcuaacagguacccaaagucuccugcagccccaccuugagcgcguugccauagaugcauugcagcugugcugccuccuguuaccuccaccgaaucggagaaagcugcagcuuuugaugaggaugaucagccgcaugucucaaaacguggacaugcccaaacuccaugaugcuaugggcacgcgaucccugaugauucacaccuucucacgguguguccuaugcugugccgaggaaguggaccuggacgagcuccuggcggggcgucuugucagcuuuuugauggaucaucaccaggaaauccuacaggugccuaguuauuuacaaacagccguugagaagcaccucgacuaccugaaaaagggacauaucgaaaacccaggcgauggucuuuucgcaccccugccuacuuauucguacugcaagcagauuuccgcucaggaguuugacgagcagaaagugucuaccagccaagccgcuauagccgaauugcucgagaauaucauuaagaacagaucacugccacuaaaagaaaagaggaaaaagcugaaacaguuccagaaggaguacccccucaucuaucagaagcgcuuuccgacaacugaaagugaggcagcccuguucggggauaaaccuaccauuaagcaaccaaugcuuaucuugcggaaacccaaguucagaucccugagguga

SEQ ID NO: 1236 - RNA, 2436 nt, Artificial Sequence
  derived and/or modified sequence opt4 from DEP1A__Homo_sapiens__BAF91373
auggagagccagggcgugccccccggccccuacagagccaccaagcuguggaacgaggugaccaccagcuucagagccggcaugccccugagaaagcacagacagcacuucaagaaguacggcaacugcuucaccgccggcgaggccguggacuggcuguacgaccugcugagaaacaacagcaacuucggccccgaggugaccagacagcagaccauccagcugcugagaaaguuccugaagaaccacgugaucgaggacaucaagggcagauggggcagcgagaacguggacgacaacaaccagcuguucagauuccccgccaccagcccccugaagacccugcccagaagauaccccgagcugagaaagaacaacaucgagaacuucagcaaggacaaggacagcaucuucaagcugagaaaccugagcagaagaacccccaagagacacggccugcaccugagccaggagaacggcgagaagaucaagcacgagaucaucaacgaggaccaggagaacgccaucgacaacagagagcugagccaggaggacguggaggagguguggagauacgugauccugaucuaccugcagaccauccugggcgugcccagccuggaggaggugaucaaccccaagcaggugaucccccaguacaucauguacaacauggccaacaccagcaagagaggcguggugauccugcagaacaagagcgacgaccugccccacugggugcugagcgccaugaagugccuggccaacuggcccagaagcaacgacaugaacaaccccaccuacgugggcuucgagagagacguguucagaaccaucgccgacuacuuccuggaccugcccgagccccugcugaccuucgaguacuacgagcuguucgugaacauccugguggugugcggcuacaucaccgugagcgacagaagcagcggcauccacaagauccaggacgacccccagagcagcaaguuccugcaccugaacaaccugaacagcuucaagagcaccgagugccugcugcugagccugcugcacagagagaagaacaaggaggagagcgacagcaccgagagacugcagaucagcaaccccggcuuccaggagagaugcgccaagaagaugcagcuggugaaccugagaaacagaagagugagcgccaacgacaucaugggcggcagcugccacaaccugaucggccugagcaacaugcacgaccugagcagcaacagcaagcccagaugcugcagccuggagggcaucguggacgugcccggcaacagcagcaaggaggccagcagcguguuccaccagagcuuccccaacaucgagggccagaacaacaagcuguuccuggagagcaagcccaagcaggaguuccugcugaaccugcacagcgaggagaacauccagaagcccuucagcgccggcuucaagagaaccagcacccugaccgugcaggaccaggaggagcugugcaacggcaagugcaagagcaagcagcugugcagaagccagagccugcugcugagaagcagcaccagaagaaacagcuacaucaacacccccguggccgagaucaucaugaagcccaacgugggccagggcagcaccagcgugcagaccgccauggagagcgagcugggcgagagcagcgccaccaucaacaagagacugugcaagagcaccaucgagcugagcgagaacagccugcugcccgccagcagcaugcugaccggcacccagagccugcugcagccccaccuggagagaguggccaucgacgcccugcagcugugcugccugcugcugcccccccccaacagaagaaagcugcagcugcugaugagaaugaucagcagaaugagccagaacguggacaugcccaagcugcacgacgccaugggcaccagaagccugaugauccacaccuucagcagaugcgugcugugcugcgccgaggagguggaccuggacgagcugcuggccggcagacuggugagcuuccugauggaccaccaccaggagauccugcaggugcccagcuaccugcagaccgccguggagaagcaccuggacuaccugaagaagggccacaucgagaaccccggcgacggccuguucgccccccugcccaccuacagcuacugcaagcagaucagcgcccaggaguucgacgagcagaaggugagcaccagccaggccgccaucgccgagcugcuggagaacaucaucaagaacagaagccugccccugaaggagaagagaaagaagcugaagcaguuccagaaggaguacccccugaucuaccagaagagauuccccaccaccgagagcgaggccgcccuguucggcgacaagcccaccaucaagcagcccaugcugauccugagaaagcccaaguucagaagccugagauga

SEQ ID NO: 1237 - RNA, 2436 nt, Artificial Sequence
  derived and/or modified sequence opt5 from DEP1A__Homo_sapiens__BAF91373
auggagagccagggcgugcccccugggccguacagagccaccaagcuguggaacgaagucacaacguccuuccgggcuggaaugccccuccgcaaacacagacaacauuuuaagaaauauggcaauugcuucaccgccggggaggcgguugacuggcuguacgaucuucugcggaacaauucuaacuuuggaccugaagugacacgccagcagaccauccagcuccugagaaaguuccuuaaaaaucacgugauugaggacaucaagggccggugggggagcgaaaacgucgaugacaauaaccaacuguuucgcuuccccgcuacauccccucucaagacccugcccagacgguauccugagcugcgcaaaaauaacauugagaauuuuucuaaggauaaagacagcaucuucaagcucagaaaccugucccggcgcacaccgaaaagacauggacuucaccugucucaggaaaauggcgagaagauuaagcaugaaaucaucaacgaggaucaggagaaugccauugacaaccgggaacucagccaggaggauguggaagagguuuggcgcuacgugauccugauuuaucuucaaaccauccugggcguccccucccucgaagaggugauuaacccuaaacagguuaucccccaguacauuauguauaauauggccaacacgagcaagagagggguggucauccugcagaauaaaucugacgaucugccucacugggugcucuccgcuaugaagugucuggccaacuggccccggagcaaugacaugaacaauccgaccuacgugggauuugagagagaugucuuccgcacaaucgcugacuacuuucuugaccugccugaaccccuccugaccuucgaguauuacgaacuuuuuguuaacauucugguggugugcggcuauaucacagucucugaucgguccagcgggauucacaaaauccaagacgauccucagucuuccaaguuccuccaucugaauaaccugaauagcuucaaauccaccgagugucuccugcuuucucugcuccacagagaaaagaacaaggaggagagcgacuccacggaacgccugcagauuagcaaucccggauuucaagagcggugcgccaaaaagaugcagcuugugaaccugagaaaucgccggguuucugcgaacgauaucaugggcggguccugucauaaccucaucggacugagcaauaugcacgaccugucuagcaacuccaaacccagaugcuguucucucgaaggcauuguggaugucccuggcaauagcuccaaggaggccagcucuguguuccaccaguccuuuccgaacaucgaagggcagaauaacaaacuguuccuugagagcaagcccaagcaagaguuucugcucaaucugcauucugaagagaacauucagaaaccuuucuccgcuggauuuaagcgcacaagcacccugacaguucaggaccaggaggaacuuugcaauggcaaauguaaguccaaacaacucugccggucucagagccugcugcucagauccucuacccgccggaacagcuacaucaauacccccguggccgagauuaucaugaagccuaacgucgggcagggauccacaagcgugcagacggcuauggaaucugagcugggcgaauccagcgccaccaucaauaagagacuuuguaaaucuacaauugagcuguccgaaaacagccuccugcccgcgucuagcaugcugaccgggacacaaucccuucuccagccgcaccuggagcgggucgccaucgaugcucugcagcucugcugccugcuucugccucccccuaaucgcagaaagcuccagcugcugaugcggaugauuagcagaaugucucaaaacguggacaugcccaaacuucaugaugccaugggaacccgcucccucaugauccacacguucagccgguguguucugugcugugcugaggaaguggaccuggacgagcuccuggccggcagacuugucuccuuucugauggaucaucaccaggaaauucuccaggugccuucuuaucugcaaacagccguugagaagcaccuggacuaccuuaaaaagggccauaucgaaaaccccggggauggacucuucgcuccgcugccuaccuauagcuacugcaagcagauuuccgcgcaggaguuugacgagcagaaagugucuaccagccaagccgcuaucgccgaacugcucgagaauaucauuaagaaccgcucccugccccuuaaagaaaagcggaaaaagcugaaacaguuccagaaggaguacccccucaucuaucagaagagauuuccuacaaccgaaucugaggccgcucuguucggcgauaaaccgacaauuaagcaacccaugcugauccuucgcaaaccuaaguucagaagccugcgguga

SEQ ID NO: 1238 - protein, 98 aa, Artificial Sequence
  E7__Human_papillomavirus_type_16__P03129
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 1239 - RNA, 297 nt, Artificial Sequence
  E7__Human_papillomavirus_type_16__AAA46940
augcauggagauacaccuacauugcaugaauauauguuagauuugcaaccagagacaacugaucucuacuguuaugagcaauuaaaugacagcucagaggaggaggaugaaauagaugguccagcuggacaagcagaaccggacagagcccauuacaauauuguaaccuuuuguugcaagugugacucuacgcuucgguugugcguacaaagcacacacguagacauucguacuuuggaagaccuguuaaugggcacacuaggaauugugugccccaucuguucucagaaaccauaa

SEQ ID NO: 1240 - RNA, 297 nt, Artificial Sequence
  derived and/or modified sequence opt1 from E7__Human_papillomavirus_type_16__AAA46940
augcacggcgacacccccacccugcacgaguacaugcucgaccugcagccggagacgaccgaccuguacugcuacgagcagcucaacgacagcuccgaggaggaggacgagaucgacgggcccgccggccaggccgagcccgaccgcgcgcacuacaacaucgugaccuucugcugcaagugcgacagcacccugcggcugugcguccaguccacgcacguggacauccgcacccucgaggaccugcugauggggacccucggcaucgugugccccaucugcagccagaagccguga

SEQ ID NO: 1241 - RNA, 297 nt, Artificial Sequence
  derived and/or modified sequence opt2 from E7__Human_papillomavirus_type_16__AAA46940
augcacggcgacacccccacccuccacgaguacaugcucgaccuccagcccgagaccaccgaccucuacugcuacgagcagcucaacgacuccuccgaggaggaggacgagaucgacggccccgccggccaggccgagcccgaccgcgcccacuacaacaucgucaccuucugcugcaagugcgacuccacccuccgccucugcguccaguccacccacgucgacauccgcacccucgaggaccuccucaugggcacccucggcaucgucugccccaucugcucccagaagcccuga

SEQ ID NO: 1242 - RNA, 297 nt, Artificial Sequence
  derived and/or modified sequence opt3 from E7__Human_papillomavirus_type_16__AAA46940
augcacggcgacacccccacacugcaugaguacaugcucgaucuucagccugaaacuacggaccuguauugcuacgagcaauugaacgauagcuccgaagaggaagacgagaucgaugggccagccggacaggcugagccggacagagcacacuauaauauugugaccuucuguugcaagugugauucuacauuaaggcugugcguccagucaacucauguugacauacggacccuagaagaucuccugauggguacacuuggcaucgugugucccauuugcagucagaaaccuuga

SEQ ID NO: 1243 - RNA, 297 nt, Artificial Sequence
  derived and/or modified sequence opt4 from E7__Human_papillomavirus_type_16__AAA46940
augcacggcgacacccccacccugcacgaguacaugcuggaccugcagcccgagaccaccgaccuguacugcuacgagcagcugaacgacagcagcgaggaggaggacgagaucgacggccccgccggccaggccgagcccgacagagcccacuacaacaucgugaccuucugcugcaagugcgacagcacccugagacugugcgugcagagcacccacguggacaucagaacccuggaggaccugcugaugggcacccugggcaucgugugccccaucugcagccagaagcccuga

SEQ ID NO: 1244 - RNA, 297 nt, Artificial Sequence
  derived and/or modified sequence opt5 from E7__Human_papillomavirus_type_16__AAA46940
augcacggcgacacccccacacugcaugaguacaugcucgaucugcagccugaaacgaccgaccuuuauugcuacgagcaacugaacgauagcuccgaagaggaagacgagaucgaugggccggccggacaggcugagcccgacagagcccacuauaauauugugacauucuguugcaagugugauucuacccuccggcugugcguccagagcacacauguugacauccgcacccuugaagaucugcucaugggcacacuggggauuguguguccuaucugcucccagaaacccuga

SEQ ID NO: 1245 - protein, 105 aa, Artificial Sequence
  E7__Human_papillomavirus_type_18__P06788
MHGPKATLQDIVLHLEPQNEIPVDLLCHEQLSDSEEENDEIDGVNHQHLPARRAEPQRHTMLCMCCKCEARIKLVVESSADDLRAFQQLFLNTLSFVCPWCASQQ

SEQ ID NO: 1246 - RNA, 318 nt, Artificial Sequence
  E7__Human_papillomavirus_type_18__AAA46947
augcauggaccuaaggcaacauugcaagacauuguauugcauuuagagccccaaaaugaaauuccgguugaccuucuaugucacgagcaauuaagcgacucagaggaagaaaacgaugaaauagauggaguuaaucaucaacauuuaccagcccgacgagcugaaccacaacgucacacaauguuguguauguguuguaagugugaagccagaauuaagcuaguaguagaaagcucagcagacgaccuucgagcauuccagcagcuguuucugaacacccuguccuuuguguguccguggugugcaucccagcaguaa

SEQ ID NO: 1247 - RNA, 318 nt, Artificial Sequence
  derived and/or modified sequence opt1 from E7__Human_papillomavirus_type_18__AAA46947
augcacggccccaaggccacccugcaggacaucgugcuccaccuggagccgcagaacgagauccccgucgaccugcucugccacgagcagcugagcgacuccgaggaggagaacgacgagaucgacggggugaaccaccagcaccuccccgcccgccgggcggagccccagcgccacaccaugcucugcaugugcugcaagugcgaggcccggaucaagcugguggucgagagcuccgccgacgaccugcgcgccuuccagcagcuguuccugaacacgcugagcuucgugugcccguggugcgccucccagcaguga

SEQ ID NO: 1248 - RNA, 318 nt, Artificial Sequence
  derived and/or modified sequence opt2 from E7__Human_papillomavirus_type_18__AAA46947
augcacggccccaaggccacccuccaggacaucguccuccaccucgagccccagaacgagauccccgucgaccuccucugccacgagcagcucuccgacuccgaggaggagaacgacgagaucgacggcgucaaccaccagcaccuccccgcccgccgcgccgagccccagcgccacaccaugcucugcaugugcugcaagugcgaggcccgcaucaagcucgucgucgaguccuccgccgacgaccuccgcgccuuccagcagcucuuccucaacacccucuccuucgucugccccuggugcgccucccagcaguga

SEQ ID NO: 1249 - RNA, 318 nt, Artificial Sequence
  derived and/or modified sequence opt3 from E7__Human_papillomavirus_type_18__AAA46947
augcacggccccaaggccacccugcaggacaucgugcuccaucuugagccucaaaacgaaauuccagucgaucuguugugccacgagcaguuaagcgacuccgaagaggaaaaugaugagauagacgggguuaaccaucagcaucugccggcuagaagggcagagccccagcggcacacaaugcuauguaugugcuguaaaugcgaagcccgcaucaagcucgugguagagucuucagcggaugaccugcgagcuuuccaacagcuuuuucugaauacuuugaguuucguguguccuuggugcgccagccagcaguga

SEQ ID NO: 1250 - RNA, 318 nt, Artificial Sequence
  derived and/or modified sequence opt4 from E7__Human_papillomavirus_type_18__AAA46947
augcacggccccaaggccacccugcaggacaucgugcugcaccuggagccccagaacgagauccccguggaccugcugugccacgagcagcugagcgacagcgaggaggagaacgacgagaucgacggcgugaaccaccagcaccugcccgccagaagagccgagccccagagacacaccaugcugugcaugugcugcaagugcgaggccagaaucaagcuggugguggagagcagcgccgacgaccugagagccuuccagcagcuguuccugaacacccugagcuucgugugccccuggugcgccagccagcaguga

SEQ ID NO: 1251 - RNA, 318 nt, Artificial Sequence
  derived and/or modified sequence opt5 from E7__Human_papillomavirus_type_18__AAA46947
augcacggccccaaggccacccugcaggacaucgugcuccaucuggagccucaaaacgaaauuccggucgaucuucugugccacgagcagcucagcgacuccgaagaggaaaaugaugagaucgacgggguuaaccaucagcaucugcccgcuagacgggccgagccucagcgccacacaaugcuuuguaugugcuguaaaugcgaagcgagaauuaagcuggugguggagucuagcgcugaugaccuccgggccuuccaacagcuguuucugaauacgcucuccuucgucugucccuggugcgccucucagcaguga

SEQ ID NO: 1252 - protein, 98 aa, Artificial Sequence
  E7__Human_papillomavirus_type_31__P17387
MRGETPTLQDYVLDLQPEATDLHCYEQLPDSSDEEDVIDSPAGQAEPDTSNYNIVTFCCQCKSTLRLCVQSTQVDIRILQELLMGSFGIVCPNCSTRL

SEQ ID NO: 1253 - RNA, 297 nt, Artificial Sequence
  E7__Human_papillomavirus_type_31__AAA46951
augcguggagaaacaccuacguugcaagacuauguguuagauuugcaaccugaggcaacugaccuccacuguuaugagcaauuacccgacagcucagaugaggaggaugucauagacaguccagcuggacaagcagaaccggacacauccaauuacaauaucguuaccuuuuguugucaguguaagucuacacuucguuuguguguacagagcacacaaguagauauucgcauauugcaagagcuguuaaugggcucauuuggaaucgugugccccaacuguucuacuagacuguaa

SEQ ID NO: 1254 - RNA, 297 nt, Artificial Sequence
  derived and/or modified sequence opt1 from E7__Human_papillomavirus_type_31__AAA46951
augcgcggcgagacccccacccugcaggacuacgugcucgaccugcagccggaggccacggaccugcacugcuacgagcagcuccccgacagcuccgacgaggaggacgucaucgacagccccgccgggcaggcggagcccgacaccuccaacuacaacaucgugaccuucugcugccagugcaagagcacccugcggcugugcgugcaguccacgcaggucgacauccgcauccuccaggagcugcugaugggcagcuucgggaucgugugcccgaacugcuccacccggcucuga

SEQ ID NO: 1255 - RNA, 297 nt, Artificial Sequence
  derived and/or modified sequence opt2 from E7__Human_papillomavirus_type_31__AAA46951
augcgcggcgagacccccacccuccaggacuacguccucgaccuccagcccgaggccaccgaccuccacugcuacgagcagcuccccgacuccuccgacgaggaggacgucaucgacucccccgccggccaggccgagcccgacaccuccaacuacaacaucgucaccuucugcugccagugcaaguccacccuccgccucugcguccaguccacccaggucgacauccgcauccuccaggagcuccucaugggcuccuucggcaucgucugccccaacugcuccacccgccucuga

SEQ ID NO: 1256 - RNA, 297 nt, Artificial Sequence
  derived and/or modified sequence opt3 from E7__Human_papillomavirus_type_31__AAA46951
augagaggcgagacccccacacugcaggacuacgugcucgaucuucaaccugaagccacugaccugcacugcuaugagcaguugccagauagcuccgacgaagaggaugucaucgacucuccggcugggcaggcagaacccgauacgucaaacuacaauauuguuaccuucuguugccaguguaagaguacauuaaggcugugcgugcaaagcacucagguagacauacggauccuacaggagcuccugaugggauccuuugguauuguguguccuaacugcucuacccgccuuuga

SEQ ID NO: 1257 - RNA, 297 nt, Artificial Sequence
  derived and/or modified sequence opt4 from E7__Human_papillomavirus_type_31__AAA46951
augagaggcgagacccccacccugcaggacuacgugcuggaccugcagcccgaggccaccgaccugcacugcuacgagcagcugcccgacagcagcgacgaggaggacgugaucgacagccccgccggccaggccgagcccgacaccagcaacuacaacaucgugaccuucugcugccagugcaagagcacccugagacugugcgugcagagcacccagguggacaucagaauccugcaggagcugcugaugggcagcuucggcaucgugugccccaacugcagcaccagacuguga

SEQ ID NO: 1258 - RNA, 297 nt, Artificial Sequence
  derived and/or modified sequence opt5 from E7__Human_papillomavirus_type_31__AAA46951
augagaggcgagacccccacacugcaggacuacgugcucgaucugcaaccugaagccacggaccuucacugcuaugagcagcugccggauagcuccgacgaagaggaugucaucgacucucccgcugggcaggccgaaccugauaccagcaacuacaauauuguuacauucuguugccaguguaaguccacccuccggcugugcgugcaaucuacacagguggacauccgcauucuucaggagcugcucaugggcagcuuuggaaucgucugucccaacugcuccaccagacuguga

SEQ ID NO: 1259 - protein, 97 aa, Artificial Sequence
  E7__Human_papillomavirus_type_33__P06429
MRGHKPTLKEYVLDLYPEPTDLYCYEQLSDSSDEDEGLDRPDGQAQPATADYYIVTCCHTCNTTVRLCVNSTASDLRTIQQLLMGTVNIVCPTCAQQ

SEQ ID NO: 1260 - RNA, 294 nt, Artificial Sequence
  E7__Human_papillomavirus_type_33__AAA46959
augagaggacacaagccaacguuaaaggaauauguuuuagauuuauauccugaaccaacugaccuauacugcuaugagcaauuaagugacagcucagaugaggaugaaggcuuggaccggccagauggacaagcacaaccagccacagcugauuacuacauuguaaccuguugucacacuuguaacaccacaguucguuuaugugucaacaguacagcaagugaccuacgaaccauacagcaacuacuuaugggcacagugaauauugugugcccuaccugugcacaacaauaa

SEQ ID NO: 1261 - RNA, 294 nt, Artificial Sequence
  derived and/or modified sequence opt1 from E7__Human_papillomavirus_type_33__AAA46959
augcgcggccacaagcccacccugaaggaguacgugcucgaccuguacccggagcccaccgaccuguacugcuacgagcagcucagcgacuccagcgacgaggacgaggggcuggaccggcccgacggccaggcccagcccgccacggcggacuacuacaucgugaccugcugccacacgugcaacaccaccguccgccugugcgugaacuccaccgccagcgaccuccggaccauccagcagcugcugauggggaccgucaacaucgugugcccgacgugcgcccagcaguga

SEQ ID NO: 1262 - RNA, 294 nt, Artificial Sequence
  derived and/or modified sequence opt2 from E7__Human_papillomavirus_type_33__AAA46959
augcgcggccacaagcccacccucaaggaguacguccucgaccucuaccccgagcccaccgaccucuacugcuacgagcagcucuccgacuccuccgacgaggacgagggccucgaccgccccgacggccaggcccagcccgccaccgccgacuacuacaucgucaccugcugccacaccugcaacaccaccguccgccucugcgucaacuccaccgccuccgaccuccgcaccauccagcagcuccucaugggcaccgucaacaucgucugccccaccugcgcccagcaguga

SEQ ID NO: 1263 - RNA, 294 nt, Artificial Sequence
  derived and/or modified sequence opt3 from E7__Human_papillomavirus_type_33__AAA46959
augagaggccacaagcccacccugaaagaguacgugcucgaccuuuauccugaaccaacagaucuguacugcuaugagcaguugagcgacuccucugaugaagacgagggguuagauaggccggacggacaagcccagcccgcuacugcagauuacuauaucgucacguguugccauaccuguaacacaacuguucggcugugcguaaauucaaccgccagugaccuacgcacaauucagcagcuccugauggguaccgugaacauaguguguccuacuugcgcgcaacaguga

SEQ ID NO: 1264 - RNA, 294 nt, Artificial Sequence
  derived and/or modified sequence opt4 from E7__Human_papillomavirus_type_33__AAA46959
augagaggccacaagcccacccugaaggaguacgugcuggaccuguaccccgagcccaccgaccuguacugcuacgagcagcugagcgacagcagcgacgaggacgagggccuggacagacccgacggccaggcccagcccgccaccgccgacuacuacaucgugaccugcugccacaccugcaacaccaccgugagacugugcgugaacagcaccgccagcgaccugagaaccauccagcagcugcugaugggcaccgugaacaucgugugccccaccugcgcccagcaguga

SEQ ID NO: 1265 - RNA, 294 nt, Artificial Sequence
  derived and/or modified sequence opt5 from E7__Human_papillomavirus_type_33__AAA46959
augagaggccacaagcccacccugaaagaguacgugcucgaccuguauccugaaccgacagaucuuuacugcuaugagcagcugagcgacuccucugaugaagacgaggggcucgaucggcccgacggacaagcccagccugcuacggccgauuacuauaucgucaccuguugccauacauguaacaccacaguucgccugugcgugaauagcaccgcguccgaccuuagaacaauucagcagcugcucaugggcaccgugaacaucgucugucccacgugcgcucaacaguga

SEQ ID NO: 1266 - protein, 99 aa, Artificial Sequence
  E7__Human_papillomavirus_type_35__P27230
MHGEITTLQDYVLDLEPEATDLYCYEQLCDSSEEEEDTIDGPAGQAKPDTSNYNIVTSCCKCEATLRLCVQSTHIDIRKLEDLLMGTFGIVCPGCSQRA

SEQ ID NO: 1267 - RNA, 300 nt, Artificial Sequence
  E7__Human_papillomavirus_type_35__AAA46967
augcauggagaaauaacuacauugcaagacuauguuuuagauuuggaacccgaggcaacugaccuauacuguuaugagcaauugugugacagcucagaggaggaggaagauacuauugacgguccagcuggacaagcaaaaccagacaccuccaauuauaauauuguaacguccuguuguaaaugugaggcgacacuacgucuguguguacagagcacacacauugacauacguaaauuggaagauuuauuaaugggcacauuuggaauagugugccccggcuguucacagagagcauaa

SEQ ID NO: 1268 - RNA, 300 nt, Artificial Sequence
  derived and/or modified sequence opt1 from E7__Human_papillomavirus_type_35__AAA46967
augcacggcgagaucaccacccugcaggacuacgugcucgaccuggagcccgaggccacggaccuguacugcuacgagcagcucugcgacagcuccgaggaggaggaggacaccaucgacgggccggccggccaggcgaagcccgacaccagcaacuacaacaucgucaccuccugcugcaagugcgaggccacgcugcgccugugcgugcagagcacccacaucgacauccggaagcucgaggaccugcugauggggaccuucggcaucgugugccccgggugcucccagcgcgccuga

SEQ ID NO: 1269 - RNA, 300 nt, Artificial Sequence
  derived and/or modified sequence opt2 from E7__Human_papillomavirus_type_35__AAA46967
augcacggcgagaucaccacccuccaggacuacguccucgaccucgagcccgaggccaccgaccucuacugcuacgagcagcucugcgacuccuccgaggaggaggaggacaccaucgacggccccgccggccaggccaagcccgacaccuccaacuacaacaucgucaccuccugcugcaagugcgaggccacccuccgccucugcguccaguccacccacaucgacauccgcaagcucgaggaccuccucaugggcaccuucggcaucgucugccccggcugcucccagcgcgccuga

SEQ ID NO: 1270 - RNA, 300 nt, Artificial Sequence
  derived and/or modified sequence opt3 from E7__Human_papillomavirus_type_35__AAA46967
augcacggcgagaucaccacacugcaggacuacgugcucgaucuugaacccgaggccacugaccuguauugcuacgaacaauugugugauagcuccgaggaagaggaggacacgauugaugggccugcuggacaggcaaagccagacaccucuaacuauaauauagucacaucaugcuguaaaugcgaagccacuuuaagacuguguguucagaguacccauaucgauauuaggaagcuagaggaccuccugauggguacauucggcaucgugugcccgggguguagccagcgggcguga

SEQ ID NO: 1271 - RNA, 300 nt, Artificial Sequence
  derived and/or modified sequence opt4 from E7__Human_papillomavirus_type_35__AAA46967
augcacggcgagaucaccacccugcaggacuacgugcuggaccuggagcccgaggccaccgaccuguacugcuacgagcagcugugcgacagcagcgaggaggaggaggacaccaucgacggccccgccggccaggccaagcccgacaccagcaacuacaacaucgugaccagcugcugcaagugcgaggccacccugagacugugcgugcagagcacccacaucgacaucagaaagcuggaggaccugcugaugggcaccuucggcaucgugugccccggcugcagccagagagccuga

SEQ ID NO: 1272 - RNA, 300 nt, Artificial Sequence
  derived and/or modified sequence opt5 from E7__Human_papillomavirus_type_35__AAA46967
augcacggcgagaucaccacacugcaggacuacgugcucgaucuggaacccgaggccacggaccuuuauugcuacgaacaacugugugauagcuccgaggaagaggaggacaccauugaugggccugcuggacaggccaagccggacacaucuaacuauaauaucgucaccagcugcuguaagugcgaagcgacacucagacuguguguucaguccacccauauugauauccggaaacuugaggaccugcucaugggcacauucgggauugugugccccggauguucucagcgcgcuuga

SEQ ID NO: 1273 - protein, 109 aa, Artificial Sequence
  E7__Human_papillomavirus_type_39__P24837
MRGPKPTLQEIVLDLCPYNEIQPVDLVCHEQLGESEDEIDEPDHAVNHQHQLLARRDEPQRHTIQCSCCKCNNTLQLVVEASRDTLRQLQQLFMDSLGFVCPWCATANQ

SEQ ID NO: 1274 - RNA, 330 nt, Artificial Sequence
  E7__Human_papillomavirus_type_39__AAA47051
augcguggaccaaagcccaccuugcaggaaauuguauuagauuuauguccuuacaaugaaauacagccgguugaccuuguaugucacgagcaauuaggagagucagaggaugaaauagaugaacccgaccaugcaguuaaucaccaacaucaacuacuagccagacgggaugaaccacagcgucacacaauacaguguucguguuguaaguguaacaacacacugcagcugguaguagaagccucacgggauacucugcgacaacuacagcagcuguuuauggacucacuaggauuuguguguccguggugugcaacugcaaaccaguaa

SEQ ID NO: 1275 - RNA, 330 nt, Artificial Sequence
  derived and/or modified sequence opt1 from E7__Human_papillomavirus_type_39__AAA47051
augcgcggccccaagccgacccugcaggagaucgugcucgaccugugccccuacaacgagauccagcccgucgaccuggugugccacgagcagcucggggagagcgaggacgagaucgacgagcccgaccacgccgugaaccaccagcaccagcugcuggcccggcgcgacgagccgcagcggcacaccauccagugcuccugcugcaagugcaacaacacgcuccagcuggucguggaggcgagccgcgacacccugcggcagcuccagcagcuguucauggacucccugggcuucgugugccccuggugcgccaccgccaaccaguga

SEQ ID NO: 1276 - RNA, 330 nt, Artificial Sequence
  derived and/or modified sequence opt2 from E7__Human_papillomavirus_type_39__AAA47051
augcgcggccccaagcccacccuccaggagaucguccucgaccucugccccuacaacgagauccagcccgucgaccucgucugccacgagcagcucggcgaguccgaggacgagaucgacgagcccgaccacgccgucaaccaccagcaccagcuccucgcccgccgcgacgagccccagcgccacaccauccagugcuccugcugcaagugcaacaacacccuccagcucgucgucgaggccucccgcgacacccuccgccagcuccagcagcucuucauggacucccucggcuucgucugccccuggugcgccaccgccaaccaguga

SEQ ID NO: 1277 - RNA, 330 nt, Artificial Sequence
  derived and/or modified sequence opt3 from E7__Human_papillomavirus_type_39__AAA47051
augagaggccccaagccuacccugcaggagaucgugcucgaccuuugcccauacaacgaaauucaaccggucgaucugguuugucacgagcaguugggggaaagcgaggacgaaauagaugagcccgaccaugccgugaaucaccagcaucaguuacuggcuaggcgggaugagccucaacgccacacaauccagugcuccuguugcaaauguaacaauacucuacagcucguaguggaagcaucucgagacacgcugcgucagcuucaacagcuguucauggauucauugggauuugucugcccauggugugccaccgcgaaccaguga

SEQ ID NO: 1278 - RNA, 330 nt, Artificial Sequence
  derived and/or modified sequence opt4 from E7__Human_papillomavirus_type_39__AAA47051
augagaggccccaagcccacccugcaggagaucgugcuggaccugugccccuacaacgagauccagcccguggaccuggugugccacgagcagcugggcgagagcgaggacgagaucgacgagcccgaccacgccgugaaccaccagcaccagcugcuggccagaagagacgagccccagagacacaccauccagugcagcugcugcaagugcaacaacacccugcagcuggugguggaggccagcagagacacccugagacagcugcagcagcuguucauggacagccugggcuucgugugccccuggugcgccaccgccaaccaguga

SEQ ID NO: 1279 - RNA, 330 nt, Artificial Sequence
  derived and/or modified sequence opt5 from E7__Human_papillomavirus_type_39__AAA47051
augagaggccccaagccuacccugcaggagaucgugcucgaccugugcccguacaacgaaauucaacccgucgaucuuguuugucacgagcagcugggggaaagcgaggacgaaaucgaugagccugaccaugccgugaaucaccagcaucagcuccuggcucggcgcgaugagccccaaagacacacaauucagugcuccuguugcaaauguaacaauacgcuucagcugguggucgaagccucucgggacacccuccgccagcugcaacagcuguucauggauagccucggauuugugugcccuuggugugcgacagcuaaccaguga

SEQ ID NO: 1280 - protein, 106 aa, Artificial Sequence
  E7__Human_papillomavirus_type_45__P21736
MHGPRETLQEIVLHLEPQNELDPVDLLCYEQLSESEEENDEADGVSHAQLPARRAEPQRHKILCVCCKCDGRIELTVESSAEDLRTLQQLFLSTLSFVCPWCATNQ

SEQ ID NO: 1281 - RNA, 321 nt, Artificial Sequence
  E7__Human_papillomavirus_type_45__CAA52574
augcauggaccccgggaaacacugcaagaaauuguauugcauuuggaaccucagaaugaauuagauccuguugaccuguuguguuacgagcaauuaagcgagucagaggaggaaaacgaugaagcagauggaguuagucaugcacaacuaccagcccgacgagccgaaccacagcgucacaaaauuuuguguguauguuguaagugugacggcagaauugagcuuacaguagagagcucggcagaggaccuuagaacacuacagcagcuguuuuugagcaccuuguccuuuguguguccguggugugcaacuaaccaauaa

SEQ ID NO: 1282 - RNA, 321 nt, Artificial Sequence
  derived and/or modified sequence opt1 from E7__Human_papillomavirus_type_45__CAA52574
augcacggcccccgcgagacccugcaggagaucgugcuccaccuggagccgcagaacgagcuggaccccgucgaccuccugugcuacgagcagcugagcgaguccgaggaggagaacgacgaggccgacggggugagccacgcccagcuccccgcgcggcgcgccgagccccagcggcacaagauccugugcgugugcugcaagugcgacggccgcaucgagcugaccgucgaguccagcgccgaggaccuccggacgcugcagcagcuguuccucuccacccugagcuucgugugcccguggugcgccaccaaccaguga

SEQ ID NO: 1283 - RNA, 321 nt, Artificial Sequence
  derived and/or modified sequence opt2 from E7__Human_papillomavirus_type_45__CAA52574
augcacggcccccgcgagacccuccaggagaucguccuccaccucgagccccagaacgagcucgaccccgucgaccuccucugcuacgagcagcucuccgaguccgaggaggagaacgacgaggccgacggcgucucccacgcccagcuccccgcccgccgcgccgagccccagcgccacaagauccucugcgucugcugcaagugcgacggccgcaucgagcucaccgucgaguccuccgccgaggaccuccgcacccuccagcagcucuuccucuccacccucuccuucgucugccccuggugcgccaccaaccaguga

SEQ ID NO: 1284 - RNA, 321 nt, Artificial Sequence
  derived and/or modified sequence opt3 from E7__Human_papillomavirus_type_45__CAA52574
augcacggccccagagagacccugcaggaaaucgugcuccaucuugagccucaaaacgaacuggacccagucgauuuguuaugcuacgagcagcugagcgaauccgaggaggaaaaugacgaggccgaugggguuucucacgcucagcuaccggcaaggcgggccgaaccccagcgccauaagauucucugugugugcuguaaaugcgacggacgaauagagcugacaguagagucaagugcggaagaucuucguacucugcaacaguuguuccucagcacgcuguccuuuguguguccuuggugcgcuaccaaccaguga

SEQ ID NO: 1285 - RNA, 321 nt, Artificial Sequence
  derived and/or modified sequence opt4 from E7__Human_papillomavirus_type_45__CAA52574
augcacggccccagagagacccugcaggagaucgugcugcaccuggagccccagaacgagcuggaccccguggaccugcugugcuacgagcagcugagcgagagcgaggaggagaacgacgaggccgacggcgugagccacgcccagcugcccgccagaagagccgagccccagagacacaagauccugugcgugugcugcaagugcgacggcagaaucgagcugaccguggagagcagcgccgaggaccugagaacccugcagcagcuguuccugagcacccugagcuucgugugccccuggugcgccaccaaccaguga

SEQ ID NO: 1286 - RNA, 321 nt, Artificial Sequence
  derived and/or modified sequence opt5 from E7__Human_papillomavirus_type_45__CAA52574
augcacggccccagagagacccugcaggaaaucgugcuccaucuggagccucagaacgaacuugacccggucgaucugcucugcuacgagcagcugagcgaauccgaggaggaaaaugacgaggccgaugggguuucucacgcucagcuucccgcccggcgcgcggaaccucagagacauaagauucugugugugugcuguaaaugcgacggacggaucgagcucacaguggagagcuccgcugaagaucugcgcacgcugcaacaacucuuccugucuacccuuagcuuugucugucccuggugcgccacaaaccaguga

SEQ ID NO: 1287 - protein, 101 aa, Artificial Sequence
  E7__Human_papillomavirus_type_51__P26558
MRGNVPQLKDVVLHLTPQTEIDLQCYEQFDSSEEEDEVDNMRDQLPERRAGQATCYRIEAPCCRCSSVVQLAVESSGDTLRVVQQMLMGELSLVCPCCANN

SEQ ID NO: 1288 - RNA, 306 nt, Artificial Sequence
  E7__Human_papillomavirus_type_51__M62877.1
augcgugguaauguaccacaauuaaaagauguaguauugcauuuaacaccacagacugaaauugacuugcaaugcuacgagcaauuugacagcucagaggaggaggaugaaguagauaauaugcgugaccagcuaccagaaagacgggcuggacaggcuacguguuacagaauugaagcuccguguugcagguguucaaguguaguacaacuggcaguggaaagcaguggagacacccuucgcguuguacagcagauguuaaugggcgaacuaagccugguuugcccguguugugcgaacaacuag

SEQ ID NO: 1289 - RNA, 306 nt, Artificial Sequence
  derived and/or modified sequence opt1 from E7__Human_papillomavirus_type_51__M62877.1
augcgcggcaacgugccccagcugaaggacgucgugcuccaccugaccccgcagaccgagaucgaccugcagugcuacgagcaguucgacagcuccgaggaggaggacgagguggacaacaugcgggaccagcuccccgagcgccgggccgggcaggccacgugcuaccgcaucgaggcgcccugcugccggugcagcuccgucgugcagcuggccguggagagcuccggcgacacccugcgcgucgugcagcagaugcucaugggggagcugagccuggugugccccugcugcgccaacaacuga

SEQ ID NO: 1290 - RNA, 306 nt, Artificial Sequence
  derived and/or modified sequence opt2 from E7__Human_papillomavirus_type_51__M62877.1
augcgcggcaacgucccccagcucaaggacgucguccuccaccucaccccccagaccgagaucgaccuccagugcuacgagcaguucgacuccuccgaggaggaggacgaggucgacaacaugcgcgaccagcuccccgagcgccgcgccggccaggccaccugcuaccgcaucgaggcccccugcugccgcugcuccuccgucguccagcucgccgucgaguccuccggcgacacccuccgcgucguccagcagaugcucaugggcgagcucucccucgucugccccugcugcgccaacaacuga

SEQ ID NO: 1291 - RNA, 306 nt, Artificial Sequence
  derived and/or modified sequence opt3 from E7__Human_papillomavirus_type_51__M62877.1
augagaggcaacgugccccagcugaaggacgucguucuccaccuuaccccucaaacagagaucgaucugcagugcuacgaacaguucgacagcuccgaggaagaggaugaaguggacaauaugagggaucaguugccagagcggcgcgccgggcaagcuacuuguuaucgaauugaggcaccgugcugucguuguucuucaguagugcaguuagccgucgaaaguagcggagacacgcugagagugguucagcagaugcuaaugggugagcucucccuggugugccccugcugugcgaacaauuga

SEQ ID NO: 1292 - RNA, 306 nt, Artificial Sequence
  derived and/or modified sequence opt4 from E7__Human_papillomavirus_type_51__M62877.1
augagaggcaacgugccccagcugaaggacguggugcugcaccugaccccccagaccgagaucgaccugcagugcuacgagcaguucgacagcagcgaggaggaggacgagguggacaacaugagagaccagcugcccgagagaagagccggccaggccaccugcuacagaaucgaggcccccugcugcagaugcagcagcguggugcagcuggccguggagagcagcggcgacacccugagaguggugcagcagaugcugaugggcgagcugagccuggugugccccugcugcgccaacaacuga

SEQ ID NO: 1293 - RNA, 306 nt, Artificial Sequence
  derived and/or modified sequence opt5 from E7__Human_papillomavirus_type_51__M62877.1
augagaggcaacgugccccagcugaaggacgucguucuccaccugaccccucaaacagagaucgaucuucagugcuacgaacaguucgacagcuccgaggaagaggaugaaguggacaauaugcgggaucagcugccggagcgcagagccgggcaagcuacguguuaucggauugaggcccccugcugucgcugcucuagcgugguccagcucgcgguggaauccucuggagacacccugagaguugugcagcagaugcuuaugggcgagcugagccucgucuguccuugcugugcuaacaauuga

SEQ ID NO: 1294 - protein, 99 aa, Artificial Sequence
  E7__Human_papillomavirus_type_52__P36831
MRGDKATIKDYILDLQPETTDLHCYEQLGDSSDEEDTDGVDRPDGQAEQATSNYYIVTYCHSCDSTLRLCIHSTATDLRTLQQMLLGTLQVVCPGCARL

SEQ ID NO: 1295 - RNA, 300 nt, Artificial Sequence
  E7__Human_papillomavirus_type_52__CAA52586
augcguggagacaaagcaacuauaaaagauuauauauuagaucugcaaccugaaacaacugaccuacacugcuaugagcaauuaggugacagcucagaugaggaggauacagaugguguggaccggccagauggacaagcagaacaagccacaagcaauuacuacauugugacauauugucacaguugugauagcacacuacggcuaugcauucauagcacugcgacggaccuucguacucuacagcaaaugcuguugggcacauuacaaguugugugccccggcugugcacggcuauaa

SEQ ID NO: 1296 - RNA, 300 nt, Artificial Sequence
  derived and/or modified sequence opt1 from E7__Human_papillomavirus_type_52__CAA52586
augcgcggcgacaaggccaccaucaaggacuacauccuggaccuccagcccgagaccacggaccugcacugcuacgagcagcugggggacagcuccgacgaggaggacaccgacggcguggaccggccggacgggcaggccgagcaggcgaccagcaacuacuacaucgucaccuacugccacuccugcgacagcacgcuccgccugugcauccacuccaccgccaccgaccugcggacccuccagcagaugcugcugggcacgcuccagguggugugccccgggugcgcccgccuguga

SEQ ID NO: 1297 - RNA, 300 nt, Artificial Sequence
  derived and/or modified sequence opt2 from E7__Human_papillomavirus_type_52__CAA52586
augcgcggcgacaaggccaccaucaaggacuacauccucgaccuccagcccgagaccaccgaccuccacugcuacgagcagcucggcgacuccuccgacgaggaggacaccgacggcgucgaccgccccgacggccaggccgagcaggccaccuccaacuacuacaucgucaccuacugccacuccugcgacuccacccuccgccucugcauccacuccaccgccaccgaccuccgcacccuccagcagaugcuccucggcacccuccaggucgucugccccggcugcgcccgccucuga

SEQ ID NO: 1298 - RNA, 300 nt, Artificial Sequence
  derived and/or modified sequence opt3 from E7__Human_papillomavirus_type_52__CAA52586
augagaggcgacaaggccaccaucaaagauuacauucuggaccuccagcccgagacaacugaucuucacugcuaugaacaacugggggacagcuccgaugaggaagacacggauggaguggacaggccugauggucaggcugagcaggcaaccucuaacuacuauauagucacauacugucauucaugcgacaguacuuugcgguuauguauccacagcaccgccacagaucugcgcacccuacagcaaaugcuccugggcacucuucagguugugugcccagggugugcgcgacuguga

SEQ ID NO: 1299 - RNA, 300 nt, Artificial Sequence
  derived and/or modified sequence opt4 from E7__Human_papillomavirus_type_52__CAA52586
augagaggcgacaaggccaccaucaaggacuacauccuggaccugcagcccgagaccaccgaccugcacugcuacgagcagcugggcgacagcagcgacgaggaggacaccgacggcguggacagacccgacggccaggccgagcaggccaccagcaacuacuacaucgugaccuacugccacagcugcgacagcacccugagacugugcauccacagcaccgccaccgaccugagaacccugcagcagaugcugcugggcacccugcagguggugugccccggcugcgccagacuguga

SEQ ID NO: 1300 - RNA, 300 nt, Artificial Sequence
  derived and/or modified sequence opt5 from E7__Human_papillomavirus_type_52__CAA52586
augagaggcgacaaggccaccaucaaagauuacauucuggaccuccagcccgagacaacggaucugcacugcuaugaacaacuuggggacagcuccgaugaggaagacaccgauggaguggaccggccugauggccaggcugagcaggccacaucuaacuacuauaucgucaccuacugucauagcugcgacuccacacugcgccucuguauucacucuaccgcgacagaucugagaacccuucagcaaaugcugcucgggacgcugcagguugugugcccgggaugugcucggcuguga

SEQ ID NO: 1301 - protein, 105 aa, Artificial Sequence
  E7__Human_papillomavirus_type_56__P36833
MHGKVPTLQDVVLELTPQTEIDLQCNEQLDSSEDEDEDEVDHLQERPQQARQAKQHTCYLIHVPCCECKFVVQLDIQSTKEDLRVVQQLLMGALTVTCPLCASSN

SEQ ID NO: 1302 - RNA, 318 nt, Artificial Sequence
  E7__Human_papillomavirus_type_56__CAA52597
augcaugguaaaguaccaacgcugcaagacguuguauuagaacuaacaccucaaacagaaauugaccuacagugcaaugagcaauuggacagcucagaggaugaggaugaggaugaaguagaccauuugcaggagcggccacagcaagcuagacaagcuaaacaacauacguguuaccuaauacacguaccuuguugugaguguaaguuuguggugcaguuggacauucagaguaccaaagaggaccugcguguuguacaacagcugcuuaugggugcguuaacaguaacgugcccacucugcgcaucaaguaacuaa

SEQ ID NO: 1303 - RNA, 318 nt, Artificial Sequence
  derived and/or modified sequence opt1 from E7__Human_papillomavirus_type_56__CAA52597
augcacggcaaggugcccacccugcaggacgucgugcucgagcugaccccgcagacggagaucgaccugcagugcaacgagcagcucgacagcuccgaggacgaggacgaggacgagguggaccaccuccaggagcgcccccagcaggcccggcaggccaagcagcacacgugcuaccugauccacguccccugcugcgagugcaaguucguggugcagcuggacauccagagcaccaaggaggaccugcgcgucgugcagcagcugcucaugggggcgcugaccgugaccugcccccugugcgccuccagcaacuga

SEQ ID NO: 1304 - RNA, 318 nt, Artificial Sequence
  derived and/or modified sequence opt2 from E7__Human_papillomavirus_type_56__CAA52597
augcacggcaagguccccacccuccaggacgucguccucgagcucaccccccagaccgagaucgaccuccagugcaacgagcagcucgacuccuccgaggacgaggacgaggacgaggucgaccaccuccaggagcgcccccagcaggcccgccaggccaagcagcacaccugcuaccucauccacguccccugcugcgagugcaaguucgucguccagcucgacauccaguccaccaaggaggaccuccgcgucguccagcagcuccucaugggcgcccucaccgucaccugcccccucugcgccuccuccaacuga

SEQ ID NO: 1305 - RNA, 318 nt, Artificial Sequence
  derived and/or modified sequence opt3 from E7__Human_papillomavirus_type_56__CAA52597
augcacggcaaggugcccacccugcaggacgucguucucgagcuuacaccucaaacugaaaucgaucugcagugcaacgagcaguuggacagcuccgaagaugaggacgaagaugagguggaccauuuacaggagagaccacaacaggccaggcaggcuaaacagcacacguguuaccugauucauguaccgugcugugaaugcaaguucgugguccaacuagauauacagucuaccaaagaggaccuccgggugguucagcagcugcuuaugggggcacugacagugacuugucccuugugcgccucaaguaauuga

SEQ ID NO: 1306 - RNA, 318 nt, Artificial Sequence
  derived and/or modified sequence opt4 from E7__Human_papillomavirus_type_56__CAA52597
augcacggcaaggugcccacccugcaggacguggugcuggagcugaccccccagaccgagaucgaccugcagugcaacgagcagcuggacagcagcgaggacgaggacgaggacgagguggaccaccugcaggagagaccccagcaggccagacaggccaagcagcacaccugcuaccugauccacgugcccugcugcgagugcaaguucguggugcagcuggacauccagagcaccaaggaggaccugagaguggugcagcagcugcugaugggcgcccugaccgugaccugcccccugugcgccagcagcaacuga

SEQ ID NO: 1307 - RNA, 318 nt, Artificial Sequence
  derived and/or modified sequence opt5 from E7__Human_papillomavirus_type_56__CAA52597
augcacggcaaggugcccacccugcaggacgucguucucgagcugacaccucaaacggaaaucgaucuucagugcaacgagcagcuggacagcuccgaagaugaggacgaagaugagguggaccaucuccaggagagaccgcaacaggcccggcaggcuaaacagcacaccuguuaccugauucaugugcccugcugugaaugcaaguucgucgugcaacuugauauccagucuacaaaagaggaccugcgcguugugcagcagcuccugaugggggcccugaccgucacauguccucucugcgcgagcuccaauuga

SEQ ID NO: 1308 - protein, 98 aa, Artificial Sequence
  E7__Human_papillomavirus_type_58__Q9QCZ1
MRGNNPTLREYILDLHPEPTDLFCYEQLCDSSDEDEIGLDRPDGQAQPATANYYIVTCCYTCDTTVRLCINSTTTDVRTLQQLLMGTCTIVCPSCAQQ

SEQ ID NO: 1309 - RNA, 297 nt, Artificial Sequence
  E7__Human_papillomavirus_type_58__AAF13691
augagaggaaacaacccaacgcuaagagaauauauuuuagauuuacauccugaaccaacugaccuauucugcuaugagcaauuaugugacagcucagacgaggaugaaauaggcuuggacaggccagauggacaagcacaaccggccacagcuaauuacuacauuguaacguguuguuacacuugugacaccacgguucguuuguguaucaacaguacaacaaccgacguacgaacccuacagcagcugcuuaugggcacauguaccauugugugcccuagcugugcacagcaauaa

SEQ ID NO: 1310 - RNA, 297 nt, Artificial Sequence
  derived and/or modified sequence opt1 from E7__Human_papillomavirus_type_58__AAF13691
augcgcggcaacaaccccacccugcgggaguacauccucgaccugcacccggagcccaccgaccuguucugcuacgagcagcucugcgacagcuccgacgaggacgagaucgggcuggaccgccccgacggccaggcccagcccgccacggcgaacuacuacaucgugaccugcugcuacacgugcgacaccaccguccggcugugcaucaacagcaccaccaccgacgugcgcacgcuccagcagcugcugauggggaccugcaccaucgugugcccguccugcgcccagcaguga

SEQ ID NO: 1311 - RNA, 297 nt, Artificial Sequence
  derived and/or modified sequence opt2 from E7__Human_papillomavirus_type_58__AAF13691
augcgcggcaacaaccccacccuccgcgaguacauccucgaccuccaccccgagcccaccgaccucuucugcuacgagcagcucugcgacuccuccgacgaggacgagaucggccucgaccgccccgacggccaggcccagcccgccaccgccaacuacuacaucgucaccugcugcuacaccugcgacaccaccguccgccucugcaucaacuccaccaccaccgacguccgcacccuccagcagcuccucaugggcaccugcaccaucgucugccccuccugcgcccagcaguga

SEQ ID NO: 1312 - RNA, 297 nt, Artificial Sequence
  derived and/or modified sequence opt3 from E7__Human_papillomavirus_type_58__AAF13691
augagaggcaacaaucccacccugagggaguacauccucgaccuucacccugaaccaacagaucuguucugcuacgagcaguugugugacagcuccgaugaagacgagauuggguuagaucggccggacggacaagcccagcccgcuacugcaaacuacuauauagugacgugcuguuauaccugcgauacaacuguccgccuguguaucaauucuaccacaaccgacguucgaacucuacagcagcuccugauggguacaugcaccauuguguguccuucaugcgcccaacaguga

SEQ ID NO: 1313 - RNA, 297 nt, Artificial Sequence
  derived and/or modified sequence opt4 from E7__Human_papillomavirus_type_58__AAF13691
augagaggcaacaaccccacccugagagaguacauccuggaccugcaccccgagcccaccgaccuguucugcuacgagcagcugugcgacagcagcgacgaggacgagaucggccuggacagacccgacggccaggcccagcccgccaccgccaacuacuacaucgugaccugcugcuacaccugcgacaccaccgugagacugugcaucaacagcaccaccaccgacgugagaacccugcagcagcugcugaugggcaccugcaccaucgugugccccagcugcgcccagcaguga

SEQ ID NO: 1314 - RNA, 297 nt, Artificial Sequence
  derived and/or modified sequence opt5 from E7__Human_papillomavirus_type_58__AAF13691
augagaggcaacaaucccacccugcgggaguacauccucgaccugcacccugaaccgacagaucuuuucugcuaugagcagcugugugacagcuccgaugaagacgagauuggccucgaucgccccgacggacaagcccagccugcuacggccaacuacuauaucgugaccugcuguuacacaugcgauaccacagucagacuguguauuaauucuaccacaaccgacguucggacgcuucagcagcugcucauggggaccugcacaaucgugugucccagcugcgcgcaacaguga

SEQ ID NO: 1315 - protein, 107 aa, Artificial Sequence
  E7__Human_papillomavirus_type_59__Q81965
MHGPKATLCDIVLDLEPQNYEEVDLVCYEQLPDSDSENEKDEPDGVNHPLLLARRAEPQRHNIVCVCCKCNNQLQLVVETSQDGLRALQQLFMDTLSFVCPLCAANQ

SEQ ID NO: 1316 - RNA, 324 nt, Artificial Sequence
  E7__Human_papillomavirus_type_59__ACL12335
augcauggaccaaaagcaacacuuugugacauuguuuuagauuuggaaccacaaaauuaugaggaaguugaccuugugugcuacgagcaauuaccugacuccgacuccgagaaugaaaaagaugaaccagauggaguuaaucauccuuugcuacuagcuagacgagcugaaccacagcgucacaacauuguguguguguguuguaaguguaauaaucaacuucagcuaguaguagaaaccucgcaagacggauugcgagccuuacagcagcuguuuauggacacacuauccuuuguguguccuuugugugcagcaaaccaguaa

SEQ ID NO: 1317 - RNA, 324 nt, Artificial Sequence
  derived and/or modified sequence opt1 from E7__Human_papillomavirus_type_59__ACL12335
augcacggccccaaggccacccugugcgacaucgugcucgaccuggagccgcagaacuacgaggaggucgaccuggugugcuacgagcagcuccccgacagcgacuccgagaacgagaaggacgagcccgacggggugaaccacccccugcugcucgcccgccgggcggagccgcagcgccacaacaucgucugcgugugcugcaagugcaacaaccagcugcagcugguggucgagaccagccaggacggccuccgggcccugcagcagcuguucauggacacgcucuccuucgugugcccccugugcgccgccaaccaguga

SEQ ID NO: 1318 - RNA, 324 nt, Artificial Sequence
  derived and/or modified sequence opt2 from E7__Human_papillomavirus_type_59__ACL12335
augcacggccccaaggccacccucugcgacaucguccucgaccucgagccccagaacuacgaggaggucgaccucgucugcuacgagcagcuccccgacuccgacuccgagaacgagaaggacgagcccgacggcgucaaccacccccuccuccucgcccgccgcgccgagccccagcgccacaacaucgucugcgucugcugcaagugcaacaaccagcuccagcucgucgucgagaccucccaggacggccuccgcgcccuccagcagcucuucauggacacccucuccuucgucugcccccucugcgccgccaaccaguga

SEQ ID NO: 1319 - RNA, 324 nt, Artificial Sequence
  derived and/or modified sequence opt3 from E7__Human_papillomavirus_type_59__ACL12335
augcacggccccaaggccacccugugcgacaucgugcucgaucuugagccucagaacuacgaagaggucgaccugguuuguuaugaacaauugccagauagcgacuccgagaaugaaaaagaugagccggacggggugaaccaucccuuacugcuagcuagaagggcagagccucagcggcacaauauuguaugcguguguugcaaguguaacaaucagcuccagcuggucguggaaacaucucaagauggacuucgcgcccugcagcaguuguucauggacacucucucauuuguuugcccacugugugcggcuaaccaguga

SEQ ID NO: 1320 - RNA, 324 nt, Artificial Sequence
  derived and/or modified sequence opt4 from E7__Human_papillomavirus_type_59__ACL12335
augcacggccccaaggccacccugugcgacaucgugcuggaccuggagccccagaacuacgaggagguggaccuggugugcuacgagcagcugcccgacagcgacagcgagaacgagaaggacgagcccgacggcgugaaccacccccugcugcuggccagaagagccgagccccagagacacaacaucgugugcgugugcugcaagugcaacaaccagcugcagcuggugguggagaccagccaggacggccugagagcccugcagcagcuguucauggacacccugagcuucgugugcccccugugcgccgccaaccaguga

SEQ ID NO: 1321 - RNA, 324 nt, Artificial Sequence
  derived and/or modified sequence opt5 from E7__Human_papillomavirus_type_59__ACL12335
augcacggccccaaggccacccugugcgacaucgugcucgaucuggagccucagaacuacgaagaggucgaccuuguuuguuaugaacagcugccggauagcgacuccgagaaugaaaaagaugagcccgacggggugaaccauccucuccugcuugcuagacgggccgagccccagcgccacaauauugugugcgucuguugcaaguguaacaaucagcugcagcucgugguugaaacaucucaagauggacugagagcgcugcagcaacucuucauggacacgcugagcuuugugugcccucuuugugcugccaaccaguga

SEQ ID NO: 1322 - protein, 105 aa, Artificial Sequence
  E7__Human_papillomavirus_type_66__Q80956
MHGKVPTLQEVILELAPQTEIDLQCNEQLDSSEDEDEDEIDHLLERPQQARQAEQHKCYLIHVPCCKCELVVQLDIQSTKEELRVVQQLLMGALTVTCPLCASSK

SEQ ID NO: 1323 - RNA, 318 nt, Artificial Sequence
  E7__Human_papillomavirus_type_66__AAA79500
augcaugguaaaguaccaacguugcaagagguuauauuagaacuugcaccgcaaacggaaauugaccuacaaugcaaugagcaauuggacagcucagaggaugaggaugaggaugaaauagaccauuugcuggagcggccacagcaagcuagacaagcugaacaacauaaguguuaccuaauucacguaccuuguuguaagugugaguugguggugcaguuggacauucagaguaccaaagaggagcuacgugugguacaacagcugcuuaugggugcguuaacaguaacgugcccacucugcgcaucaucuaaauaa

SEQ ID NO: 1324 - RNA, 318 nt, Artificial Sequence
  derived and/or modified sequence opt1 from E7__Human_papillomavirus_type_66__AAA79500
augcacggcaagguccccacccugcaggaggucauccucgagcuggccccgcagaccgagaucgaccugcagugcaacgagcagcucgacagcuccgaggacgaggacgaggacgagaucgaccaccuccuggagcgcccccagcaggcccggcaggcggagcagcacaagugcuaccugauccacgugcccugcugcaagugcgagcuggugguccagcuggacauccagagcacgaaggaggagcuccgcguggugcagcagcugcugaugggggcccucaccgugaccugcccccugugcgccuccagcaaguga

SEQ ID NO: 1325 - RNA, 318 nt, Artificial Sequence
  derived and/or modified sequence opt2 from E7__Human_papillomavirus_type_66__AAA79500
augcacggcaagguccccacccuccaggaggucauccucgagcucgccccccagaccgagaucgaccuccagugcaacgagcagcucgacuccuccgaggacgaggacgaggacgagaucgaccaccuccucgagcgcccccagcaggcccgccaggccgagcagcacaagugcuaccucauccacguccccugcugcaagugcgagcucgucguccagcucgacauccaguccaccaaggaggagcuccgcgucguccagcagcuccucaugggcgcccucaccgucaccugcccccucugcgccuccuccaaguga

SEQ ID NO: 1326 - RNA, 318 nt, Artificial Sequence
  derived and/or modified sequence opt3 from E7__Human_papillomavirus_type_66__AAA79500
augcacggcaaggugcccacccugcaggaggucauccucgaacuugccccucaaacagagauugaccugcagugcaacgaacaguuggauagcuccgaggacgaagaugaggacgagauagaucauuuacuggaaagaccacagcaagcuaggcaggcagagcagcacaaauguuaccuaauccauguuccgugcuguaagugcgaacucgugguacagcuggacauucaaucuacuaaagaggagcuucgggugguccagcagcuguugaugggggcccucacggugaccuguccccugugcgcgucaaguaaguga

SEQ ID NO: 1327 - RNA, 318 nt, Artificial Sequence
  derived and/or modified sequence opt4 from E7__Human_papillomavirus_type_66__AAA79500
augcacggcaaggugcccacccugcaggaggugauccuggagcuggccccccagaccgagaucgaccugcagugcaacgagcagcuggacagcagcgaggacgaggacgaggacgagaucgaccaccugcuggagagaccccagcaggccagacaggccgagcagcacaagugcuaccugauccacgugcccugcugcaagugcgagcugguggugcagcuggacauccagagcaccaaggaggagcugagaguggugcagcagcugcugaugggcgcccugaccgugaccugcccccugugcgccagcagcaaguga

SEQ ID NO: 1328 - RNA, 318 nt, Artificial Sequence
  derived and/or modified sequence opt5 from E7__Human_papillomavirus_type_66__AAA79500
augcacggcaaggugcccacccugcaggaggucauccucgaacuggccccucaaacagagauugaccuucagugcaacgaacagcuggauagcuccgaggacgaagaugaggacgagaucgaucaucuccuggaaagaccgcagcaagcucggcaggccgagcagcacaaauguuaccuuauucauguucccugcuguaagugcgaacugguggugcagcucgacauccaaucuacgaaagaggagcugcgcgucgugcagcagcugcucaugggggcgcugaccguuacauguccucuuugcgcuagcuccaaguga

SEQ ID NO: 1329 - protein, 463 aa, Artificial Sequence
  EF1A2__Homo_sapiens__Q05639
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 1330 - RNA, 1392 nt, Artificial Sequence
  EF1A2__Homo_sapiens__AAF80488
augggcaaggagaagacccacaucaacaucguggucaucggccacguggacuccggaaaguccaccaccacgggccaccucaucuacaaaugcggagguauugacaaaaggaccauugagaaguucgagaaggaggcggcugagauggggaagggauccuucaaguaugccugggugcuggacaagcugaaggcggagcgugagcgcggcaucaccaucgacaucucccucuggaaguucgagaccaccaaguacuacaucaccaucaucgaugcccccggccaccgcgacuucaucaagaacaugaucacggguacaucccaggcggacugcgcagugcugaucguggcggcgggcgugggcgaguucgaggcgggcaucuccaagaaugggcagacgcgggagcaugcccugcuggccuacacgcugggugugaagcagcucaucgugggcgugaacaaaauggacuccacagagccggccuacagcgagaagcgcuacgacgagaucgucaaggaagucagcgccuacaucaagaagaucggcuacaacccggccaccgugcccuuugugcccaucuccggcuggcacggcgacaacaugcuggagcccucccccaacaugccgugguucaagggcuggaagguggagcguaaggagggcaacgcaagcggcgugucccugcuggaggcccuggacaccauccugccccccacgcgccccacggacaagccccugcgccugccgcugcaggacguguacaagauuggcggcauuggcacggugcccgugggccggguggagaccggcauccugcggccgggcaugguggugaccuuugcgccagugaacaucaccacugaggugaagucaguggagaugcaccacgaggcucugagcgaagcucugcccggcgacaacgucggcuucaaugugaagaacgugucggugaaggacauccggcggggcaacguguguggggacagcaagucugacccgccgcaggaggcugcucaguucaccucccaggucaucauccugaaccacccggggcagauuagcgccggcuacuccccggucaucgacugccacacagcccacaucgccugcaaguuugcggagcugaaggagaagauugaccggcgcucuggcaagaagcuggaggacaaccccaagucccugaagucuggagacgcggccaucguggagauggugccgggaaagcccauguguguggagagcuucucccaguacccgccucucggccgcuucgccgugcgcgacaugaggcagacgguggccguaggcgucaucaagaacguggaaaagaagagcggcggcgccggcaaggucaccaagucggcgcagaaggcgcagaaggcgggcaaguga

SEQ ID NO: 1331 - RNA, 1392 nt, Artificial Sequence
  derived and/or modified sequence opt1 from EF1A2__Homo_sapiens__AAF80488
augggcaaggagaagacgcacaucaacaucguggucaucgggcacguggacagcggcaaguccaccacgaccgggcaccugaucuacaagugcggcgggaucgacaagcgcaccaucgagaaguucgagaaggaggccgccgagaugggcaagggcagcuucaaguacgcgugggugcucgacaagcugaaggccgagcgggagcgcgggaucaccaucgacaucucccuguggaaguucgagacgaccaaguacuacaucaccaucaucgacgcccccggccaccgggacuucaucaagaacaugaucaccgggacgagccaggccgacugcgccguccucaucguggcggccggcgugggggaguucgaggccggcaucuccaagaacggccagacccgcgagcacgcccugcuggcguacacccucggggucaagcagcugaucgugggcgugaacaagauggacagcaccgagccggccuacuccgagaagcgguacgacgagaucgucaaggaggugagcgccuacaucaagaagaucggguacaaccccgccacggugcccuucguccccaucuccggcuggcacggcgacaacaugcuggagccgagccccaacaugcccugguucaagggguggaagguggagcgcaaggagggcaacgccuccggggugagccuccuggaggcgcuggacaccauccugcccccgacccggcccaccgacaagccccugcgccugccccuccaggacgucuacaagaucggcgggaucggcacggugccggugggccgggucgagaccgggauccugcgccccggcaugguggugaccuucgcccccgucaacaucaccacggaggugaaguccguggagaugcaccacgaggcccugagcgaggcccuccccggggacaacgucggcuucaacgugaagaacgucuccgugaaggacauccggcgcgggaacgugugcggcgacagcaaguccgacccgccccaggaggccgcgcaguucaccagccaggucaucauccugaaccaccccggccagaucuccgccggguacagccccgugaucgacugccacaccgcccacaucgccugcaaguucgccgagcugaaggagaagaucgaccggcgcagcggcaagaagcucgaggacaacccgaagucccucaagagcggggacgcggccaucguggagaugguccccggcaagcccaugugcguggaguccuucagccaguacccgccccuggggcgguucgccgugcgcgacaugcggcagaccgucgccgugggcgugaucaagaacgucgagaagaaguccggcggggccggcaaggugaccaagagcgcgcagaaggcccagaaggccgggaaguga

SEQ ID NO: 1332 - RNA, 1392 nt, Artificial Sequence
  derived and/or modified sequence opt2 from EF1A2__Homo_sapiens__AAF80488
augggcaaggagaagacccacaucaacaucgucgucaucggccacgucgacuccggcaaguccaccaccaccggccaccucaucuacaagugcggcggcaucgacaagcgcaccaucgagaaguucgagaaggaggccgccgagaugggcaagggcuccuucaaguacgccuggguccucgacaagcucaaggccgagcgcgagcgcggcaucaccaucgacaucucccucuggaaguucgagaccaccaaguacuacaucaccaucaucgacgcccccggccaccgcgacuucaucaagaacaugaucaccggcaccucccaggccgacugcgccguccucaucgucgccgccggcgucggcgaguucgaggccggcaucuccaagaacggccagacccgcgagcacgcccuccucgccuacacccucggcgucaagcagcucaucgucggcgucaacaagauggacuccaccgagcccgccuacuccgagaagcgcuacgacgagaucgucaaggaggucuccgccuacaucaagaagaucggcuacaaccccgccaccguccccuucguccccaucuccggcuggcacggcgacaacaugcucgagcccucccccaacaugcccugguucaagggcuggaaggucgagcgcaaggagggcaacgccuccggcgucucccuccucgaggcccucgacaccauccucccccccacccgccccaccgacaagccccuccgccucccccuccaggacgucuacaagaucggcggcaucggcaccguccccgucggccgcgucgagaccggcauccuccgccccggcauggucgucaccuucgcccccgucaacaucaccaccgaggucaaguccgucgagaugcaccacgaggcccucuccgaggcccuccccggcgacaacgucggcuucaacgucaagaacgucuccgucaaggacauccgccgcggcaacgucugcggcgacuccaaguccgaccccccccaggaggccgcccaguucaccucccaggucaucauccucaaccaccccggccagaucuccgccggcuacucccccgucaucgacugccacaccgcccacaucgccugcaaguucgccgagcucaaggagaagaucgaccgccgcuccggcaagaagcucgaggacaaccccaagucccucaaguccggcgacgccgccaucgucgagaugguccccggcaagcccaugugcgucgaguccuucucccaguaccccccccucggccgcuucgccguccgcgacaugcgccagaccgucgccgucggcgucaucaagaacgucgagaagaaguccggcggcgccggcaaggucaccaaguccgcccagaaggcccagaaggccggcaaguga

SEQ ID NO: 1333 - RNA, 1392 nt, Artificial Sequence
  derived and/or modified sequence opt3 from EF1A2__Homo_sapiens__AAF80488
augggcaaggagaaaacccacaucaacauuguggucauagggcauguugacagcggaaaguccacaacuacgggucaccugaucuacaaaugcggcgggauugauaagagaaccaucgaaaaauucgagaaggaagccgcugagaugggaaagggcucuuuuaaauaugcaugggugcucgacaaacuuaaagccgaaagggagcgggguauuacaaucgauauaucacuguggaaguucgagacuaccaaauacuauaucacaauuaucgacgcgcccgggcaucgcgauuuuauuaagaauaugaucaccggaacaagucaggcugacugugccguauugauaguggcagccggcgucggcgaguucgaagcugggauuagcaagaacggacaaacucgagaacacgcauuacuggccuacacccuaggugugaaacagcucaucguuggcgugaauaagauggauuccacggagccugcuuauucugagaaacguuacgacgaaauugucaaggaggugucggccuauaucaaaaagaucggguacaacccagcgacuguaccguuuguucccauuucaggauggcauggcgauaauaugcuggaaccuagcccaaacaugcccugguucaaagguuggaagguggagagaaaggaagggaaugcaaguggagucucccuucuggaggccuuggacaccauacucccuccaacaaggcccacugauaaaccucugcggcugccacuccaggacguguacaagaucggcggcauugggaccgugccggucggacgcguugagacagguaucuuaagacccggcauggugguaaccuuugcuccugugaacauaacgacugaagucaaaucuguggagaugcaccacgaagcccugagcgaggcacuuccaggggauaauguuggauucaacgugaagaaugucuccgugaaagacauuaggcggggcaacguaugcggugacucaaagagugaucccccucaggaagcugcccaauuuacaagccagguuaucaucuugaaucauccagggcagauuucugcgggcuauucccccgugaucgacugucacaccgcccauauugcaugcaaguucgcugagcugaaagagaagauagaucgccgaucaggaaagaagcuagaagacaacccgaaaagccucaagaguggcgaugccgcuaucgucgagauggugccugggaagcccaugugugucgaaucuuuuucccaguacccaccucugggaagauucgccgugagggacaugcggcaaacuguugcaguggguguaauuaaaaaugucgagaagaaaagcggcggggccggaaaggugacaaaaucggcucagaaggcgcagaaggcaggcaaauga

SEQ ID NO: 1334 - RNA, 1392 nt, Artificial Sequence
  derived and/or modified sequence opt4 from EF1A2__Homo_sapiens__AAF80488
augggcaaggagaagacccacaucaacaucguggugaucggccacguggacagcggcaagagcaccaccaccggccaccugaucuacaagugcggcggcaucgacaagagaaccaucgagaaguucgagaaggaggccgccgagaugggcaagggcagcuucaaguacgccugggugcuggacaagcugaaggccgagagagagagaggcaucaccaucgacaucagccuguggaaguucgagaccaccaaguacuacaucaccaucaucgacgcccccggccacagagacuucaucaagaacaugaucaccggcaccagccaggccgacugcgccgugcugaucguggccgccggcgugggcgaguucgaggccggcaucagcaagaacggccagaccagagagcacgcccugcuggccuacacccugggcgugaagcagcugaucgugggcgugaacaagauggacagcaccgagcccgccuacagcgagaagagauacgacgagaucgugaaggaggugagcgccuacaucaagaagaucggcuacaaccccgccaccgugcccuucgugcccaucagcggcuggcacggcgacaacaugcuggagcccagccccaacaugcccugguucaagggcuggaagguggagagaaaggagggcaacgccagcggcgugagccugcuggaggcccuggacaccauccugccccccaccagacccaccgacaagccccugagacugccccugcaggacguguacaagaucggcggcaucggcaccgugcccgugggcagaguggagaccggcauccugagacccggcaugguggugaccuucgcccccgugaacaucaccaccgaggugaagagcguggagaugcaccacgaggcccugagcgaggcccugcccggcgacaacgugggcuucaacgugaagaacgugagcgugaaggacaucagaagaggcaacgugugcggcgacagcaagagcgaccccccccaggaggccgcccaguucaccagccaggugaucauccugaaccaccccggccagaucagcgccggcuacagccccgugaucgacugccacaccgcccacaucgccugcaaguucgccgagcugaaggagaagaucgacagaagaagcggcaagaagcuggaggacaaccccaagagccugaagagcggcgacgccgccaucguggagauggugcccggcaagcccaugugcguggagagcuucagccaguaccccccccugggcagauucgccgugagagacaugagacagaccguggccgugggcgugaucaagaacguggagaagaagagcggcggcgccggcaaggugaccaagagcgcccagaaggcccagaaggccggcaaguga

SEQ ID NO: 1335 - RNA, 1392 nt, Artificial Sequence
  derived and/or modified sequence opt5 from EF1A2__Homo_sapiens__AAF80488
augggcaaggagaaaacccacaucaacauuguggucaucgggcauguugacagcggaaaguccacaacgaccggccaccugauuuacaaaugcgggggaaucgauaagagaacaauugaaaaauucgagaaggaagccgcugagaugggcaaggggucuuuuaaauaugccugggugcucgacaagcugaaagcggaacgggagcgcggaaucaccaucgauauuagccuuuggaaguucgagacaaccaaauacuauaucacaauuaucgacgcucccggccauagagauuuuauuaagaauaugaucaccggcacgucccaggccgacugugccgugcugauugucgcugccggggugggagaguucgaagcuggcaucucuaagaacgggcaaacccgggaacacgcccuccuggcguacacacuuggaguuaaacagcugaucgugggcgucaauaagauggauagcaccgagccugccuauuccgagaaacgcuacgacgaaauugugaaggagguuucugcuuauaucaaaaagauuggguacaacccggccacagugcccuuugucccuaucagcggauggcauggcgauaauaugcucgaacccuccccuaacaugcccugguucaaaggcuggaagguggagagaaaggaagggaaugcuagcggagugucucugcuggaggcccucgacaccauucugccuccgacgcggcccacagauaaaccucuucgccugccccuccaggacgucuacaagaucggcgggaucggaaccguuccugugggcagaguggagacagggauucugcggcccggaauggucgugaccuuugcgccgguuaacaucaccacagaagugaaauccgucgagaugcaccacgaagcccuuagcgaggcucugccuggcgauaaugugggcuucaacguuaagaaugugucugucaaagacauucgcagagggaacgugugcggagacuccaagagcgaucccccucaggaagccgcucaauuuacgucucaggucaucauucucaaucaucccggccagaucuccgccggguauagccccgugaucgacugucacaccgcccauauugcuugcaaguucgcggagcugaaagagaagaucgaucggcgcuccggcaaaaagcuggaagacaacccuaaaucucucaagagcggagaugccgcuauuguugagauggugccggggaagcccaugugugucgaauccuuuagccaguacccuccccugggcagauucgccgugcgggacaugcgccaaacaguugccgugggagucaucaaaaauguggagaagaaaucuggcggggcuggaaaggugaccaaauccgcccagaaggcgcagaaggcuggcaaauga

SEQ ID NO: 1336 - protein, 972 aa, Artificial Sequence
  EFTUD2/m__Homo_sapiens__Q15029
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTCFVDCLIEQTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 1337 - RNA, 2919 nt, Artificial Sequence
  EFTUD2/m__Homo_sapiens__EAW51573
auggauaccgacuuauaugaugaguuugggaauuauauuggaccagagcuugauucugaugaagaugaugaugaauuggguagagagaccaaagaucuugaugagauggaugaugaugacgacgacgaugacguaggagaucaugacgaugaccacccugggauggagguggugcugcaugaggacaagaaguacuacccaacagccgaggagguguaugguccugagguggagaccauaguucaagaggaagacacucagccucucacagaacccauuauuaagccagugaaaaccaagaaauucacucugauggagcagacauuaccuguuacgguguaugagauggauuucuuggcggaucugauggauaacucagagcucaucagaaaugugacccuuuguggacaucuccaccauggcaagacauguuuuguggauuguuuaauugaacagacucacccggaaaucagaaagcgcuaugaccaagaucugugcuauacugacauccucuucacagagcaagagagagguguaggcaucaaaagcacuccugugacaguggucuugccagacaccaaaggaaaaucuuaucucuucaauaucauggacacuccaggacaugugaauuucucugaugaggucacagcuggcuugcgcaucucagauggagugguccuuuucauugaugcugcugagggggugaugcugaacacagagcggcugaucaagcaugcggugcaggagaggcuggcagucacugugugcaucaacaagauugaccggcugauccuggagcugaagcugccuccaacugaugcuuauuacaagcugcgccacauuguggaugaggucaauggauuaauaagcauguauuccacugaugagaaccugauccuuuccccacuccuggguaacgucugcuucuccagcucccaguacagcaucugcuucacgcugggcuccuuugccaagaucuaugccgacaccuuuggugacauuaauuaccaagaauuugcuaaaagacucuggggugacaucuacuucaacccuaagacgcgaaaguucaccaaaaaggccccaacuagcagcucccagagaaguuucguggaguuuaucuuggagccucuuuauaagauccucgcccagguuguaggugacguggacaccagccucccacggacccuagacgagcuuggcauccaccugacgaaggaggagcugaagcugaacauccgccccuugcucaggcuggucugcaaaaaguucuuuggcgaguucacaggcuuuguggacaugugugugcagcauaucccuucuccaaaggugggcgccaagcccaagauugagcacaccuacaccggugguguggacuccgaccucggcgaggcuaugagugacugugacccugauggcccccugaugugccacacuacuaagauguacagcacagaugauggaguccaguuucacgccuuuggccgggugcugaguggcaccauucaugcugggcagccugugaagguacugggggagaacuacacccuggaggaugaggaagacucccagauaugcaccgugggccgccuuuggaucucuguggccagguaccacaucgaggugaaccguguuccugcuggcaacuggguucugauugaagguguugaucaaccaauugugaagacagcaaccauaaccgaaccccgaggcaaugaggaggcucagauuuuccgacccuugaaguucaauaccacaucuguuaucaagauugcuguggagccagucaaccccucagagcugcccaagaugcuugauggccugcgcaaggucaacaagagcuauccaucccucaccaccaagguggaggagucuggcgagcaugugauccugggcacuggggagcucuaccuggacugugugaugcaugauuugcggaagauguacucagagauagacaucaagguggcugacccaguugucacguuuugugagacggugguggaaacauccucccucaagugcuuugcugaaacgccuaauaagaagaacaagaucaccaugauugcugagccucuugagaagggccuggcagaggacauagagaaugaggugguccagauuacguggaacaggaagaagcugggagaguucuuccagaccaaguacgauugggaucugcuggcugcccguuccaucugggcuuuuggcccugaugcgacuggccccaacauucugguggaugauacucugcccucugagguggacaaggcucuucuugguucagugaaggacagcaucguucaagguuuccaguggggaaccagggagggcccccucugugaugaauugauucggaaugucaaguuuaagauccuggaugcggugguugcccaggagccccugcaccggggcgggggccagaucauccccacagccaggagagucgucuacucugccuuccucauggcuacuccucgucugauggagccuuacuacuuuguagagguccaggccccugcagauugcgucucugcaguuuauaccguccuggccaggcgcagggggcacgugacucaggaugcacccaucccaggcuccccucuguacaccaucaaagcuuuuaucccggccaucgacucuuuuggcuuugagacugaucuccggacucacacccagggacaagccuuuucucugucugucuuccaccacuggcagauugugccuggugauccccuggacaagagcauugucauccgccccuuggagccacagccagcuccucaccuggcccgggaauucaugaucaaaacccgccguaggaagggccucagugaagaugugagcaucagcaaauucuucgaugauccuauguugcuggaacuugccaaacaggauguugugcucaauuaccccauguga

SEQ ID NO: 1338 - RNA, 2919 nt, Artificial Sequence
  derived and/or modified sequence opt1 from EFTUD2/m__Homo_sapiens__EAW51573
auggacaccgaccuguacgacgaguucggcaacuacaucgggcccgagcucgacagcgacgaggacgacgacgagcugggccgcgagaccaaggaccuggacgagauggacgacgacgacgacgacgacgacgugggggaccacgacgacgaccacccgggcauggaggucgugcuccacgaggacaagaaguacuaccccacggccgaggagguguacgggcccgaggucgagaccaucgugcaggaggaggacacccagccccugaccgagccgaucaucaagcccgugaagacgaagaaguucacccugauggagcagacccuccccgucaccguguacgagauggacuuccuggccgaccugauggacaacuccgagcucauccggaacgugacgcugugcggccaccuccaccacggcaagaccugcuucgucgacugccucaucgagcagacccaccccgagauccgcaagcgguacgaccaggaccugugcuacaccgacauccuguucacggagcaggagcgcggggugggcaucaagagcaccccggugaccgucgugcuccccgacaccaaggggaaguccuaccuguucaacaucauggacacgcccggccacgugaacuucagcgacgaggucaccgcggggcugcggaucuccgacggcguggugcuguucaucgacgccgccgagggcgucaugcugaacaccgagcgccugaucaagcacgccgugcaggagcggcucgccgugaccgucugcaucaacaagaucgaccgccugauccuggagcucaagcugcccccgacggacgcguacuacaagcugcggcacaucguggacgaggugaacgggcucaucagcauguacuccaccgacgagaaccugauccugagcccccuccugggcaacgucugcuucuccagcucccaguacagcaucugcuucacccugggguccuucgccaagaucuacgccgacaccuucggcgacaucaacuaccaggaguucgccaagcgccucuggggcgacaucuacuucaaccccaagacgcggaaguucaccaagaaggcgcccaccagcuccagccagcgcuccuucguggaguucauccuggagccgcuguacaagauccucgcccaggucgugggggacguggacaccagccugccccggacgcuggacgagcucggcauccaccugaccaaggaggagcugaagcucaacauccgcccccugcugcggcucgucugcaagaaguucuucggggaguucaccggcuucguggacaugugcgugcagcacauccccuccccgaaggucggggccaagcccaagaucgagcacaccuacacgggcggcguggacagcgaccugggggaggccaugagcgacugcgaccccgacggcccccugaugugccacaccaccaagauguacuccaccgacgacggggugcaguuccacgccuucggccgcguccucagcgggacgauccacgcgggccagccggugaaggugcugggcgagaacuacacccuggaggacgaggaggacucccagaucugcaccgucgggcggcuguggaucagcguggcccgcuaccacaucgaggugaaccggguccccgccggcaacugggugcucaucgaggggguggaccagcccaucgucaagaccgccaccaucacggagccccgcggcaacgaggaggcccagaucuuccggccgcugaaguucaacaccaccuccgugaucaagaucgcgguggagcccgucaaccccagcgagcugccgaagaugcucgacgggcugcgcaaggugaacaaguccuaccccagccugaccacgaagguggaggaguccggcgagcacgucauccucggcaccggggagcuguaccuggacugcgugaugcacgaccuccgcaagauguacagcgagaucgacaucaagguggccgaccccgucgugaccuucugcgagaccguggucgagacguccagccugaagugcuucgccgagacccccaacaagaagaacaagaucaccaugaucgccgagccgcuggagaagggccucgccgaggacaucgagaacgagguggugcagaucaccuggaaccggaagaagcugggggaguucuuccagacgaaguacgacugggaccugcucgcggcccgcuccaucugggccuucggccccgacgccaccggccccaacauccuggucgacgacacccugcccagcgagguggacaaggcccuccugggguccgugaaggacagcaucguccagggcuuccagugggggacccgggagggcccgcugugcgacgagcucauccgcaacgugaaguucaagauccuggacgcgguggucgcccaggagccccugcaccgcgggggcggccagaucauccccacggcccggcgggugguguacuccgccuuccucauggcgacgccccgccugauggagccguacuacuucgucgaggugcaggcccccgccgacugcgugagcgccgucuacaccgugcuggcccggcgccgggggcacgugacccaggacgcgcccauccccggcuccccgcucuacaccaucaaggccuucauccccgccaucgacagcuucggguucgagaccgaccugcgcacccacacccagggccaggccuucagccuguccgucuuccaccacuggcagaucgugcccggggacccccucgacaagagcaucgugauccggccgcuggagccccagcccgcgccccaccuggcccgcgaguucaugaucaagacgcggcgccggaagggccucuccgaggacgucagcaucuccaaguucuucgacgacccgaugcugcuggagcucgccaagcaggacgugguccugaacuaccccauguga

SEQ ID NO: 1339 - RNA, 2919 nt, Artificial Sequence
  derived and/or modified sequence opt2 from EFTUD2/m__Homo_sapiens__EAW51573
auggacaccgaccucuacgacgaguucggcaacuacaucggccccgagcucgacuccgacgaggacgacgacgagcucggccgcgagaccaaggaccucgacgagauggacgacgacgacgacgacgacgacgucggcgaccacgacgacgaccaccccggcauggaggucguccuccacgaggacaagaaguacuaccccaccgccgaggaggucuacggccccgaggucgagaccaucguccaggaggaggacacccagccccucaccgagcccaucaucaagcccgucaagaccaagaaguucacccucauggagcagacccuccccgucaccgucuacgagauggacuuccucgccgaccucauggacaacuccgagcucauccgcaacgucacccucugcggccaccuccaccacggcaagaccugcuucgucgacugccucaucgagcagacccaccccgagauccgcaagcgcuacgaccaggaccucugcuacaccgacauccucuucaccgagcaggagcgcggcgucggcaucaaguccacccccgucaccgucguccuccccgacaccaagggcaaguccuaccucuucaacaucauggacacccccggccacgucaacuucuccgacgaggucaccgccggccuccgcaucuccgacggcgucguccucuucaucgacgccgccgagggcgucaugcucaacaccgagcgccucaucaagcacgccguccaggagcgccucgccgucaccgucugcaucaacaagaucgaccgccucauccucgagcucaagcucccccccaccgacgccuacuacaagcuccgccacaucgucgacgaggucaacggccucaucuccauguacuccaccgacgagaaccucauccucuccccccuccucggcaacgucugcuucuccuccucccaguacuccaucugcuucacccucggcuccuucgccaagaucuacgccgacaccuucggcgacaucaacuaccaggaguucgccaagcgccucuggggcgacaucuacuucaaccccaagacccgcaaguucaccaagaaggcccccaccuccuccucccagcgcuccuucgucgaguucauccucgagccccucuacaagauccucgcccaggucgucggcgacgucgacaccucccucccccgcacccucgacgagcucggcauccaccucaccaaggaggagcucaagcucaacauccgcccccuccuccgccucgucugcaagaaguucuucggcgaguucaccggcuucgucgacaugugcguccagcacauccccucccccaaggucggcgccaagcccaagaucgagcacaccuacaccggcggcgucgacuccgaccucggcgaggccauguccgacugcgaccccgacggcccccucaugugccacaccaccaagauguacuccaccgacgacggcguccaguuccacgccuucggccgcguccucuccggcaccauccacgccggccagcccgucaagguccucggcgagaacuacacccucgaggacgaggaggacucccagaucugcaccgucggccgccucuggaucuccgucgcccgcuaccacaucgaggucaaccgcguccccgccggcaacuggguccucaucgagggcgucgaccagcccaucgucaagaccgccaccaucaccgagccccgcggcaacgaggaggcccagaucuuccgcccccucaaguucaacaccaccuccgucaucaagaucgccgucgagcccgucaaccccuccgagcuccccaagaugcucgacggccuccgcaaggucaacaaguccuaccccucccucaccaccaaggucgaggaguccggcgagcacgucauccucggcaccggcgagcucuaccucgacugcgucaugcacgaccuccgcaagauguacuccgagaucgacaucaaggucgccgaccccgucgucaccuucugcgagaccgucgucgagaccuccucccucaagugcuucgccgagacccccaacaagaagaacaagaucaccaugaucgccgagccccucgagaagggccucgccgaggacaucgagaacgaggucguccagaucaccuggaaccgcaagaagcucggcgaguucuuccagaccaaguacgacugggaccuccucgccgcccgcuccaucugggccuucggccccgacgccaccggccccaacauccucgucgacgacacccuccccuccgaggucgacaaggcccuccucggcuccgucaaggacuccaucguccagggcuuccaguggggcacccgcgagggcccccucugcgacgagcucauccgcaacgucaaguucaagauccucgacgccgucgucgcccaggagccccuccaccgcggcggcggccagaucauccccaccgcccgccgcgucgucuacuccgccuuccucauggccaccccccgccucauggagcccuacuacuucgucgagguccaggcccccgccgacugcgucuccgccgucuacaccguccucgcccgccgccgcggccacgucacccaggacgcccccauccccggcuccccccucuacaccaucaaggccuucauccccgccaucgacuccuucggcuucgagaccgaccuccgcacccacacccagggccaggccuucucccucuccgucuuccaccacuggcagaucguccccggcgacccccucgacaaguccaucgucauccgcccccucgagccccagcccgccccccaccucgcccgcgaguucaugaucaagacccgccgccgcaagggccucuccgaggacgucuccaucuccaaguucuucgacgaccccaugcuccucgagcucgccaagcaggacgucguccucaacuaccccauguga

SEQ ID NO: 1340 - RNA, 2919 nt, Artificial Sequence
  derived and/or modified sequence opt3 from EFTUD2/m__Homo_sapiens__EAW51573
auggacaccgaucuguacgacgaguucggcaacuauaucgggcccgaacucgauagcgacgaggaugacgaugaacuuggaagagagacaaaggaccuggaugaaauggacgaugacgaugacgacgaugacgugggugaucacgacgaugaccauccuggcauggaggucguuuugcacgaggauaaaaaguacuauccaacugccgaagagguguacgggccggaaguagagacgauugugcaggaggaagacacccaacccuuaacagagccuauaaucaaaccagucaagacuaaaaaguuuacccugauggaacagacacuacccgugaccguuuaugagauggauuuccucgcugaccugauggauaauuccgaacuuauuaggaacgugacucugugcggacauuugcaccauggcaagacauguuuugucgacugccucaucgagcagacccacccugagauucggaaacgcuacgaccaggaucuguguuauacggacauccuguucacugaacaagagcgagguguggggauaaagucuaccccaguaacaguugugcuccccgauacuaaaggaaagucauacuuauuuaauaucauggacaccccuggccacgucaacuucagugaugaagugacagcaggccugcguauuagcgacggggugguccuuuuuaucgaugccgcggagggaguuauguugaauaccgaaagacugauuaaacaugcugugcaggagaggcuagccguaacggugugcaucaacaagauagaccggcucauucuggagcuuaagcugccaccgacugaugcauacuauaaauugcgccacaucgucgacgaagugaauggucucauuuccauguacucuacagaugagaaccugaucuuaucgccccugcucggcaauguuuguuucucaagcagucaguauuccaucugcuuuacccuugggucuuucgccaagauuuacgcugacacuuuuggagauauaaacuaucaggaguucgcaaaaagacuguggggcgacaucuacuuuaauccuaagacaaggaaauucaccaagaaagccccaacgagcuccucacaacggaguuucguggaauuuauuuuggaaccccuauauaagauccuggcucaggucgugggugacguagauaccagccucccucgcacacuggacgagcuugggauacaucugacuaaggaggaauugaaacucaacauucgaccacuguuaagacugguuuguaagaaauucuuuggagaguucaccggcuuuguggauaugugcguccagcacauccccucuccgaaggugggcgccaaaccuaagaucgaacacacauacacugggggagucgacuccgaucuaggugaggcgaugucagacugugaucccgacggcccacucaugugccauaccacaaagauguacagcaccgaugacggggugcaguuccacgcauuuggaaggguucugaguggcacuauucaugccggucaaccugugaaaguacuuggggagaauuauacguuggaagaugaggaagacucucagaucuguacagucggccggcuguggauuuccguggcucguuaccacauagagguuaaccgcgugcccgccggaaauuggguccucaucgaaggcguggaucagccaauuguaaagaccgcaacuaucaccgagcccagagggaacgaggaagcucaaaucuucaggccucugaaauuuaacacaaccagcgugauuaagauagccguugagccagucaauccgucggaacuucccaaaaugcuggacggauugcggaaggugaacaagucuuauccuucccucacuacaaaaguggaggaaucaggugagcaugucauccugggcacgggggaguuauaccuggacugcguuaugcacgaucuacgaaagauguauagugaaauugacaucaaaguggcggauccagugguaaccuucugcgagacugucguggaaacaagcucccucaaguguuuugccgagacccccaauaaaaagaacaagauuacaaugaucgcagaaccucuggagaaaggacuugcugaggacauagaaaaugagguugugcagaucacuuggaaccgcaagaaauugggcgaguucuuucagaccaaguacgauugggaccugcucgccgcuagaucuauuugggccuucgguccagaugcaacggggcccaauauccuggucgacgauaccuuaccgagcgaaguggacaaagcccugcuuggcucaguuaaggauaguauugugcagggauuccaauggggcacaagggaggggccuuugugcgacgaacucauccggaacguaaaauuuaagauacuggacgcugucguggcgcaggagccacuacaccgcggagguggccagauuauccccacugcaagaaggguggucuauuccgccuuccugauggcuaccccucgucucauggaacccuacuacuuuguugaggugcaggccccagcagauuguguaagcgccguguauacaguccuggcucggcgaagagggcaugugacucaagacgccccuauucccggaucuccacuuuacaccaucaaggcauucauaccggcgaucgauucauuuggcuucgaaacggacuugaggacacacacccagggucaggcuuuuagucugagcguuuuccaucacuggcagauugugccuggggaucccuuagacaaauccaucgucauucgcccacucgagccccaaccugccccacaccuggcacgggaguuuaugaucaagacuagaaggcgcaaaggccuuucugaagaugugucgauaagcaaguucuuugacgaucccaugcuguuggagcucgccaaacaggacguugugcugaauuauccuauguga

SEQ ID NO: 1341 - RNA, 2919 nt, Artificial Sequence
  derived and/or modified sequence opt4 from EFTUD2/m__Homo_sapiens__EAW51573
auggacaccgaccuguacgacgaguucggcaacuacaucggccccgagcuggacagcgacgaggacgacgacgagcugggcagagagaccaaggaccuggacgagauggacgacgacgacgacgacgacgacgugggcgaccacgacgacgaccaccccggcauggagguggugcugcacgaggacaagaaguacuaccccaccgccgaggagguguacggccccgagguggagaccaucgugcaggaggaggacacccagccccugaccgagcccaucaucaagcccgugaagaccaagaaguucacccugauggagcagacccugcccgugaccguguacgagauggacuuccuggccgaccugauggacaacagcgagcugaucagaaacgugacccugugcggccaccugcaccacggcaagaccugcuucguggacugccugaucgagcagacccaccccgagaucagaaagagauacgaccaggaccugugcuacaccgacauccuguucaccgagcaggagagaggcgugggcaucaagagcacccccgugaccguggugcugcccgacaccaagggcaagagcuaccuguucaacaucauggacacccccggccacgugaacuucagcgacgaggugaccgccggccugagaaucagcgacggcguggugcuguucaucgacgccgccgagggcgugaugcugaacaccgagagacugaucaagcacgccgugcaggagagacuggccgugaccgugugcaucaacaagaucgacagacugauccuggagcugaagcugccccccaccgacgccuacuacaagcugagacacaucguggacgaggugaacggccugaucagcauguacagcaccgacgagaaccugauccugagcccccugcugggcaacgugugcuucagcagcagccaguacagcaucugcuucacccugggcagcuucgccaagaucuacgccgacaccuucggcgacaucaacuaccaggaguucgccaagagacuguggggcgacaucuacuucaaccccaagaccagaaaguucaccaagaaggcccccaccagcagcagccagagaagcuucguggaguucauccuggagccccuguacaagauccuggcccagguggugggcgacguggacaccagccugcccagaacccuggacgagcugggcauccaccugaccaaggaggagcugaagcugaacaucagaccccugcugagacuggugugcaagaaguucuucggcgaguucaccggcuucguggacaugugcgugcagcacauccccagccccaaggugggcgccaagcccaagaucgagcacaccuacaccggcggcguggacagcgaccugggcgaggccaugagcgacugcgaccccgacggcccccugaugugccacaccaccaagauguacagcaccgacgacggcgugcaguuccacgccuucggcagagugcugagcggcaccauccacgccggccagcccgugaaggugcugggcgagaacuacacccuggaggacgaggaggacagccagaucugcaccgugggcagacuguggaucagcguggccagauaccacaucgaggugaacagagugcccgccggcaacugggugcugaucgagggcguggaccagcccaucgugaagaccgccaccaucaccgagcccagaggcaacgaggaggcccagaucuucagaccccugaaguucaacaccaccagcgugaucaagaucgccguggagcccgugaaccccagcgagcugcccaagaugcuggacggccugagaaaggugaacaagagcuaccccagccugaccaccaagguggaggagagcggcgagcacgugauccugggcaccggcgagcuguaccuggacugcgugaugcacgaccugagaaagauguacagcgagaucgacaucaagguggccgaccccguggugaccuucugcgagaccgugguggagaccagcagccugaagugcuucgccgagacccccaacaagaagaacaagaucaccaugaucgccgagccccuggagaagggccuggccgaggacaucgagaacgagguggugcagaucaccuggaacagaaagaagcugggcgaguucuuccagaccaaguacgacugggaccugcuggccgccagaagcaucugggccuucggccccgacgccaccggccccaacauccugguggacgacacccugcccagcgagguggacaaggcccugcugggcagcgugaaggacagcaucgugcagggcuuccaguggggcaccagagagggcccccugugcgacgagcugaucagaaacgugaaguucaagauccuggacgccgugguggcccaggagccccugcacagaggcggcggccagaucauccccaccgccagaagagugguguacagcgccuuccugauggccacccccagacugauggagcccuacuacuucguggaggugcaggcccccgccgacugcgugagcgccguguacaccgugcuggccagaagaagaggccacgugacccaggacgcccccauccccggcagcccccuguacaccaucaaggccuucauccccgccaucgacagcuucggcuucgagaccgaccugagaacccacacccagggccaggccuucagccugagcguguuccaccacuggcagaucgugcccggcgacccccuggacaagagcaucgugaucagaccccuggagccccagcccgccccccaccuggccagagaguucaugaucaagaccagaagaagaaagggccugagcgaggacgugagcaucagcaaguucuucgacgaccccaugcugcuggagcuggccaagcaggacguggugcugaacuaccccauguga

SEQ ID NO: 1342 - RNA, 2919 nt, Artificial Sequence
  derived and/or modified sequence opt5 from EFTUD2/m__Homo_sapiens__EAW51573
auggacaccgaucuguacgacgaguucggcaacuauaucgggcccgaacucgauagcgacgaggaugacgaugaacugggaagagagacaaaggaccuugaugaaauggacgaugacgaugacgacgaugacgugggcgaucacgacgaugaccauccugggauggaggucguucugcacgaggauaaaaaguacuauccgacggccgaagagguguacggacccgaaguggagaccauuguccaggaggaagacacacaaccucucaccgagcccaucauuaaaccugugaagaccaaaaaguuuacccugauggaacagacacuucccguuaccguguaugagauggauuuccuggcugaccucauggauaauuccgaacugauccggaacgucacgcugugcggccaucuccaccaugggaagaccuguuuuguggacugccugauugagcagacacacccugagauccgcaaaagauacgaccaggaucuuuguuauaccgacauccuguucacagaacaagagcggggaguuggcauuaagucuaccccggugacggucgugcuccccgauacaaaaggcaagagcuaccuguuuaauaucauggacaccccugggcacgugaacuucuccgaugaagucacagccggacuucgcauuucugacggcguugugcuguuuaucgaugcggcugagggggugaugcucaauaccgaaagacugauuaaacaugccguccaggagcggcuggccgugaccguuugcaucaacaagauugaccgccucauccuggagcuuaagcugcccccuacagaugcuuacuauaaacucagacacaucguggacgaagucaauggacugauuagcauguacuccacggaugagaaccuuauccugucuccccuccugggcaauguguguuucagcuccagccaguauucuauuugcuuuacccugggguccuucgccaagaucuacgcugacacauuuggagauauuaacuaucaggaguucgccaaacggcucuggggcgacaucuacuuuaauccgaagacccgcaaauucacaaagaaagcgccuaccagcagcucccaaagaucuuucguugaauuuauccuggaaccccuuuauaagauucuggcccagguggucggcgacguggauacgucucucccucggacacuggacgagcuugggauccaucugaccaaggaggaacucaaacugaacauucgcccccugcucagacuggucuguaagaaauucuuuggagaguucaccggcuuuguggauaugugcguucagcacauccccuccccuaaggugggggcuaaaccgaagauugaacacacauacaccggaggcgucgacagcgaucuuggggaggccauguccgacugugaucccgacggaccucugaugugccauacaacgaagauguacucuaccgaugacggcgugcaguuccacgcuuuuggccggguucucagcgggacaauccaugccggacaacccgugaaaguccugggcgagaauuauacccuggaagaugaggaagacucccagaucuguacaguggggcgccuuuggauuagcguggcgagauaccacaucgagguuaaccgggucccugccggaaauugggugcucauugaaggcguggaucagcccaucgucaagaccgcuacgauuaccgagccgagagggaacgaggaagcccaaaucuuccgcccucugaaauuuaacacaaccucugugauuaagaucgcuguugagcccgugaauccuuccgaacugcccaaaaugcucgacggccugcggaaggucaacaagagcuauccuucucuuacaaccaaaguggaggaaagcggagagcauguuauccugggcacgggggagcucuaccuggacugcgugaugcacgaucugagaaagauguauuccgaaauugacaucaaagucgccgaucccgugguuacauucugcgagaccguggucgaaacaucuagccuuaaguguuuugccgagaccccgaauaaaaagaacaagauuaccaugaucgcugaaccucucgagaaaggacuggcggaggacauugaaaaugagguggugcagaucacauggaaccgcaagaaacugggcgaguucuuucagacgaaguacgauugggaccuccuggccgcucgguccaucugggccuucgggcccgaugccaccggacccaauauucuugucgacgauacacugccuagcgaaguugacaaagcucuccugggcucugugaaggauuccaucgugcagggguuccaauggggcaccagagagggaccgcugugcgacgaacuuauucgcaacgucaaauuuaagauccucgacgccgugguugcgcaggagccccugcaccggggcgggggacagauuaucccuacagcuagacgcguggucuauagcgccuuccugauggccacaccccggcucauggaaccuuacuacuuuguggagguucaggcucccgccgauugugugucugcugucuauacggugcuggccagacgccggggccauguuacacaagacgcgccuauccccggguccccgcuuuacaccauuaaggccuucaucccugcuauugauagcuuuggauucgaaaccgaccugagaacacacacccagggccaggccuuuucccucucuguguuccaucacuggcagaucguccccggggauccucuggacaaaagcauugugauccggccccuggagccgcaaccugcuccccaccuugcccgcgaguuuaugaucaagacaagacggagaaaaggccucuccgaagaugugucuauuagcaaguucuuugacgauccuaugcugcuggagcucgcgaaacaggacgucguucugaauuaucccauguga

SEQ ID NO: 1343 - protein, 657 aa, Artificial Sequence
  EGFR__Homo_sapiens__A0A0B4J1Y5
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGSYIVSHFPRSFYKMSVH

SEQ ID NO: 1344 - RNA, 1971 nt, Artificial Sequence
  EGFR__Homo_sapiens__EAW50963
augcgacccuccgggacggccggggcagcgcuccuggcgcugcuggcugcgcucugcccggcgagucgggcucuggaggaaaagaaaguuugccaaggcacgaguaacaagcucacgcaguugggcacuuuugaagaucauuuucucagccuccagaggauguucaauaacugugaggugguccuugggaauuuggaaauuaccuaugugcagaggaauuaugaucuuuccuucuuaaagaccauccaggagguggcugguuauguccucauugcccucaacacaguggagcgaauuccuuuggaaaaccugcagaucaucagaggaaauauguacuacgaaaauuccuaugccuuagcagucuuaucuaacuaugaugcaaauaaaaccggacugaaggagcugcccaugagaaauuuacaggaaauccugcauggcgccgugcgguucagcaacaacccugcccugugcaacguggagagcauccaguggcgggacauagucagcagugacuuucucagcaacaugucgauggacuuccagaaccaccugggcagcugccaaaagugugauccaagcugucccaaugggagcugcuggggugcaggagaggagaacugccagaaacugaccaaaaucaucugugcccagcagugcuccgggcgcugccguggcaagucccccagugacugcugccacaaccagugugcugcaggcugcacaggcccccgggagagcgacugccuggucugccgcaaauuccgagacgaagccacgugcaaggacaccugccccccacucaugcucuacaaccccaccacguaccagauggaugugaaccccgagggcaaauacagcuuuggugccaccugcgugaagaaguguccccguaauuauguggugacagaucacggcucgugcguccgagccuguggggccgacagcuaugagauggaggaagacggcguccgcaaguguaagaagugcgaagggccuugccgcaaaguguguaacggaauagguauuggugaauuuaaagacucacucuccauaaaugcuacgaauauuaaacacuucaaaaacugcaccuccaucaguggcgaucuccacauccugccgguggcauuuaggggugacuccuucacacauacuccuccucuggauccacaggaacuggauauucugaaaaccguaaaggaaaucacaggguuuuugcugauucaggcuuggccugaaaacaggacggaccuccaugccuuugagaaccuagaaaucauacgcggcaggaccaagcaacauggucaguuuucucuugcagucgucagccugaacauaacauccuugggauuacgcucccucaaggagauaagugauggagaugugauaauuucaggaaacaaaaauuugugcuaugcaaauacaauaaacuggaaaaaacuguuugggaccuccggucagaaaaccaaaauuauaagcaacagaggugaaaacagcugcaaggccacaggccaggucugccaugccuugugcucccccgagggcugcuggggcccggagcccagggacugcgucucuugccggaaugucagccgaggcagggaaugcguggacaagugcaaccuucuggagggugagccaagggaguuuguggagaacucugagugcauacagugccacccagagugccugccucaggccaugaacaucaccugcacaggacggggaccagacaacuguauccagugugcccacuacauugacggcccccacugcgucaagaccugcccggcaggagucaugggagaaaacaacacccuggucuggaaguacgcagacgccggccaugugugccaccugugccauccaaacugcaccuacggaugcacugggccaggucuugaaggcuguccaacgaauggaagcuacauagugucucacuuuccaagaucauucuacaagaugucagugcac

SEQ ID NO: 1345 - RNA, 1971 nt, Artificial Sequence
  derived and/or modified sequence opt1 from EGFR__Homo_sapiens__EAW50963
augcgccccagcggcaccgccggggccgcgcugcucgcccugcuggccgcccucugcccggccucccgggcgcuggaggagaagaaggugugccagggcaccagcaacaagcugacgcagcucgggaccuucgaggaccacuuccugucccugcagcgcauguucaacaacugcgaggucgugcucggcaaccuggagaucaccuacgugcagcggaacuacgaccugagcuuccucaagaccauccaggaggucgccggguacgugcugaucgcccugaacacgguggagcgcaucccccucgagaaccugcagaucauccggggcaacauguacuacgagaacuccuacgcccuggcgguccucagcaacuacgacgccaacaagaccggccugaaggagcugcccaugcgcaaccuccaggagauccugcacggggccgugcgguucuccaacaaccccgcccugugcaacguggagagcauccaguggcgcgacaucgucuccagcgacuuccucuccaacaugagcauggacuuccagaaccaccugggcuccugccagaagugcgacccgagcugccccaacggguccugcuggggcgccggggaggagaacugccagaagcugaccaagaucaucugcgcgcagcagugcagcggccggugccgcggcaagucccccagcgacugcugccacaaccagugcgccgccgggugcaccggcccccgggaguccgacugccucgugugccgcaaguuccgggacgaggccacgugcaaggacacgugcccgccccugaugcuguacaaccccaccaccuaccagauggacgugaaccccgaggggaaguacagcuucggcgcgaccugcgucaagaagugcccgcgcaacuacguggugaccgaccacggcagcugcguccgggccugcggggccgacuccuacgagauggaggaggacggcgugcgcaagugcaagaagugcgaggggcccugccggaaggugugcaacggcaucgggaucggcgaguucaaggacagccucuccaucaacgccaccaacaucaagcacuucaagaacugcaccagcaucuccggcgaccugcacauccugcccgucgccuuccgcggggacagcuucacgcacacgcccccgcucgacccccaggagcuggacauccugaagaccgugaaggagaucaccggcuuccuccugauccaggccuggcccgagaaccggaccgaccugcacgcguucgagaaccucgagaucauccgcgggcggaccaagcagcacggccaguucucccuggccguggucagccugaacaucaccucccucgggcugcgcagccugaaggagaucuccgacggcgacgugaucaucagcggcaacaagaaccucugcuacgccaacaccaucaacuggaagaagcuguucgggacguccggccagaagaccaagaucaucagcaaccgcggggagaacuccugcaaggccaccggccaggugugccacgcccugugcagccccgaggggugcuggggcccggagccccgggacugcgucuccugccgcaacgugagccggggccgcgagugcgucgacaagugcaaccuccuggagggggagccccgggaguucguggagaacuccgagugcauccagugccaccccgagugccugccgcaggcgaugaacaucacgugcaccggccgcgggcccgacaacugcauccagugcgcccacuacaucgacggcccccacugcgugaagaccugccccgccggcgucaugggggagaacaacacccugguguggaaguacgccgacgcgggccacgugugccaccucugccacccgaacugcaccuacgggugcacgggccccgggcuggagggcugccccaccaacggcagcuacaucgucagccacuucccgcgguccuucuacaagaugagcgugcac

SEQ ID NO: 1346 - RNA, 1971 nt, Artificial Sequence
  derived and/or modified sequence opt2 from EGFR__Homo_sapiens__EAW50963
augcgccccuccggcaccgccggcgccgcccuccucgcccuccucgccgcccucugccccgccucccgcgcccucgaggagaagaaggucugccagggcaccuccaacaagcucacccagcucggcaccuucgaggaccacuuccucucccuccagcgcauguucaacaacugcgaggucguccucggcaaccucgagaucaccuacguccagcgcaacuacgaccucuccuuccucaagaccauccaggaggucgccggcuacguccucaucgcccucaacaccgucgagcgcaucccccucgagaaccuccagaucauccgcggcaacauguacuacgagaacuccuacgcccucgccguccucuccaacuacgacgccaacaagaccggccucaaggagcuccccaugcgcaaccuccaggagauccuccacggcgccguccgcuucuccaacaaccccgcccucugcaacgucgaguccauccaguggcgcgacaucgucuccuccgacuuccucuccaacauguccauggacuuccagaaccaccucggcuccugccagaagugcgaccccuccugccccaacggcuccugcuggggcgccggcgaggagaacugccagaagcucaccaagaucaucugcgcccagcagugcuccggccgcugccgcggcaagucccccuccgacugcugccacaaccagugcgccgccggcugcaccggcccccgcgaguccgacugccucgucugccgcaaguuccgcgacgaggccaccugcaaggacaccugccccccccucaugcucuacaaccccaccaccuaccagauggacgucaaccccgagggcaaguacuccuucggcgccaccugcgucaagaagugcccccgcaacuacgucgucaccgaccacggcuccugcguccgcgccugcggcgccgacuccuacgagauggaggaggacggcguccgcaagugcaagaagugcgagggccccugccgcaaggucugcaacggcaucggcaucggcgaguucaaggacucccucuccaucaacgccaccaacaucaagcacuucaagaacugcaccuccaucuccggcgaccuccacauccuccccgucgccuuccgcggcgacuccuucacccacacccccccccucgacccccaggagcucgacauccucaagaccgucaaggagaucaccggcuuccuccucauccaggccuggcccgagaaccgcaccgaccuccacgccuucgagaaccucgagaucauccgcggccgcaccaagcagcacggccaguucucccucgccgucgucucccucaacaucaccucccucggccuccgcucccucaaggagaucuccgacggcgacgucaucaucuccggcaacaagaaccucugcuacgccaacaccaucaacuggaagaagcucuucggcaccuccggccagaagaccaagaucaucuccaaccgcggcgagaacuccugcaaggccaccggccaggucugccacgcccucugcucccccgagggcugcuggggccccgagccccgcgacugcgucuccugccgcaacgucucccgcggccgcgagugcgucgacaagugcaaccuccucgagggcgagccccgcgaguucgucgagaacuccgagugcauccagugccaccccgagugccucccccaggccaugaacaucaccugcaccggccgcggccccgacaacugcauccagugcgcccacuacaucgacggcccccacugcgucaagaccugccccgccggcgucaugggcgagaacaacacccucgucuggaaguacgccgacgccggccacgucugccaccucugccaccccaacugcaccuacggcugcaccggccccggccucgagggcugccccaccaacggcuccuacaucgucucccacuucccccgcuccuucuacaagauguccguccac

SEQ ID NO: 1347 - RNA, 1971 nt, Artificial Sequence
  derived and/or modified sequence opt3 from EGFR__Homo_sapiens__EAW50963
augagacccagcggcaccgccggggcugcacugcucgcccuucuggcggcuuugugcccugccuccagggcauuagaggaaaagaaagugugucagggaacaucuaacaagcugacucaacuagguacguucgaggaccacuuucucucacugcagcggauguucaauaacugcgaagucguucuuggcaaucuggagaucaccuacgugcagcgcaacuaugauuugaguuuucucaaaacaauucaggaaguagccggguacgugcugauagcucugaauacugucgagcgaaucccacucgagaacuuacaaauuauccguggaaauauguauuacgaaaacagcuaugcacuggccgugcuuuccaauuacgacgcuaacaagaccggcuugaaagagcugccgaugagaaaucuacaggaaauucuccauggugccguuagguucucuaacaaucccgcgcuguguaacguggagucgauccaguggcgggauauagucucaagcgacuuucuuaguaauauguccauggauuuccagaaccaccuggggucuugccaaaagugugacccuagcugcccaaacggauccuguuggggcgcaggcgaggaaaauugccagaaguugacaaaaaucauuugugcccagcagugcucagggcgcuguagaggaaagagucccagcgauugcugccauaaccaaugugcugccgguugcaccggcccuagggagucugacugucucgugugccggaaauuucgcgaugaagcaacuuguaaggacacaugcccaccccugauguuauauaauccuaccacguaccagauggauguaaacccagaggggaaauacuccuucggagcuacuuguguuaagaagugcccgcgaaauuauguggucaccgaccacggcucaugugugagagccugcggugcggauagcuacgaaauggaggaggacggggugaggaaauguaagaaaugcgaaggacccugccggaaggucuguaacggcaucggcauuggggaguuuaaagacagucugucuaucaaugccacaaacauaaagcauuucaaaaauugcacuuccauuagcggagaucuccacauccuuccuguugcauuucguggugacucguucacccacacaccaccccuggauccucaggaauuggacauucuaaagaccgugaaggagaucacgggcuuucugcucauccaggcuuggccagaaaaccgcacugaucugcaugccuucgagaaucuugagauuauaagagggaggacaaaacaacacggacaguucucucuggcuguaguguccuugaacaucaccucacucggccugcggaguuuaaaggaaauuagcgacggugaugucaucauauccgggaauaaaaaccuguguuaugccaauacuauuaacuggaagaaacuauuuggcacaucuggacagaagaccaagaucaucagcaaccgaggcgaaaauucaugcaaagcaacggggcaagugugucaugcccucugcagucccgaaggauguugggguccggagccucgcgacugcguuuccuguagaaacgugagcaggggccgggaaugcgucgauaaguguaaucugcuugagggggagccccgcgaguucguggagaacucugaaugcauucagugccacccagaguguuugccucaggcuaugaauauuaccugcacaggaagaggccccgacaacuguauccagugcgcgcacuacauagaugguccacauuguguaaaaacuugccccgcagggguuaugggcgagaauaacacccugguguggaaguaugccgacgcuggacacgucugucaucucugccacccuaauuguacauacggcugcacugggccaggacuggaagguuguccgaccaacggcucauauaucgugagucauuuucccaggagcuucuacaaaauguccguccac

SEQ ID NO: 1348 - RNA, 1971 nt, Artificial Sequence
  derived and/or modified sequence opt4 from EGFR__Homo_sapiens__EAW50963
augagacccagcggcaccgccggcgccgcccugcuggcccugcuggccgcccugugccccgccagcagagcccuggaggagaagaaggugugccagggcaccagcaacaagcugacccagcugggcaccuucgaggaccacuuccugagccugcagagaauguucaacaacugcgagguggugcugggcaaccuggagaucaccuacgugcagagaaacuacgaccugagcuuccugaagaccauccaggagguggccggcuacgugcugaucgcccugaacaccguggagagaaucccccuggagaaccugcagaucaucagaggcaacauguacuacgagaacagcuacgcccuggccgugcugagcaacuacgacgccaacaagaccggccugaaggagcugcccaugagaaaccugcaggagauccugcacggcgccgugagauucagcaacaaccccgcccugugcaacguggagagcauccaguggagagacaucgugagcagcgacuuccugagcaacaugagcauggacuuccagaaccaccugggcagcugccagaagugcgaccccagcugccccaacggcagcugcuggggcgccggcgaggagaacugccagaagcugaccaagaucaucugcgcccagcagugcagcggcagaugcagaggcaagagccccagcgacugcugccacaaccagugcgccgccggcugcaccggccccagagagagcgacugccuggugugcagaaaguucagagacgaggccaccugcaaggacaccugccccccccugaugcuguacaaccccaccaccuaccagauggacgugaaccccgagggcaaguacagcuucggcgccaccugcgugaagaagugccccagaaacuacguggugaccgaccacggcagcugcgugagagccugcggcgccgacagcuacgagauggaggaggacggcgugagaaagugcaagaagugcgagggccccugcagaaaggugugcaacggcaucggcaucggcgaguucaaggacagccugagcaucaacgccaccaacaucaagcacuucaagaacugcaccagcaucagcggcgaccugcacauccugcccguggccuucagaggcgacagcuucacccacacccccccccuggacccccaggagcuggacauccugaagaccgugaaggagaucaccggcuuccugcugauccaggccuggcccgagaacagaaccgaccugcacgccuucgagaaccuggagaucaucagaggcagaaccaagcagcacggccaguucagccuggccguggugagccugaacaucaccagccugggccugagaagccugaaggagaucagcgacggcgacgugaucaucagcggcaacaagaaccugugcuacgccaacaccaucaacuggaagaagcuguucggcaccagcggccagaagaccaagaucaucagcaacagaggcgagaacagcugcaaggccaccggccaggugugccacgcccugugcagccccgagggcugcuggggccccgagcccagagacugcgugagcugcagaaacgugagcagaggcagagagugcguggacaagugcaaccugcuggagggcgagcccagagaguucguggagaacagcgagugcauccagugccaccccgagugccugccccaggccaugaacaucaccugcaccggcagaggccccgacaacugcauccagugcgcccacuacaucgacggcccccacugcgugaagaccugccccgccggcgugaugggcgagaacaacacccugguguggaaguacgccgacgccggccacgugugccaccugugccaccccaacugcaccuacggcugcaccggccccggccuggagggcugccccaccaacggcagcuacaucgugagccacuuccccagaagcuucuacaagaugagcgugcac

SEQ ID NO: 1349 - RNA, 1971 nt, Artificial Sequence
  derived and/or modified sequence opt5 from EGFR__Homo_sapiens__EAW50963
augagacccagcggcaccgccggggcugcccugcucgcgcugcuugcugcccugugcccugccucccgggcucucgaggaaaagaaagugugucagggaacaucuaacaagcugacgcaacuuggcaccuucgaggaccacuuucugagccuccagcgcauguucaauaacugcgaagucguucuggggaaucuggagaucacauacgugcagagaaacuaugaucucuccuuucugaaaaccauucaggaaguggccggauacguccuuaucgcucugaauacaguggagcggauuccgcucgagaaccugcaaaucauucgcggcaauauguauuacgaaaacucuuaugcccuugcgguucugagcaauuacgacgccaacaagaccgggcucaaagagcugcccaugagaaaucugcaggaaauccuccauggagcugugcgguucuccaacaauccugcccuguguaacgucgagucuauccaguggcgcgauauugugagcuccgacuuucuuagcaauaugucuauggauuuccagaaccaccugggcuccugccaaaagugugaccccagcugcccuaacggcucuuguuggggagcuggggaggaaaauugccagaagcucacaaaaaucauuugugcccagcagugcuccggcagaugucggggaaagagccccucugauugcugccauaaccaaugugcggccgggugcaccggcccucgcgaguccgacugucugguuugcagaaaauuucgggaugaagcuacguguaaggauaccugcccgccccuuaugcuguauaauccuacaaccuaccagauggacgugaaccccgaggggaaauacagcuucggagccacaugugucaagaagugcccucgcaauuauguggugaccgaccacggcuccugugucagagcuugcggcgccgauucuuacgaaauggaggaggacgggguucggaaauguaagaaaugcgaaggacccugccgcaagguguguaacggcaucgggauuggagaguuuaaagacagccucuccaucaaugccacgaacauuaagcauuucaaaaauugcacaagcaucucuggcgaucugcacauccugccgguggcuuuuagaggggacuccuucacccacacaccuccccucgauccucaggaacuggacauucuuaagaccgucaaggagaucaccggauuucugcucauucaagcguggcccgaaaaccggacagaucugcaugccuucgagaaucuugagaucauuagaggccgcacgaaacagcacggccaguucagccuggcugugguuucucucaacaucaccagccuggggcugcggucccucaaggaaaucucugacggagaugugauuaucagcggcaauaaaaaccuguguuaugccaauacaauuaacuggaagaaacuuuuugggaccuccggacagaagacaaagaucauuagcaacagaggcgaaaauucuugcaaagccaccgggcaagucugucaugcucugugcucccccgaaggcuguuggggaccugagccgcgcgacugcgugagcugucggaacguuucuagaggccgcgaaugcguggauaaguguaaucuccuggagggggagccccgggaguucgucgagaacuccgaaugcauccagugccacccugagugucugccccaggccaugaauaucacgugcacaggaagaggcccugacaacuguauucagugcgcgcacuacaucgaugggccccauugugugaaaaccugcccggcuggagucaugggcgagaauaacacccuuguguggaaguaugccgacgccgggcacguuugucaucucugccacccuaauuguacauacggcugcaccggacccggccuggaaggguguccuacaaacggaagcuauauugugucccauuuuccccgcucuuucuacaaaaugagcguccac

SEQ ID NO: 1350 - protein, 1136 aa, Artificial Sequence
  EGFR__Homo_sapiens__E7BSV0
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 1351 - RNA, 3411 nt, Artificial Sequence
  EGFR__Homo_sapiens__ADL28125
augcgacccuccgggacggccggggcagcgcuccuggcgcugcuggcugcgcucugcccggcgagucgggcucuggaggaaaagaaaguuugccaaggcacgaguaacaagcucacgcaguugggcacuuuugaagaucauuuucucagccuccagaggauguucaauaacugugaggugguccuugggaauuuggaaauuaccuaugugcagaggaauuaugaucuuuccuucuuaaagaccauccaggagguggcugguuauguccucauugcccucaacacaguggagcgaauuccuuuggaaaaccugcagaucaucagaggaaauauguacuacgaaaauuccuaugccuuagcagucuuaucuaacuaugaugcaaauaaaaccggacugaaggagcugcccaugagaaauuuacaggaaauccugcauggcgccgugcgguucagcaacaacccugcccugugcaacguggagagcauccaguggcgggacauagucagcagugacuuucucagcaacaugucgauggacuuccagaaccaccugggcagcugccaaaagugugauccaagcugucccaaugggagcugcuggggugcaggagaggagaacugccagaaacugaccaaaaucaucugugcccagcagugcuccgggcgcugccguggcaagucccccagugacugcugccacaaccagugugcugcaggcugcacaggcccccgggagagcgacugccuggucugccgcaaauuccgagacgaagccacgugcaaggacaccugccccccacucaugcucuacaaccccaccacguaccagauggaugugaaccccgagggcaaauacagcuuuggugccaccugcgugaagaaguguccccguaauuauguggugacagaucacggcucgugcguccgagccuguggggccgacagcuaugagauggaggaagacggcguccgcaaguguaagaagugcgaagggccuugccgcaaaguguguaacggaauagguauuggugaauuuaaagacucacucuccauaaaugcuacgaauauuaaacacuucaaaaacugcaccuccaucaguggcgaucuccacauccugccgguggcauuuaggggugacuccuucacacauacuccuccucuggauccacaggaacuggauauucugaaaaccguaaaggaaaucacaggguuuuugcugauucaggcuuggccugaaaacaggacggaccuccaugccuuugagaaccuagaaaucauacgcggcaggaccaagcaacauggucaguuuucucuugcagucgucagccugaacauaacauccuugggauuacgcucccucaaggagauaagugauggagaugugauaauuucaggaaacaaaaauuugugcuaugcaaauacaauaaacuggaaaaaacuguuugggaccuccggucagaaaaccaaaauuauaagcaacagaggugaaaacagcugcaaggccacaggccaggucugccaugccuugugcucccccgagggcugcuggggcccggagcccagggacugcgucucuugccggaaugucagccgaggcagggaaugcguggacaagugcaaccuucuggagggugagccaagggaguuuguggagaacucugagugcauacagugccacccagagugccugccucaggccaugaacaucaccugcacaggacggggaccagacaacuguauccagugugcccacuacauugacggcccccacugcgucaagaccugcccggcaggagucaugggagaaaacaacacccuggucuggaaguacgcagacgccggccaugugugccaccugugccauccaaacugcaccuacggaugcacugggccaggucuugaaggcuguccaacgaaugggccuaagaucccguccaucgccacugggauggugggggcccuccucuugcugcuggugguggcccuggggaucggccucuucaugcgaaggcgccacaucguucggaagcgcacgcugcggaggcugcugcaggagagggagcuuguggagccucuuacacccaguggagaagcucccaaccaagcucucuugaggaucuugaaggaaacugaauucaaaaagaucaaagugcugggcuccggugcguucggcacgguguauaagggacucuggaucccagaaggugagaaaguuaaaauucccgucgcuaucaaggaauuaagagaagcaacaucuccgaaagccaacaaggaaauccucgaugaagccuacgugauggccagcguggacaacccccacgugugccgccugcugggcaucugccucaccuccaccgugcagcucaucacgcagcucaugcccuucggcugccuccuggacuauguccgggaacacaaagacaauauuggcucccaguaccugcucaacuggugugugcagaucgcaaagggcaugaacuacuuggaggaccgucgcuuggugcaccgcgaccuggcagccaggaacguacuggugaaaacaccgcagcaugucaagaucacagauuuugggcuggccaaacugcugggugcggaagagaaagaauaccaugcagaaggaggcaaagugccuaucaaguggauggcauuggaaucaauuuuacacagaaucuauacccaccagagugaugucuggagcuacggggugaccguuugggaguugaugaccuuuggauccaagccauaugacggaaucccugccagcgagaucuccuccauccuggagaaaggagaacgccucccucagccacccauauguaccaucgaugucuacaugaucauggucaagugcuggaugauagacgcagauagucgcccaaaguuccgugaguugaucaucgaauucuccaaaauggcccgagacccccagcgcuaccuugucauucagggggaugaaagaaugcauuugccaaguccuacagacuccaacuucuaccgugcccugauggaugaagaagacauggacgacgugguggaugccgacgaguaccucaucccacagcagggcuucuucagcagccccuccacgucacggacuccccuccugagcucucugagugcaaccagcaacaauuccaccguggcuugcauugauagaaaugggcugcaaagcugucccaucaaggaagacagcuucuugcagcgauacagcucagaccccacaggcgccuugacugaggacagcauagacgacaccuuccucccagugccuggugaguggcuugucuggaaacaguccugcuccucaaccuccucgacccacucagcagcagccagucuccaguguccaagccaggugcucccuccagcaucuccagagggggaaacaguggcagauuugcagacacaguga

SEQ ID NO: 1352 - RNA, 3411 nt, Artificial Sequence
  derived and/or modified sequence opt1 from EGFR__Homo_sapiens__ADL28125
augcgccccagcggcaccgccggggccgcgcugcucgcccugcuggccgcccucugcccggccucccgggcgcuggaggagaagaaggugugccagggcaccagcaacaagcugacgcagcucgggaccuucgaggaccacuuccugucccugcagcgcauguucaacaacugcgaggucgugcucggcaaccuggagaucaccuacgugcagcggaacuacgaccugagcuuccucaagaccauccaggaggucgccggguacgugcugaucgcccugaacacgguggagcgcaucccccucgagaaccugcagaucauccggggcaacauguacuacgagaacuccuacgcccuggcgguccucagcaacuacgacgccaacaagaccggccugaaggagcugcccaugcgcaaccuccaggagauccugcacggggccgugcgguucuccaacaaccccgcccugugcaacguggagagcauccaguggcgcgacaucgucuccagcgacuuccucuccaacaugagcauggacuuccagaaccaccugggcuccugccagaagugcgacccgagcugccccaacggguccugcuggggcgccggggaggagaacugccagaagcugaccaagaucaucugcgcgcagcagugcagcggccggugccgcggcaagucccccagcgacugcugccacaaccagugcgccgccgggugcaccggcccccgggaguccgacugccucgugugccgcaaguuccgggacgaggccacgugcaaggacacgugcccgccccugaugcuguacaaccccaccaccuaccagauggacgugaaccccgaggggaaguacagcuucggcgcgaccugcgucaagaagugcccgcgcaacuacguggugaccgaccacggcagcugcguccgggccugcggggccgacuccuacgagauggaggaggacggcgugcgcaagugcaagaagugcgaggggcccugccggaaggugugcaacggcaucgggaucggcgaguucaaggacagccucuccaucaacgccaccaacaucaagcacuucaagaacugcaccagcaucuccggcgaccugcacauccugcccgucgccuuccgcggggacagcuucacgcacacgcccccgcucgacccccaggagcuggacauccugaagaccgugaaggagaucaccggcuuccuccugauccaggccuggcccgagaaccggaccgaccugcacgcguucgagaaccucgagaucauccgcgggcggaccaagcagcacggccaguucucccuggccguggucagccugaacaucaccucccucgggcugcgcagccugaaggagaucuccgacggcgacgugaucaucagcggcaacaagaaccucugcuacgccaacaccaucaacuggaagaagcuguucgggacguccggccagaagaccaagaucaucagcaaccgcggggagaacuccugcaaggccaccggccaggugugccacgcccugugcagccccgaggggugcuggggcccggagccccgggacugcgucuccugccgcaacgugagccggggccgcgagugcgucgacaagugcaaccuccuggagggggagccccgggaguucguggagaacuccgagugcauccagugccaccccgagugccugccgcaggcgaugaacaucacgugcaccggccgcgggcccgacaacugcauccagugcgcccacuacaucgacggcccccacugcgugaagaccugccccgccggcgucaugggggagaacaacacccugguguggaaguacgccgacgcgggccacgugugccaccucugccacccgaacugcaccuacgggugcacgggccccgggcuggagggcugccccaccaacggcccgaagauccccagcaucgccaccgggauggucggcgcccugcuccugcugcucgugguggcccuggggaucggccuguucaugcggcgccggcacaucguccgcaagcggacccuccgccggcugcugcaggagcgcgagcucguggagccccugacgcccagcggggaggccccgaaccaggcgcugcuccggauccugaaggagaccgaguucaagaagaucaaggugcugggcuccggcgccuucgggaccgucuacaagggccucuggauccccgagggggagaaggugaagauccccguggccaucaaggagcugcgcgaggccaccagccccaaggccaacaaggagauccuggacgaggcguacgucauggccuccguggacaacccgcacgugugccggcuccugggcaucugccugaccagcacgguccagcucaucacccagcugaugcccuucgggugccugcucgacuacgugcgcgagcacaaggacaacaucggcucccaguaccugcugaacuggugcgugcagaucgccaagggcaugaacuaccucgaggaccggcgccugguccaccgcgaccuggccgcccggaacgugcucgugaagacgccccagcacgucaagaucaccgacuucgggcuggcgaagcugcucggcgccgaggagaaggaguaccacgccgagggcgggaaggugcccaucaaguggauggcccuggagagcauccugcaccgcaucuacacccaccaguccgacguguggagcuacggggucaccgugugggagcucaugaccuucggcuccaagccguacgacggcauccccgcgagcgagaucuccagcauccuggagaagggggagcggcugccccagcccccgaucugcaccaucgacguguacaugaucauggucaagugcuggaugaucgacgccgacucccgccccaaguuccgggagcucaucaucgaguucagcaagauggcccgcgacccccagcgguaccuggugauccagggcgacgagcgcaugcaccuccccuccccgacggacagcaacuucuaccgggcccugauggacgaggaggacauggacgacguggucgacgccgacgaguaccugaucccccagcagggguucuucuccagccccagcaccucccgcacgccccugcucagcucccugagcgcgaccuccaacaacagcaccguggccugcaucgaccggaacggccugcaguccugcccgaucaaggaggacagcuuccuccagcgcuacuccagcgaccccaccggcgcccugaccgaggacuccaucgacgacaccuuccugcccgugccgggggaguggcucgucuggaagcagagcugcuccagcacguccagcacccacuccgccgccgcgagccugcagugccccucccaggugcugccgcccgccagccccgagggcgagaccguggccgaccuccagacccaguga

SEQ ID NO: 1353 - RNA, 3411 nt, Artificial Sequence
  derived and/or modified sequence opt2 from EGFR__Homo_sapiens__ADL28125
augcgccccuccggcaccgccggcgccgcccuccucgcccuccucgccgcccucugccccgccucccgcgcccucgaggagaagaaggucugccagggcaccuccaacaagcucacccagcucggcaccuucgaggaccacuuccucucccuccagcgcauguucaacaacugcgaggucguccucggcaaccucgagaucaccuacguccagcgcaacuacgaccucuccuuccucaagaccauccaggaggucgccggcuacguccucaucgcccucaacaccgucgagcgcaucccccucgagaaccuccagaucauccgcggcaacauguacuacgagaacuccuacgcccucgccguccucuccaacuacgacgccaacaagaccggccucaaggagcuccccaugcgcaaccuccaggagauccuccacggcgccguccgcuucuccaacaaccccgcccucugcaacgucgaguccauccaguggcgcgacaucgucuccuccgacuuccucuccaacauguccauggacuuccagaaccaccucggcuccugccagaagugcgaccccuccugccccaacggcuccugcuggggcgccggcgaggagaacugccagaagcucaccaagaucaucugcgcccagcagugcuccggccgcugccgcggcaagucccccuccgacugcugccacaaccagugcgccgccggcugcaccggcccccgcgaguccgacugccucgucugccgcaaguuccgcgacgaggccaccugcaaggacaccugccccccccucaugcucuacaaccccaccaccuaccagauggacgucaaccccgagggcaaguacuccuucggcgccaccugcgucaagaagugcccccgcaacuacgucgucaccgaccacggcuccugcguccgcgccugcggcgccgacuccuacgagauggaggaggacggcguccgcaagugcaagaagugcgagggccccugccgcaaggucugcaacggcaucggcaucggcgaguucaaggacucccucuccaucaacgccaccaacaucaagcacuucaagaacugcaccuccaucuccggcgaccuccacauccuccccgucgccuuccgcggcgacuccuucacccacacccccccccucgacccccaggagcucgacauccucaagaccgucaaggagaucaccggcuuccuccucauccaggccuggcccgagaaccgcaccgaccuccacgccuucgagaaccucgagaucauccgcggccgcaccaagcagcacggccaguucucccucgccgucgucucccucaacaucaccucccucggccuccgcucccucaaggagaucuccgacggcgacgucaucaucuccggcaacaagaaccucugcuacgccaacaccaucaacuggaagaagcucuucggcaccuccggccagaagaccaagaucaucuccaaccgcggcgagaacuccugcaaggccaccggccaggucugccacgcccucugcucccccgagggcugcuggggccccgagccccgcgacugcgucuccugccgcaacgucucccgcggccgcgagugcgucgacaagugcaaccuccucgagggcgagccccgcgaguucgucgagaacuccgagugcauccagugccaccccgagugccucccccaggccaugaacaucaccugcaccggccgcggccccgacaacugcauccagugcgcccacuacaucgacggcccccacugcgucaagaccugccccgccggcgucaugggcgagaacaacacccucgucuggaaguacgccgacgccggccacgucugccaccucugccaccccaacugcaccuacggcugcaccggccccggccucgagggcugccccaccaacggccccaagauccccuccaucgccaccggcauggucggcgcccuccuccuccuccucgucgucgcccucggcaucggccucuucaugcgccgccgccacaucguccgcaagcgcacccuccgccgccuccuccaggagcgcgagcucgucgagccccucacccccuccggcgaggcccccaaccaggcccuccuccgcauccucaaggagaccgaguucaagaagaucaagguccucggcuccggcgccuucggcaccgucuacaagggccucuggauccccgagggcgagaaggucaagauccccgucgccaucaaggagcuccgcgaggccaccucccccaaggccaacaaggagauccucgacgaggccuacgucauggccuccgucgacaacccccacgucugccgccuccucggcaucugccucaccuccaccguccagcucaucacccagcucaugcccuucggcugccuccucgacuacguccgcgagcacaaggacaacaucggcucccaguaccuccucaacuggugcguccagaucgccaagggcaugaacuaccucgaggaccgccgccucguccaccgcgaccucgccgcccgcaacguccucgucaagaccccccagcacgucaagaucaccgacuucggccucgccaagcuccucggcgccgaggagaaggaguaccacgccgagggcggcaagguccccaucaaguggauggcccucgaguccauccuccaccgcaucuacacccaccaguccgacgucugguccuacggcgucaccgucugggagcucaugaccuucggcuccaagcccuacgacggcauccccgccuccgagaucuccuccauccucgagaagggcgagcgccucccccagccccccaucugcaccaucgacgucuacaugaucauggucaagugcuggaugaucgacgccgacucccgccccaaguuccgcgagcucaucaucgaguucuccaagauggcccgcgacccccagcgcuaccucgucauccagggcgacgagcgcaugcaccuccccucccccaccgacuccaacuucuaccgcgcccucauggacgaggaggacauggacgacgucgucgacgccgacgaguaccucaucccccagcagggcuucuucuccucccccuccaccucccgcaccccccuccucuccucccucuccgccaccuccaacaacuccaccgucgccugcaucgaccgcaacggccuccaguccugccccaucaaggaggacuccuuccuccagcgcuacuccuccgaccccaccggcgcccucaccgaggacuccaucgacgacaccuuccuccccguccccggcgaguggcucgucuggaagcaguccugcuccuccaccuccuccacccacuccgccgccgccucccuccagugccccucccagguccucccccccgccucccccgagggcgagaccgucgccgaccuccagacccaguga

SEQ ID NO: 1354 - RNA, 3411 nt, Artificial Sequence
  derived and/or modified sequence opt3 from EGFR__Homo_sapiens__ADL28125
augagacccagcggcaccgccggggcugcacugcucgcccuucuggcggcuuugugcccugccuccagggcauuagaggaaaagaaagugugucagggaacaucuaacaagcugacucaacuagguacguucgaggaccacuuucucucacugcagcggauguucaauaacugcgaagucguucuuggcaaucuggagaucaccuacgugcagcgcaacuaugauuugaguuuucucaaaacaauucaggaaguagccggguacgugcugauagcucugaauacugucgagcgaaucccacucgagaacuuacaaauuauccguggaaauauguauuacgaaaacagcuaugcacuggccgugcuuuccaauuacgacgcuaacaagaccggcuugaaagagcugccgaugagaaaucuacaggaaauucuccauggugccguuagguucucuaacaaucccgcgcuguguaacguggagucgauccaguggcgggauauagucucaagcgacuuucuuaguaauauguccauggauuuccagaaccaccuggggucuugccaaaagugugacccuagcugcccaaacggauccuguuggggcgcaggcgaggaaaauugccagaaguugacaaaaaucauuugugcccagcagugcucagggcgcuguagaggaaagagucccagcgauugcugccauaaccaaugugcugccgguugcaccggcccuagggagucugacugucucgugugccggaaauuucgcgaugaagcaacuuguaaggacacaugcccaccccugauguuauauaauccuaccacguaccagauggauguaaacccagaggggaaauacuccuucggagcuacuuguguuaagaagugcccgcgaaauuauguggucaccgaccacggcucaugugugagagccugcggugcggauagcuacgaaauggaggaggacggggugaggaaauguaagaaaugcgaaggacccugccggaaggucuguaacggcaucggcauuggggaguuuaaagacagucugucuaucaaugccacaaacauaaagcauuucaaaaauugcacuuccauuagcggagaucuccacauccuuccuguugcauuucguggugacucguucacccacacaccaccccuggauccucaggaauuggacauucuaaagaccgugaaggagaucacgggcuuucugcucauccaggcuuggccagaaaaccgcacugaucugcaugccuucgagaaucuugagauuauaagagggaggacaaaacaacacggacaguucucucuggcuguaguguccuugaacaucaccucacucggccugcggaguuuaaaggaaauuagcgacggugaugucaucauauccgggaauaaaaaccuguguuaugccaauacuauuaacuggaagaaacuauuuggcacaucuggacagaagaccaagaucaucagcaaccgaggcgaaaauucaugcaaagcaacggggcaagugugucaugcccucugcagucccgaaggauguugggguccggagccucgcgacugcguuuccuguagaaacgugagcaggggccgggaaugcgucgauaaguguaaucugcuugagggggagccccgcgaguucguggagaacucugaaugcauucagugccacccagaguguuugccucaggcuaugaauauuaccugcacaggaagaggccccgacaacuguauucagugcgcgcacuacauagaugguccacauuguguaaaaacuugccccgcagggguuaugggcgagaauaacacccugguguggaaguaugccgacgcuggacacgucugucaucucugccacccuaauuguacauacggcugcacugggccaggacuggaagguuguccgaccaacggccccaaaaucccuucaauugccacagggauggugggagcacuucuguugcuccuggucguggccuuaggcaucggucuguuuaugaggcgucggcauaucguucgaaagagaacccuaaggcgccuccugcaagagcgggaacuuguggagccauugacucccaguggggaagcuccuaaucaggcccugcucagaauccugaaggagacggaguucaaaaagauaaaaguauuaggcagcggagcauuuggcacagucuauaaggggcuguggaucccagaaggagagaaagugaagauucccguugcgaucaaggaacuuagggaggcuaccuccccgaaagccaacaaggaaauuuuggacgaggcauacgugauggccucugucgauaauccucacgugugccgccuccugggcaucugccuaacuucgaccguacagcugauaacacagcucaugccauucgguugucugcuugacuacgugcgagagcacaaagauaacaucgggagccaauauuugcugaauuggugcguucagauugcuaagggaaugaacuacuuagaagaccggcgucucguccauagagaucuggccgcaaggaacgugcuugugaaaacuccccagcacgucaagaucaccgacuuuggccuggcuaaauugcucggugccgaggaaaaggaguaucaugcggaaggcgggaagguuccuauuaaauggauggcccuggaguccauccuacaccgcauauacacacaccagucagauguguggaguuauggagugacgguaugggagcugaugaccuucggcucuaagcccuacgacgggauuccagcuagcgaaaucuccucaauucucgagaaaggagaacggcugccucaacccccaaucuguacuauagaugucuauaugaucauggugaagugcuggaugauugacgcagauagcagaccgaaauuuagggagcuuaucauugaguucucuaagauggcccgagacccucagcgcuacuugguuauccagggcgaugaacggaugcaucugcccuccccaacagacaguaauuuuuacagagcuuuaauggacgaggaagauauggacgauguggucgacgccgaugaguaucucauaccccaacaggguuucuuuagcucuccuuccaccucaaggacaccacugcuuaguagccugucggcaacuuccaacaauucuaccguggcguguauugaccguaacgggcuacagagcugccccaucaaggaagauucauuccuccagcgcuacaguuccgacccuacgggagcccugaccgaggauucuaucgacgauacauucuugccgguuccaggcgaguggcugguguggaaacaaagcuguuccucaacuagcaguacccacucugcugccgcauccuuacagugccccagccagguacucccuccagcuucgcccgaaggugagacagucgccgaccugcagacucaauga

SEQ ID NO: 1355 - RNA, 3411 nt, Artificial Sequence
  derived and/or modified sequence opt4 from EGFR__Homo_sapiens__ADL28125
augagacccagcggcaccgccggcgccgcccugcuggcccugcuggccgcccugugccccgccagcagagcccuggaggagaagaaggugugccagggcaccagcaacaagcugacccagcugggcaccuucgaggaccacuuccugagccugcagagaauguucaacaacugcgagguggugcugggcaaccuggagaucaccuacgugcagagaaacuacgaccugagcuuccugaagaccauccaggagguggccggcuacgugcugaucgcccugaacaccguggagagaaucccccuggagaaccugcagaucaucagaggcaacauguacuacgagaacagcuacgcccuggccgugcugagcaacuacgacgccaacaagaccggccugaaggagcugcccaugagaaaccugcaggagauccugcacggcgccgugagauucagcaacaaccccgcccugugcaacguggagagcauccaguggagagacaucgugagcagcgacuuccugagcaacaugagcauggacuuccagaaccaccugggcagcugccagaagugcgaccccagcugccccaacggcagcugcuggggcgccggcgaggagaacugccagaagcugaccaagaucaucugcgcccagcagugcagcggcagaugcagaggcaagagccccagcgacugcugccacaaccagugcgccgccggcugcaccggccccagagagagcgacugccuggugugcagaaaguucagagacgaggccaccugcaaggacaccugccccccccugaugcuguacaaccccaccaccuaccagauggacgugaaccccgagggcaaguacagcuucggcgccaccugcgugaagaagugccccagaaacuacguggugaccgaccacggcagcugcgugagagccugcggcgccgacagcuacgagauggaggaggacggcgugagaaagugcaagaagugcgagggccccugcagaaaggugugcaacggcaucggcaucggcgaguucaaggacagccugagcaucaacgccaccaacaucaagcacuucaagaacugcaccagcaucagcggcgaccugcacauccugcccguggccuucagaggcgacagcuucacccacacccccccccuggacccccaggagcuggacauccugaagaccgugaaggagaucaccggcuuccugcugauccaggccuggcccgagaacagaaccgaccugcacgccuucgagaaccuggagaucaucagaggcagaaccaagcagcacggccaguucagccuggccguggugagccugaacaucaccagccugggccugagaagccugaaggagaucagcgacggcgacgugaucaucagcggcaacaagaaccugugcuacgccaacaccaucaacuggaagaagcuguucggcaccagcggccagaagaccaagaucaucagcaacagaggcgagaacagcugcaaggccaccggccaggugugccacgcccugugcagccccgagggcugcuggggccccgagcccagagacugcgugagcugcagaaacgugagcagaggcagagagugcguggacaagugcaaccugcuggagggcgagcccagagaguucguggagaacagcgagugcauccagugccaccccgagugccugccccaggccaugaacaucaccugcaccggcagaggccccgacaacugcauccagugcgcccacuacaucgacggcccccacugcgugaagaccugccccgccggcgugaugggcgagaacaacacccugguguggaaguacgccgacgccggccacgugugccaccugugccaccccaacugcaccuacggcugcaccggccccggccuggagggcugccccaccaacggccccaagauccccagcaucgccaccggcauggugggcgcccugcugcugcugcuggugguggcccugggcaucggccuguucaugagaagaagacacaucgugagaaagagaacccugagaagacugcugcaggagagagagcugguggagccccugacccccagcggcgaggcccccaaccaggcccugcugagaauccugaaggagaccgaguucaagaagaucaaggugcugggcagcggcgccuucggcaccguguacaagggccuguggauccccgagggcgagaaggugaagauccccguggccaucaaggagcugagagaggccaccagccccaaggccaacaaggagauccuggacgaggccuacgugauggccagcguggacaacccccacgugugcagacugcugggcaucugccugaccagcaccgugcagcugaucacccagcugaugcccuucggcugccugcuggacuacgugagagagcacaaggacaacaucggcagccaguaccugcugaacuggugcgugcagaucgccaagggcaugaacuaccuggaggacagaagacuggugcacagagaccuggccgccagaaacgugcuggugaagaccccccagcacgugaagaucaccgacuucggccuggccaagcugcugggcgccgaggagaaggaguaccacgccgagggcggcaaggugcccaucaaguggauggcccuggagagcauccugcacagaaucuacacccaccagagcgacguguggagcuacggcgugaccgugugggagcugaugaccuucggcagcaagcccuacgacggcauccccgccagcgagaucagcagcauccuggagaagggcgagagacugccccagccccccaucugcaccaucgacguguacaugaucauggugaagugcuggaugaucgacgccgacagcagacccaaguucagagagcugaucaucgaguucagcaagauggccagagacccccagagauaccuggugauccagggcgacgagagaaugcaccugcccagccccaccgacagcaacuucuacagagcccugauggacgaggaggacauggacgacgugguggacgccgacgaguaccugaucccccagcagggcuucuucagcagccccagcaccagcagaaccccccugcugagcagccugagcgccaccagcaacaacagcaccguggccugcaucgacagaaacggccugcagagcugccccaucaaggaggacagcuuccugcagagauacagcagcgaccccaccggcgcccugaccgaggacagcaucgacgacaccuuccugcccgugcccggcgaguggcugguguggaagcagagcugcagcagcaccagcagcacccacagcgccgccgccagccugcagugccccagccaggugcugccccccgccagccccgagggcgagaccguggccgaccugcagacccaguga

SEQ ID NO: 1356 - RNA, 3411 nt, Artificial Sequence
  derived and/or modified sequence opt5 from EGFR__Homo_sapiens__ADL28125
augagacccagcggcaccgccggggcugcccugcucgcgcugcuugcugcccugugcccugccucccgggcucucgaggaaaagaaagugugucagggaacaucuaacaagcugacgcaacuuggcaccuucgaggaccacuuucugagccuccagcgcauguucaauaacugcgaagucguucuggggaaucuggagaucacauacgugcagagaaacuaugaucucuccuuucugaaaaccauucaggaaguggccggauacguccuuaucgcucugaauacaguggagcggauuccgcucgagaaccugcaaaucauucgcggcaauauguauuacgaaaacucuuaugcccuugcgguucugagcaauuacgacgccaacaagaccgggcucaaagagcugcccaugagaaaucugcaggaaauccuccauggagcugugcgguucuccaacaauccugcccuguguaacgucgagucuauccaguggcgcgauauugugagcuccgacuuucuuagcaauaugucuauggauuuccagaaccaccugggcuccugccaaaagugugaccccagcugcccuaacggcucuuguuggggagcuggggaggaaaauugccagaagcucacaaaaaucauuugugcccagcagugcuccggcagaugucggggaaagagccccucugauugcugccauaaccaaugugcggccgggugcaccggcccucgcgaguccgacugucugguuugcagaaaauuucgggaugaagcuacguguaaggauaccugcccgccccuuaugcuguauaauccuacaaccuaccagauggacgugaaccccgaggggaaauacagcuucggagccacaugugucaagaagugcccucgcaauuauguggugaccgaccacggcuccugugucagagcuugcggcgccgauucuuacgaaauggaggaggacgggguucggaaauguaagaaaugcgaaggacccugccgcaagguguguaacggcaucgggauuggagaguuuaaagacagccucuccaucaaugccacgaacauuaagcauuucaaaaauugcacaagcaucucuggcgaucugcacauccugccgguggcuuuuagaggggacuccuucacccacacaccuccccucgauccucaggaacuggacauucuuaagaccgucaaggagaucaccggauuucugcucauucaagcguggcccgaaaaccggacagaucugcaugccuucgagaaucuugagaucauuagaggccgcacgaaacagcacggccaguucagccuggcugugguuucucucaacaucaccagccuggggcugcggucccucaaggaaaucucugacggagaugugauuaucagcggcaauaaaaaccuguguuaugccaauacaauuaacuggaagaaacuuuuugggaccuccggacagaagacaaagaucauuagcaacagaggcgaaaauucuugcaaagccaccgggcaagucugucaugcucugugcucccccgaaggcuguuggggaccugagccgcgcgacugcgugagcugucggaacguuucuagaggccgcgaaugcguggauaaguguaaucuccuggagggggagccccgggaguucgucgagaacuccgaaugcauccagugccacccugagugucugccccaggccaugaauaucacgugcacaggaagaggcccugacaacuguauucagugcgcgcacuacaucgaugggccccauugugugaaaaccugcccggcuggagucaugggcgagaauaacacccuuguguggaaguaugccgacgccgggcacguuugucaucucugccacccuaauuguacauacggcugcaccggacccggccuggaaggguguccuacaaacggacccaaaauuccuagcaucgcuacgggcauggugggggcccugcuccugcuucuggucguggcucucggaauuggccuguuuaugcgccggagacauaucguucgcaagcggacccugagacggcuucuccaagagcgcgaacugguggagccccugacaccguccggggaagccccuaaucaggcgcuccugcggauucuuaaggagaccgaguucaaaaagaucaaaguccugggcucuggagccuuuggcacaguguauaaggggcucuggauccccgaaggagagaaagugaagauucccguugcuaucaaggaacugagagaggccaccagcccuaaagcuaacaaggaaauucuggacgaggccuacgucauggcguccguggauaauccgcacgugugcagacuucucggcaucugccugacgucuaccguccagcugauuacacagcucaugcccuucgggugucugcuugacuacgugcgcgagcacaaagauaacaucggaagccaauaucugcucaauuggugcguucagaucgccaagggcaugaacuaccuggaagaccggagacuggugcaucgcgaucuugcugccagaaacguccucgugaaaaccccucagcacguuaagauuacagacuuugggcuggcuaaacugcucggcgccgaggaaaaggaguaucaugccgaaggaggcaaggugcccaucaaauggauggcucuggaguccauucuucaccggaucuacacccaccagagcgaugucuggucuuauggggugacgguuugggagcugaugacauucggauccaagccuuacgacggcauucccgcgagcgaaaucucuuccauccucgagaaaggggaacgccugccucaacccccgauuuguaccaucgauguguauaugauuauggucaagugcuggaugaucgacgccgauagcagaccuaaauuucgggagcugauuaucgaguucucuaagauggcucgcgacccccagagauaccuugugauccagggagaugaacggaugcaucugccuagccccacagacuccaauuuuuaccgcgcccucauggacgaggaagauauggacgauguggucgacgccgaugaguaucugauuccgcaacagggcuucuuuagcucuccuuccaccagcagaacaccccuccuguccucucuuagcgcuaccuccaacaauucuacgguugccuguaucgaccggaacggccugcagagcugcccuauuaaggaagauuccuuccuccagcgcuacucuagcgaccccaccggggcgcugacagaggauuccaucgacgauaccuuccugcccgugccuggagaguggcuuguguggaaacaaagcuguucuuccacaagcucuacccacuccgcugccgccagccugcagugcccgucucagguccugcccccugcuucccccgaaggcgagacgguggccgaccuccagacacaauga

SEQ ID NO: 1357 - protein, 49 aa, Artificial Sequence
  EGFR__Homo_sapiens__L0R6G1
MCATCAIQTAPTGPNKSSLSDFSLPLKLHFLSTISISPFASNKVLTLFI

SEQ ID NO: 1358 - RNA, 150 nt, Artificial Sequence
  EGFR__Homo_sapiens__CCO13722
augugugccaccugugccauccaaacugcaccuacggguccuaauaaaucuucacugucugacuuuagucucccacuaaaacugcauuuccuuucuacaauuucaauuucucccuuugcuucaaauaaaguccugacacuauucauuuga

SEQ ID NO: 1359 - RNA, 150 nt, Artificial Sequence
  derived and/or modified sequence opt1 from EGFR__Homo_sapiens__CCO13722
augugcgcgaccugcgccauccagaccgcccccacgggcccgaacaagagcucccugagcgacuucucccucccccugaagcugcacuuccucagcaccaucuccaucagccccuucgccuccaacaaggugcugacccuguucaucuga

SEQ ID NO: 1360 - RNA, 150 nt, Artificial Sequence
  derived and/or modified sequence opt2 from EGFR__Homo_sapiens__CCO13722
augugcgccaccugcgccauccagaccgcccccaccggccccaacaaguccucccucuccgacuucucccucccccucaagcuccacuuccucuccaccaucuccaucucccccuucgccuccaacaagguccucacccucuucaucuga

SEQ ID NO: 1361 - RNA, 150 nt, Artificial Sequence
  derived and/or modified sequence opt3 from EGFR__Homo_sapiens__CCO13722
augugcgccaccugugcuauccagacagcacccacuggcccuaacaagagcucccugucugacuucucacucccacuuaaacugcacuuuuugaguacgauuagcauauccccguucgccucuaauaagguguuaacccuguuuaucuga

SEQ ID NO: 1362 - RNA, 150 nt, Artificial Sequence
  derived and/or modified sequence opt4 from EGFR__Homo_sapiens__CCO13722
augugcgccaccugcgccauccagaccgcccccaccggccccaacaagagcagccugagcgacuucagccugccccugaagcugcacuuccugagcaccaucagcaucagccccuucgccagcaacaaggugcugacccuguucaucuga

SEQ ID NO: 1363 - RNA, 150 nt, Artificial Sequence
  derived and/or modified sequence opt5 from EGFR__Homo_sapiens__CCO13722
augugcgccaccugugcuauccagacagcccccacgggcccuaacaagagcucccugucugacuucagccucccgcugaaacuucacuuucuguccaccauuucuaucagccccuucgcguccaauaaggugcucacacuguuuauuuga

SEQ ID NO: 1364 - protein, 405 aa, Artificial Sequence
  EGFR__Homo_sapiens__P00533-2
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 1365 - RNA, 1218 nt, Artificial Sequence
  EGFR__Homo_sapiens__CCDS47587.1
augcgacccuccgggacggccggggcagcgcuccuggcgcugcuggcugcgcucugcccggcgagucgggcucuggaggaaaagaaaguuugccaaggcacgaguaacaagcucacgcaguugggcacuuuugaagaucauuuucucagccuccagaggauguucaauaacugugaggugguccuugggaauuuggaaauuaccuaugugcagaggaauuaugaucuuuccuucuuaaagaccauccaggagguggcugguuauguccucauugcccucaacacaguggagcgaauuccuuuggaaaaccugcagaucaucagaggaaauauguacuacgaaaauuccuaugccuuagcagucuuaucuaacuaugaugcaaauaaaaccggacugaaggagcugcccaugagaaauuuacaggaaauccugcauggcgccgugcgguucagcaacaacccugcccugugcaacguggagagcauccaguggcgggacauagucagcagugacuuucucagcaacaugucgauggacuuccagaaccaccugggcagcugccaaaagugugauccaagcugucccaaugggagcugcuggggugcaggagaggagaacugccagaaacugaccaaaaucaucugugcccagcagugcuccgggcgcugccguggcaagucccccagugacugcugccacaaccagugugcugcaggcugcacaggcccccgggagagcgacugccuggucugccgcaaauuccgagacgaagccacgugcaaggacaccugccccccacucaugcucuacaaccccaccacguaccagauggaugugaaccccgagggcaaauacagcuuuggugccaccugcgugaagaaguguccccguaauuauguggugacagaucacggcucgugcguccgagccuguggggccgacagcuaugagauggaggaagacggcguccgcaaguguaagaagugcgaagggccuugccgcaaaguguguaacggaauagguauuggugaauuuaaagacucacucuccauaaaugcuacgaauauuaaacacuucaaaaacugcaccuccaucaguggcgaucuccacauccugccgguggcauuuaggggugacuccuucacacauacuccuccucuggauccacaggaacuggauauucugaaaaccguaaaggaaaucacagguuugagcuga

SEQ ID NO: 1366 - RNA, 1218 nt, Artificial Sequence
  derived and/or modified sequence opt1 from EGFR__Homo_sapiens__CCDS47587.1
augcgccccagcggcaccgccggggccgcgcugcucgcccugcuggccgcccucugcccggccucccgggcgcuggaggagaagaaggugugccagggcaccagcaacaagcugacccagcucgggaccuucgaggaccacuuccugucccugcagcgcauguucaacaacugcgaggucgugcucggcaaccuggagaucaccuacgugcagcggaacuacgaccugagcuuccucaagaccauccaggaggucgccggguacgugcugaucgcccugaacacgguggagcgcaucccccucgagaaccugcagaucauccggggcaacauguacuacgagaacuccuacgcccuggcgguccucagcaacuacgacgccaacaagaccggccugaaggagcugcccaugcgcaaccuccaggagauccugcacggggccgugcgguucuccaacaaccccgcccugugcaacguggagagcauccaguggcgcgacaucgucuccagcgacuuccucuccaacaugagcauggacuuccagaaccaccugggcuccugccagaagugcgacccgagcugccccaacggguccugcuggggcgccggggaggagaacugccagaagcugaccaagaucaucugcgcgcagcagugcagcggccggugccgcggcaagucccccagcgacugcugccacaaccagugcgccgccgggugcaccggcccccgggaguccgacugccucgugugccgcaaguuccgggacgaggccacgugcaaggacacgugcccgccccugaugcuguacaaccccaccaccuaccagauggacgugaaccccgaggggaaguacagcuucggcgcgaccugcgucaagaagugcccgcgcaacuacguggugaccgaccacggcagcugcguccgggccugcggggccgacuccuacgagauggaggaggacggcgugcgcaagugcaagaagugcgaggggcccugccggaaggugugcaacggcaucgggaucggcgaguucaaggacagccucuccaucaacgccaccaacaucaagcacuucaagaacugcaccagcaucuccggcgaccugcacauccugcccgucgccuuccgcggggacagcuucacgcacacgcccccgcucgacccccaggagcuggacauccugaagaccgugaaggagaucaccggccucuccuga

SEQ ID NO: 1367 - RNA, 1218 nt, Artificial Sequence
  derived and/or modified sequence opt2 from EGFR__Homo_sapiens__CCDS47587.1
augcgccccuccggcaccgccggcgccgcccuccucgcccuccucgccgcccucugccccgccucccgcgcccucgaggagaagaaggucugccagggcaccuccaacaagcucacccagcucggcaccuucgaggaccacuuccucucccuccagcgcauguucaacaacugcgaggucguccucggcaaccucgagaucaccuacguccagcgcaacuacgaccucuccuuccucaagaccauccaggaggucgccggcuacguccucaucgcccucaacaccgucgagcgcaucccccucgagaaccuccagaucauccgcggcaacauguacuacgagaacuccuacgcccucgccguccucuccaacuacgacgccaacaagaccggccucaaggagcuccccaugcgcaaccuccaggagauccuccacggcgccguccgcuucuccaacaaccccgcccucugcaacgucgaguccauccaguggcgcgacaucgucuccuccgacuuccucuccaacauguccauggacuuccagaaccaccucggcuccugccagaagugcgaccccuccugccccaacggcuccugcuggggcgccggcgaggagaacugccagaagcucaccaagaucaucugcgcccagcagugcuccggccgcugccgcggcaagucccccuccgacugcugccacaaccagugcgccgccggcugcaccggcccccgcgaguccgacugccucgucugccgcaaguuccgcgacgaggccaccugcaaggacaccugccccccccucaugcucuacaaccccaccaccuaccagauggacgucaaccccgagggcaaguacuccuucggcgccaccugcgucaagaagugcccccgcaacuacgucgucaccgaccacggcuccugcguccgcgccugcggcgccgacuccuacgagauggaggaggacggcguccgcaagugcaagaagugcgagggccccugccgcaaggucugcaacggcaucggcaucggcgaguucaaggacucccucuccaucaacgccaccaacaucaagcacuucaagaacugcaccuccaucuccggcgaccuccacauccuccccgucgccuuccgcggcgacuccuucacccacacccccccccucgacccccaggagcucgacauccucaagaccgucaaggagaucaccggccucuccuga

SEQ ID NO: 1368 - RNA, 1218 nt, Artificial Sequence
  derived and/or modified sequence opt3 from EGFR__Homo_sapiens__CCDS47587.1
augagacccagcggcaccgccggggcugcacugcucgcccuucuggcggcuuugugcccugccuccagggcauuagaggaaaagaaagugugucagggaacaucuaacaagcugacucaacuagguacguucgaggaccacuuucucucacugcagcggauguucaauaacugcgaagucguucuuggcaaucuggagaucaccuacgugcagcgcaacuaugauuugaguuuucucaaaacaauucaggaaguagccggguacgugcugauagcucugaauacugucgagcgaaucccacucgagaacuuacaaauuauccguggaaauauguauuacgaaaacagcuaugcacuggccgugcuuuccaauuacgacgcuaacaagaccggcuugaaagagcugccgaugagaaaucuacaggaaauucuccauggugccguuagguucucuaacaaucccgcgcuguguaacguggagucgauccaguggcgggauauagucucaagcgacuuucuuaguaauauguccauggauuuccagaaccaccuggggucuugccaaaagugugacccuagcugcccaaacggauccuguuggggcgcaggcgaggaaaauugccagaaguugacaaaaaucauuugugcccagcagugcucagggcgcuguagaggaaagagucccagcgauugcugccauaaccaaugugcugccgguugcaccggcccuagggagucugacugucucgugugccggaaauuucgcgaugaagcaacuuguaaggacacaugcccaccccugauguuauauaauccuaccacguaccagauggauguaaacccagaggggaaauacuccuucggagcuacuuguguuaagaagugcccgcgaaauuauguggucaccgaccacggcucaugugugagagccugcggugcggauagcuacgaaauggaggaggacggggugaggaaauguaagaaaugcgaaggacccugccggaaggucuguaacggcaucggcauuggggaguuuaaagacagucugucuaucaaugccacaaacauaaagcauuucaaaaauugcacuuccauuagcggagaucuccacauccuuccuguugcauuucguggugacucguucacccacacaccaccccuggauccucaggaauuggacauucuaaagaccgugaaggagaucacgggccugucuuga

SEQ ID NO: 1369 - RNA, 1218 nt, Artificial Sequence
  derived and/or modified sequence opt4 from EGFR__Homo_sapiens__CCDS47587.1
augagacccagcggcaccgccggcgccgcccugcuggcccugcuggccgcccugugccccgccagcagagcccuggaggagaagaaggugugccagggcaccagcaacaagcugacccagcugggcaccuucgaggaccacuuccugagccugcagagaauguucaacaacugcgagguggugcugggcaaccuggagaucaccuacgugcagagaaacuacgaccugagcuuccugaagaccauccaggagguggccggcuacgugcugaucgcccugaacaccguggagagaaucccccuggagaaccugcagaucaucagaggcaacauguacuacgagaacagcuacgcccuggccgugcugagcaacuacgacgccaacaagaccggccugaaggagcugcccaugagaaaccugcaggagauccugcacggcgccgugagauucagcaacaaccccgcccugugcaacguggagagcauccaguggagagacaucgugagcagcgacuuccugagcaacaugagcauggacuuccagaaccaccugggcagcugccagaagugcgaccccagcugccccaacggcagcugcuggggcgccggcgaggagaacugccagaagcugaccaagaucaucugcgcccagcagugcagcggcagaugcagaggcaagagccccagcgacugcugccacaaccagugcgccgccggcugcaccggccccagagagagcgacugccuggugugcagaaaguucagagacgaggccaccugcaaggacaccugccccccccugaugcuguacaaccccaccaccuaccagauggacgugaaccccgagggcaaguacagcuucggcgccaccugcgugaagaagugccccagaaacuacguggugaccgaccacggcagcugcgugagagccugcggcgccgacagcuacgagauggaggaggacggcgugagaaagugcaagaagugcgagggccccugcagaaaggugugcaacggcaucggcaucggcgaguucaaggacagccugagcaucaacgccaccaacaucaagcacuucaagaacugcaccagcaucagcggcgaccugcacauccugcccguggccuucagaggcgacagcuucacccacacccccccccuggacccccaggagcuggacauccugaagaccgugaaggagaucaccggccugagcuga

SEQ ID NO: 1370 - RNA, 1218 nt, Artificial Sequence
  derived and/or modified sequence opt5 from EGFR__Homo_sapiens__CCDS47587.1
augagacccagcggcaccgccggggcugcccugcucgcgcugcuugcugcccugugcccugccucccgggcucucgaggaaaagaaagugugucagggaacaucuaacaagcugacgcaacuuggcaccuucgaggaccacuuucugagccuccagcgcauguucaauaacugcgaagucguucuggggaaucuggagaucacauacgugcagagaaacuaugaucucuccuuucugaaaaccauucaggaaguggccggauacguccuuaucgcucugaauacaguggagcggauuccgcucgagaaccugcaaaucauucgcggcaauauguauuacgaaaacucuuaugcccuugcgguucugagcaauuacgacgccaacaagaccgggcucaaagagcugcccaugagaaaucugcaggaaauccuccauggagcugugcgguucuccaacaauccugcccuguguaacgucgagucuauccaguggcgcgauauugugagcuccgacuuucuuagcaauaugucuauggauuuccagaaccaccugggcuccugccaaaagugugaccccagcugcccuaacggcucuuguuggggagcuggggaggaaaauugccagaagcucacaaaaaucauuugugcccagcagugcuccggcagaugucggggaaagagccccucugauugcugccauaaccaaugugcggccgggugcaccggcccucgcgaguccgacugucugguuugcagaaaauuucgggaugaagcuacguguaaggauaccugcccgccccuuaugcuguauaauccuacaaccuaccagauggacgugaaccccgaggggaaauacagcuucggagccacaugugucaagaagugcccucgcaauuauguggugaccgaccacggcuccugugucagagcuugcggcgccgauucuuacgaaauggaggaggacgggguucggaaauguaagaaaugcgaaggacccugccgcaagguguguaacggcaucgggauuggagaguuuaaagacagccucuccaucaaugccacgaacauuaagcauuucaaaaauugcacaagcaucucuggcgaucugcacauccugccgguggcuuuuagaggggacuccuucacccacacaccuccccucgauccucaggaacuggacauucuuaagaccgucaaggagaucaccggacugagcuga

SEQ ID NO: 1371 - protein, 1210 aa, Artificial Sequence [sequence omitted]

SEQ ID NO: 1372 - RNA, 3633 nt, Artificial Sequence
  EGFR__Homo_sapiens__AAG35789
augcgacccuccgggacggccggggcagcgcuccuggcgcugcuggcugcgcucugcccggcgagucgggcucuggaggaaaagaaaguuugccaaggcacgaguaacaagcucacgcaguugggcacuuuugaagaucauuuucucagccuccagaggauguucaauaacugugaggugguccuugggaauuuggaaauuaccuaugugcagaggaauuaugaucuuuccuucuuaaagaccauccaggagguggcugguuauguccucauugcccucaacacaguggagcgaauuccuuuggaaaaccugcagaucaucagaggaaauauguacuacgaaaauuccuaugccuuagcagucuuaucuaacuaugaugcaaauaaaaccggacugaaggagcugcccaugagaaauuuacaggaaauccugcauggcgccgugcgguucagcaacaacccugcccugugcaacguggagagcauccaguggcgggacauagucagcagugacuuucucagcaacaugucgauggacuuccagaaccaccugggcagcugccaaaagugugauccaagcugucccaaugggagcugcuggggugcaggagaggagaacugccagaaacugaccaaaaucaucugugcccagcagugcuccgggcgcugccguggcaagucccccagugacugcugccacaaccagugugcugcaggcugcacaggcccccgggagagcgacugccuggucugccgcaaauuccgagacgaagccacgugcaaggacaccugccccccacucaugcucuacaaccccaccacguaccagauggaugugaaccccgagggcaaauacagcuuuggugccaccugcgugaagaaguguccccguaauuauguggugacagaucacggcucgugcguccgagccuguggggccgacagcuaugagauggaggaagacggcguccgcaaguguaagaagugcgaagggccuugccgcaaaguguguaacggaauagguauuggugaauuuaaagacucacucuccauaaaugcuacgaauauuaaacacuucaaaaacugcaccuccaucaguggcgaucuccacauccugccgguggcauuuaggggugacuccuucacacauacuccuccucuggauccacaggaacuggauauucugaaaaccguaaaggaaaucacaggguuuuugcugauucaggcuuggccugaaaacaggacggaccuccaugccuuugagaaccuagaaaucauacgcggcaggaccaagcaacauggucaguuuucucuugcagucgucagccugaacauaacauccuugggauuacgcucccucaaggagauaagugauggagaugugauaauuucaggaaacaaaaauuugugcuaugcaaauacaauaaacuggaaaaaacuguuugggaccuccggucagaaaaccaaaauuauaagcaacagaggugaaaacagcugcaaggccacaggccaggucugccaugccuugugcucccccgagggcugcuggggcccggagcccagggacugcgucucuugccggaaugucagccgaggcagggaaugcguggacaagugcaaccuucuggagggugagccaagggaguuuguggagaacucugagugcauacagugccacccagagugccugccucaggccaugaacaucaccugcacaggacggggaccagacaacuguauccagugugcccacuacauugacggcccccacugcgucaagaccugcccggcaggagucaugggagaaaacaacacccuggucuggaaguacgcagacgccggccaugugugccaccugugccauccaaacugcaccuacggaugcacugggccaggucuugaaggcuguccaacgaaugggccuaagaucccguccaucgccacugggauggugggggcccuccucuugcugcuggugguggcccuggggaucggccucuucaugcgaaggcgccacaucguucggaagcgcacgcugcggaggcugcugcaggagagggagcuuguggagccucuuacacccaguggagaagcucccaaccaagcucucuugaggaucuugaaggaaacugaauucaaaaagaucaaagugcugggcuccggugcguucggcacgguguauaagggacucuggaucccagaaggugagaaaguuaaaauucccgucgcuaucaaggaauuaagagaagcaacaucuccgaaagccaacaaggaaauccucgaugaagccuacgugauggccagcguggacaacccccacgugugccgccugcugggcaucugccucaccuccaccgugcagcucaucacgcagcucaugcccuucggcugccuccuggacuauguccgggaacacaaagacaauauuggcucccaguaccugcucaacuggugugugcagaucgcaaagggcaugaacuacuuggaggaccgucgcuuggugcaccgcgaccuggcagccaggaacguacuggugaaaacaccgcagcaugucaagaucacagauuuugggcuggccaaacugcugggugcggaagagaaagaauaccaugcagaaggaggcaaagugccuaucaaguggauggcauuggaaucaauuuuacacagaaucuauacccaccagagugaugucuggagcuacggggugaccguuugggaguugaugaccuuuggauccaagccauaugacggaaucccugccagcgagaucuccuccauccuggagaaaggagaacgccucccucagccacccauauguaccaucgaugucuacaugaucauggucaagugcuggaugauagacgcagauagucgcccaaaguuccgugaguugaucaucgaauucuccaaaauggcccgagacccccagcgcuaccuugucauucagggggaugaaagaaugcauuugccaaguccuacagacuccaacuucuaccgugcccugauggaugaagaagacauggacgacgugguggaugccgacgaguaccucaucccacagcagggcuucuucagcagccccuccacgucacggacuccccuccugagcucucugagugcaaccagcaacaauuccaccguggcuugcauugauagaaaugggcugcaaagcugucccaucaaggaagacagcuucuugcagcgauacagcucagaccccacaggcgccuugacugaggacagcauagacgacaccuuccucccagugccugaauacauaaaccaguccguucccaaaaggcccgcuggcucugugcagaauccugucuaucacaaucagccucugaaccccgcgcccagcagagacccacacuaccaggacccccacagcacugcagugggcaaccccgaguaucucaacacuguccagcccaccugugucaacagcacauucgacagcccugcccacugggcccagaaaggcagccaccaaauuagccuggacaacccugacuaccagcaggacuucuuucccaaggaagccaagccaaauggcaucuuuaagggcuccacagcugaaaaugcagaauaccuaagggucgcgccacaaagcagugaauuuauuggagcauga

SEQ ID NO: 1373 - RNA, 3633 nt, Artificial Sequence
  derived and/or modified sequence opt1 from EGFR__Homo_sapiens__AAG35789
augcgccccagcggcaccgccggggccgcccugcucgcccugcuggccgcccucugcccggccucccgggcgcuggaggagaagaaggugugccagggcaccagcaacaagcugacgcagcucgggaccuucgaggaccacuuccugucccugcagcgcauguucaacaacugcgaggucgugcucggcaaccuggagaucaccuacgugcagcggaacuacgaccugagcuuccucaagaccauccaggaggucgccggguacgugcugaucgcccugaacacgguggagcgcaucccccucgagaaccugcagaucauccggggcaacauguacuacgagaacuccuacgcccuggcgguccucagcaacuacgacgccaacaagaccggccugaaggagcugcccaugcgcaaccuccaggagauccugcacggggccgugcgguucuccaacaaccccgcccugugcaacguggagagcauccaguggcgcgacaucgucuccagcgacuuccucuccaacaugagcauggacuuccagaaccaccugggcuccugccagaagugcgacccgagcugccccaacggguccugcuggggcgccggggaggagaacugccagaagcugaccaagaucaucugcgcgcagcagugcagcggccggugccgcggcaagucccccagcgacugcugccacaaccagugcgccgccgggugcaccggcccccgggaguccgacugccucgugugccgcaaguuccgggacgaggccacgugcaaggacacgugcccgccccugaugcuguacaaccccaccaccuaccagauggacgugaaccccgaggggaaguacagcuucggcgcgaccugcgucaagaagugcccgcgcaacuacguggugaccgaccacggcagcugcguccgggccugcggggccgacuccuacgagauggaggaggacggcgugcgcaagugcaagaagugcgaggggcccugccggaaggugugcaacggcaucgggaucggcgaguucaaggacagccucuccaucaacgccaccaacaucaagcacuucaagaacugcaccagcaucuccggcgaccugcacauccugcccgucgccuuccgcggggacagcuucacgcacacgcccccgcucgacccccaggagcuggacauccugaagaccgugaaggagaucaccggcuuccuccugauccaggccuggcccgagaaccggaccgaccugcacgcguucgagaaccucgagaucauccgcgggcggaccaagcagcacggccaguucucccuggccguggucagccugaacaucaccucccucgggcugcgcagccugaaggagaucuccgacggcgacgugaucaucagcggcaacaagaaccucugcuacgccaacaccaucaacuggaagaagcuguucgggacguccggccagaagaccaagaucaucagcaaccgcggggagaacuccugcaaggccaccggccaggugugccacgcccugugcagccccgaggggugcuggggcccggagccccgggacugcgucuccugccgcaacgugagccggggccgcgagugcgucgacaagugcaaccuccuggagggggagccccgggaguucguggagaacuccgagugcauccagugccaccccgagugccugccgcaggcgaugaacaucacgugcaccggccgcgggcccgacaacugcauccagugcgcccacuacaucgacggcccccacugcgugaagaccugccccgccggcgucaugggggagaacaacacccugguguggaaguacgccgacgcgggccacgugugccaccucugccacccgaacugcaccuacgggugcacgggccccgggcuggagggcugccccaccaacggcccgaagauccccagcaucgccaccgggauggucggcgcccugcuccugcugcucgugguggcccuggggaucggccuguucaugcggcgccggcacaucguccgcaagcggacccuccgccggcugcugcaggagcgcgagcucguggagccccugacgcccagcggggaggccccgaaccaggcgcugcuccggauccugaaggagaccgaguucaagaagaucaaggugcugggcuccggcgccuucgggaccgucuacaagggccucuggauccccgagggggagaaggugaagauccccguggccaucaaggagcugcgcgaggccaccagccccaaggccaacaaggagauccuggacgaggcguacgucauggccuccguggacaacccgcacgugugccggcuccugggcaucugccugaccagcacgguccagcucaucacccagcugaugcccuucgggugccugcucgacuacgugcgcgagcacaaggacaacaucggcucccaguaccugcugaacuggugcgugcagaucgccaagggcaugaacuaccucgaggaccggcgccugguccaccgcgaccuggccgcccggaacgugcucgugaagacgccccagcacgucaagaucaccgacuucgggcuggcgaagcugcucggcgccgaggagaaggaguaccacgccgagggcgggaaggugcccaucaaguggauggcccuggagagcauccugcaccgcaucuacacccaccaguccgacguguggagcuacggggucaccgugugggagcucaugaccuucggcuccaagccguacgacggcauccccgcgagcgagaucuccagcauccuggagaagggggagcggcugccccagcccccgaucugcaccaucgacguguacaugaucauggucaagugcuggaugaucgacgccgacucccgccccaaguuccgggagcucaucaucgaguucagcaagauggcccgcgacccccagcgguaccuggugauccagggcgacgagcgcaugcaccuccccuccccgacggacagcaacuucuaccgggcccugauggacgaggaggacauggacgacguggucgacgccgacgaguaccugaucccccagcagggguucuucuccagccccagcaccucccgcacgccccugcucagcucccugagcgcgaccuccaacaacagcaccguggccugcaucgaccggaacggccugcaguccugcccgaucaaggaggacagcuuccuccagcgcuacuccagcgaccccaccggcgcccugaccgaggacuccaucgacgacaccuuccugcccgugccggaguacaucaaccagagcguccccaagcggcccgccggguccgugcagaaccccguguaccacaaccagccgcucaaccccgcccccagccgcgacccccacuaccaggacccgcacuccacggcggucggcaaccccgaguaccugaacaccgugcagccgaccugcgugaacagcaccuucgacucccccgcccacugggcccagaaggggagccaccagaucucccuggacaaccccgacuaccagcaggacuucuuccccaaggaggccaagcccaacggcaucuucaaggggagcacggccgagaacgcggaguaccuccgggucgcgccccagagcuccgaguucaucggcgccuga

SEQ ID NO: 1374 - RNA, 3633 nt, Artificial Sequence
  derived and/or modified sequence opt2 from EGFR__Homo_sapiens__AAG35789
augcgccccuccggcaccgccggcgccgcccuccucgcccuccucgccgcccucugccccgccucccgcgcccucgaggagaagaaggucugccagggcaccuccaacaagcucacccagcucggcaccuucgaggaccacuuccucucccuccagcgcauguucaacaacugcgaggucguccucggcaaccucgagaucaccuacguccagcgcaacuacgaccucuccuuccucaagaccauccaggaggucgccggcuacguccucaucgcccucaacaccgucgagcgcaucccccucgagaaccuccagaucauccgcggcaacauguacuacgagaacuccuacgcccucgccguccucuccaacuacgacgccaacaagaccggccucaaggagcuccccaugcgcaaccuccaggagauccuccacggcgccguccgcuucuccaacaaccccgcccucugcaacgucgaguccauccaguggcgcgacaucgucuccuccgacuuccucuccaacauguccauggacuuccagaaccaccucggcuccugccagaagugcgaccccuccugccccaacggcuccugcuggggcgccggcgaggagaacugccagaagcucaccaagaucaucugcgcccagcagugcuccggccgcugccgcggcaagucccccuccgacugcugccacaaccagugcgccgccggcugcaccggcccccgcgaguccgacugccucgucugccgcaaguuccgcgacgaggccaccugcaaggacaccugccccccccucaugcucuacaaccccaccaccuaccagauggacgucaaccccgagggcaaguacuccuucggcgccaccugcgucaagaagugcccccgcaacuacgucgucaccgaccacggcuccugcguccgcgccugcggcgccgacuccuacgagauggaggaggacggcguccgcaagugcaagaagugcgagggccccugccgcaaggucugcaacggcaucggcaucggcgaguucaaggacucccucuccaucaacgccaccaacaucaagcacuucaagaacugcaccuccaucuccggcgaccuccacauccuccccgucgccuuccgcggcgacuccuucacccacacccccccccucgacccccaggagcucgacauccucaagaccgucaaggagaucaccggcuuccuccucauccaggccuggcccgagaaccgcaccgaccuccacgccuucgagaaccucgagaucauccgcggccgcaccaagcagcacggccaguucucccucgccgucgucucccucaacaucaccucccucggccuccgcucccucaaggagaucuccgacggcgacgucaucaucuccggcaacaagaaccucugcuacgccaacaccaucaacuggaagaagcucuucggcaccuccggccagaagaccaagaucaucuccaaccgcggcgagaacuccugcaaggccaccggccaggucugccacgcccucugcucccccgagggcugcuggggccccgagccccgcgacugcgucuccugccgcaacgucucccgcggccgcgagugcgucgacaagugcaaccuccucgagggcgagccccgcgaguucgucgagaacuccgagugcauccagugccaccccgagugccucccccaggccaugaacaucaccugcaccggccgcggccccgacaacugcauccagugcgcccacuacaucgacggcccccacugcgucaagaccugccccgccggcgucaugggcgagaacaacacccucgucuggaaguacgccgacgccggccacgucugccaccucugccaccccaacugcaccuacggcugcaccggccccggccucgagggcugccccaccaacggccccaagauccccuccaucgccaccggcauggucggcgcccuccuccuccuccucgucgucgcccucggcaucggccucuucaugcgccgccgccacaucguccgcaagcgcacccuccgccgccuccuccaggagcgcgagcucgucgagccccucacccccuccggcgaggcccccaaccaggcccuccuccgcauccucaaggagaccgaguucaagaagaucaagguccucggcuccggcgccuucggcaccgucuacaagggccucuggauccccgagggcgagaaggucaagauccccgucgccaucaaggagcuccgcgaggccaccucccccaaggccaacaaggagauccucgacgaggccuacgucauggccuccgucgacaacccccacgucugccgccuccucggcaucugccucaccuccaccguccagcucaucacccagcucaugcccuucggcugccuccucgacuacguccgcgagcacaaggacaacaucggcucccaguaccuccucaacuggugcguccagaucgccaagggcaugaacuaccucgaggaccgccgccucguccaccgcgaccucgccgcccgcaacguccucgucaagaccccccagcacgucaagaucaccgacuucggccucgccaagcuccucggcgccgaggagaaggaguaccacgccgagggcggcaagguccccaucaaguggauggcccucgaguccauccuccaccgcaucuacacccaccaguccgacgucugguccuacggcgucaccgucugggagcucaugaccuucggcuccaagcccuacgacggcauccccgccuccgagaucuccuccauccucgagaagggcgagcgccucccccagccccccaucugcaccaucgacgucuacaugaucauggucaagugcuggaugaucgacgccgacucccgccccaaguuccgcgagcucaucaucgaguucuccaagauggcccgcgacccccagcgcuaccucgucauccagggcgacgagcgcaugcaccuccccucccccaccgacuccaacuucuaccgcgcccucauggacgaggaggacauggacgacgucgucgacgccgacgaguaccucaucccccagcagggcuucuucuccucccccuccaccucccgcaccccccuccucuccucccucuccgccaccuccaacaacuccaccgucgccugcaucgaccgcaacggccuccaguccugccccaucaaggaggacuccuuccuccagcgcuacuccuccgaccccaccggcgcccucaccgaggacuccaucgacgacaccuuccuccccguccccgaguacaucaaccaguccguccccaagcgccccgccggcuccguccagaaccccgucuaccacaaccagccccucaaccccgcccccucccgcgacccccacuaccaggacccccacuccaccgccgucggcaaccccgaguaccucaacaccguccagcccaccugcgucaacuccaccuucgacucccccgcccacugggcccagaagggcucccaccagaucucccucgacaaccccgacuaccagcaggacuucuuccccaaggaggccaagcccaacggcaucuucaagggcuccaccgccgagaacgccgaguaccuccgcgucgccccccaguccuccgaguucaucggcgccuga

SEQ ID NO: 1375 - RNA, 3633 nt, Artificial Sequence
  derived and/or modified sequence opt3 from EGFR__Homo_sapiens__AAG35789
augagacccagcggcaccgccggggcugcacugcucgcccuucuggcggcuuugugcccugccuccagggcauuagaggaaaagaaagugugucagggaacaucuaacaagcugacucaacuagguacguucgaggaccacuuucucucacugcagcggauguucaauaacugcgaagucguucuuggcaaucuggagaucaccuacgugcagcgcaacuaugauuugaguuuucucaaaacaauucaggaaguagccggguacgugcugauagcucugaauacugucgagcgaaucccacucgagaacuuacaaauuauccguggaaauauguauuacgaaaacagcuaugcacuggccgugcuuuccaauuacgacgcuaacaagaccggcuugaaagagcugccgaugagaaaucuacaggaaauucuccauggugccguuagguucucuaacaaucccgcgcuguguaacguggagucgauccaguggcgggauauagucucaagcgacuuucuuaguaauauguccauggauuuccagaaccaccuggggucuugccaaaagugugacccuagcugcccaaacggauccuguuggggcgcaggcgaggaaaauugccagaaguugacaaaaaucauuugugcccagcagugcucagggcgcuguagaggaaagagucccagcgauugcugccauaaccaaugugcugccgguugcaccggcccuagggagucugacugucucgugugccggaaauuucgcgaugaagcaacuuguaaggacacaugcccaccccugauguuauauaauccuaccacguaccagauggauguaaacccagaggggaaauacuccuucggagcuacuuguguuaagaagugcccgcgaaauuauguggucaccgaccacggcucaugugugagagccugcggugcggauagcuacgaaauggaggaggacggggugaggaaauguaagaaaugcgaaggacccugccggaaggucuguaacggcaucggcauuggggaguuuaaagacagucugucuaucaaugccacaaacauaaagcauuucaaaaauugcacuuccauuagcggagaucuccacauccuuccuguugcauuucguggugacucguucacccacacaccaccccuggauccucaggaauuggacauucuaaagaccgugaaggagaucacgggcuuucugcucauccaggcuuggccagaaaaccgcacugaucugcaugccuucgagaaucuugagauuauaagagggaggacaaaacaacacggacaguucucucuggcuguaguguccuugaacaucaccucacucggccugcggaguuuaaaggaaauuagcgacggugaugucaucauauccgggaauaaaaaccuguguuaugccaauacuauuaacuggaagaaacuauuuggcacaucuggacagaagaccaagaucaucagcaaccgaggcgaaaauucaugcaaagcaacggggcaagugugucaugcccucugcagucccgaaggauguugggguccggagccucgcgacugcguuuccuguagaaacgugagcaggggccgggaaugcgucgauaaguguaaucugcuugagggggagccccgcgaguucguggagaacucugaaugcauucagugccacccagaguguuugccucaggcuaugaauauuaccugcacaggaagaggccccgacaacuguauucagugcgcgcacuacauagaugguccacauuguguaaaaacuugccccgcagggguuaugggcgagaauaacacccugguguggaaguaugccgacgcuggacacgucugucaucucugccacccuaauuguacauacggcugcacugggccaggacuggaagguuguccgaccaacggccccaaaaucccuucaauugccacagggauggugggagcacuucuguugcuccuggucguggccuuaggcaucggucuguuuaugaggcgucggcauaucguucgaaagagaacccuaaggcgccuccugcaagagcgggaacuuguggagccauugacucccaguggggaagcuccuaaucaggcccugcucagaauccugaaggagacggaguucaaaaagauaaaaguauuaggcagcggagcauuuggcacagucuauaaggggcuguggaucccagaaggagagaaagugaagauucccguugcgaucaaggaacuuagggaggcuaccuccccgaaagccaacaaggaaauuuuggacgaggcauacgugauggccucugucgauaauccucacgugugccgccuccugggcaucugccuaacuucgaccguacagcugauaacacagcucaugccauucgguugucugcuugacuacgugcgagagcacaaagauaacaucgggagccaauauuugcugaauuggugcguucagauugcuaagggaaugaacuacuuagaagaccggcgucucguccauagagaucuggccgcaaggaacgugcuugugaaaacuccccagcacgucaagaucaccgacuuuggccuggcuaaauugcucggugccgaggaaaaggaguaucaugcggaaggcgggaagguuccuauuaaauggauggcccuggaguccauccuacaccgcauauacacacaccagucagauguguggaguuauggagugacgguaugggagcugaugaccuucggcucuaagcccuacgacgggauuccagcuagcgaaaucuccucaauucucgagaaaggagaacggcugccucaacccccaaucuguacuauagaugucuauaugaucauggugaagugcuggaugauugacgcagauagcagaccgaaauuuagggagcuuaucauugaguucucuaagauggcccgagacccucagcgcuacuugguuauccagggcgaugaacggaugcaucugcccuccccaacagacaguaauuuuuacagagcuuuaauggacgaggaagauauggacgauguggucgacgccgaugaguaucucauaccccaacaggguuucuuuagcucuccuuccaccucaaggacaccacugcuuaguagccugucggcaacuuccaacaauucuaccguggcguguauugaccguaacgggcuacagagcugccccaucaaggaagauucauuccuccagcgcuacaguuccgacccuacgggagcccugaccgaggauucuaucgacgauacauucuugccgguuccagaguauauuaaucaaagcgugcccaaacggccugcuggcuccguacagaacccagucuaccacaaucagccccugaacccugccccgucaagagacccccauuaucaggauccacacagcacugcaguggguaauccugaauacuuaaacaccgugcaacccacaugugucaauaguacuuuugacucuccagcucauugggcccagaagggcucccaccagaucagccucgacaacccugauuaucagcaagacuucuuucccaaagaggcaaagccaaaugggauuuucaaaggaucgaccgccgaaaacgcugaguaccugaggguugcgccgcagucaucugaauuuauaggcgccuga

SEQ ID NO: 1376 - RNA, 3633 nt, Artificial Sequence
  derived and/or modified sequence opt4 from EGFR__Homo_sapiens__AAG35789
augagacccagcggcaccgccggcgccgcccugcuggcccugcuggccgcccugugccccgccagcagagcccuggaggagaagaaggugugccagggcaccagcaacaagcugacccagcugggcaccuucgaggaccacuuccugagccugcagagaauguucaacaacugcgagguggugcugggcaaccuggagaucaccuacgugcagagaaacuacgaccugagcuuccugaagaccauccaggagguggccggcuacgugcugaucgcccugaacaccguggagagaaucccccuggagaaccugcagaucaucagaggcaacauguacuacgagaacagcuacgcccuggccgugcugagcaacuacgacgccaacaagaccggccugaaggagcugcccaugagaaaccugcaggagauccugcacggcgccgugagauucagcaacaaccccgcccugugcaacguggagagcauccaguggagagacaucgugagcagcgacuuccugagcaacaugagcauggacuuccagaaccaccugggcagcugccagaagugcgaccccagcugccccaacggcagcugcuggggcgccggcgaggagaacugccagaagcugaccaagaucaucugcgcccagcagugcagcggcagaugcagaggcaagagccccagcgacugcugccacaaccagugcgccgccggcugcaccggccccagagagagcgacugccuggugugcagaaaguucagagacgaggccaccugcaaggacaccugccccccccugaugcuguacaaccccaccaccuaccagauggacgugaaccccgagggcaaguacagcuucggcgccaccugcgugaagaagugccccagaaacuacguggugaccgaccacggcagcugcgugagagccugcggcgccgacagcuacgagauggaggaggacggcgugagaaagugcaagaagugcgagggccccugcagaaaggugugcaacggcaucggcaucggcgaguucaaggacagccugagcaucaacgccaccaacaucaagcacuucaagaacugcaccagcaucagcggcgaccugcacauccugcccguggccuucagaggcgacagcuucacccacacccccccccuggacccccaggagcuggacauccugaagaccgugaaggagaucaccggcuuccugcugauccaggccuggcccgagaacagaaccgaccugcacgccuucgagaaccuggagaucaucagaggcagaaccaagcagcacggccaguucagccuggccguggugagccugaacaucaccagccugggccugagaagccugaaggagaucagcgacggcgacgugaucaucagcggcaacaagaaccugugcuacgccaacaccaucaacuggaagaagcuguucggcaccagcggccagaagaccaagaucaucagcaacagaggcgagaacagcugcaaggccaccggccaggugugccacgcccugugcagccccgagggcugcuggggccccgagcccagagacugcgugagcugcagaaacgugagcagaggcagagagugcguggacaagugcaaccugcuggagggcgagcccagagaguucguggagaacagcgagugcauccagugccaccccgagugccugccccaggccaugaacaucaccugcaccggcagaggccccgacaacugcauccagugcgcccacuacaucgacggcccccacugcgugaagaccugccccgccggcgugaugggcgagaacaacacccugguguggaaguacgccgacgccggccacgugugccaccugugccaccccaacugcaccuacggcugcaccggccccggccuggagggcugccccaccaacggccccaagauccccagcaucgccaccggcauggugggcgcccugcugcugcugcuggugguggcccugggcaucggccuguucaugagaagaagacacaucgugagaaagagaacccugagaagacugcugcaggagagagagcugguggagccccugacccccagcggcgaggcccccaaccaggcccugcugagaauccugaaggagaccgaguucaagaagaucaaggugcugggcagcggcgccuucggcaccguguacaagggccuguggauccccgagggcgagaaggugaagauccccguggccaucaaggagcugagagaggccaccagccccaaggccaacaaggagauccuggacgaggccuacgugauggccagcguggacaacccccacgugugcagacugcugggcaucugccugaccagcaccgugcagcugaucacccagcugaugcccuucggcugccugcuggacuacgugagagagcacaaggacaacaucggcagccaguaccugcugaacuggugcgugcagaucgccaagggcaugaacuaccuggaggacagaagacuggugcacagagaccuggccgccagaaacgugcuggugaagaccccccagcacgugaagaucaccgacuucggccuggccaagcugcugggcgccgaggagaaggaguaccacgccgagggcggcaaggugcccaucaaguggauggcccuggagagcauccugcacagaaucuacacccaccagagcgacguguggagcuacggcgugaccgugugggagcugaugaccuucggcagcaagcccuacgacggcauccccgccagcgagaucagcagcauccuggagaagggcgagagacugccccagccccccaucugcaccaucgacguguacaugaucauggugaagugcuggaugaucgacgccgacagcagacccaaguucagagagcugaucaucgaguucagcaagauggccagagacccccagagauaccuggugauccagggcgacgagagaaugcaccugcccagccccaccgacagcaacuucuacagagcccugauggacgaggaggacauggacgacgugguggacgccgacgaguaccugaucccccagcagggcuucuucagcagccccagcaccagcagaaccccccugcugagcagccugagcgccaccagcaacaacagcaccguggccugcaucgacagaaacggccugcagagcugccccaucaaggaggacagcuuccugcagagauacagcagcgaccccaccggcgcccugaccgaggacagcaucgacgacaccuuccugcccgugcccgaguacaucaaccagagcgugcccaagagacccgccggcagcgugcagaaccccguguaccacaaccagccccugaaccccgcccccagcagagacccccacuaccaggacccccacagcaccgccgugggcaaccccgaguaccugaacaccgugcagcccaccugcgugaacagcaccuucgacagccccgcccacugggcccagaagggcagccaccagaucagccuggacaaccccgacuaccagcaggacuucuuccccaaggaggccaagcccaacggcaucuucaagggcagcaccgccgagaacgccgaguaccugagaguggccccccagagcagcgaguucaucggcgccuga

SEQ ID NO: 1377 - RNA, 3633 nt, Artificial Sequence
  derived and/or modified sequence opt5 from EGFR__Homo_sapiens__AAG35789
augagacccagcggcaccgccggggcugcccugcucgcgcugcuugcugcccugugcccugccucccgggcucucgaggaaaagaaagugugucagggaacaucuaacaagcugacgcaacuuggcaccuucgaggaccacuuucugagccuccagcgcauguucaauaacugcgaagucguucuggggaaucuggagaucacauacgugcagagaaacuaugaucucuccuuucugaaaaccauucaggaaguggccggauacguccuuaucgcucugaauacaguggagcggauuccgcucgagaaccugcaaaucauucgcggcaauauguauuacgaaaacucuuaugcccuugcgguucugagcaauuacgacgccaacaagaccgggcucaaagagcugcccaugagaaaucugcaggaaauccuccauggagcugugcgguucuccaacaauccugcccuguguaacgucgagucuauccaguggcgcgauauugugagcuccgacuuucuuagcaauaugucuauggauuuccagaaccaccugggcuccugccaaaagugugaccccagcugcccuaacggcucuuguuggggagcuggggaggaaaauugccagaagcucacaaaaaucauuugugcccagcagugcuccggcagaugucggggaaagagccccucugauugcugccauaaccaaugugcggccgggugcaccggcccucgcgaguccgacugucugguuugcagaaaauuucgggaugaagcuacguguaaggauaccugcccgccccuuaugcuguauaauccuacaaccuaccagauggacgugaaccccgaggggaaauacagcuucggagccacaugugucaagaagugcccucgcaauuauguggugaccgaccacggcuccugugucagagcuugcggcgccgauucuuacgaaauggaggaggacgggguucggaaauguaagaaaugcgaaggacccugccgcaagguguguaacggcaucgggauuggagaguuuaaagacagccucuccaucaaugccacgaacauuaagcauuucaaaaauugcacaagcaucucuggcgaucugcacauccugccgguggcuuuuagaggggacuccuucacccacacaccuccccucgauccucaggaacuggacauucuuaagaccgucaaggagaucaccggauuucugcucauucaagcguggcccgaaaaccggacagaucugcaugccuucgagaaucuugagaucauuagaggccgcacgaaacagcacggccaguucagccuggcugugguuucucucaacaucaccagccuggggcugcggucccucaaggaaaucucugacggagaugugauuaucagcggcaauaaaaaccuguguuaugccaauacaauuaacuggaagaaacuuuuugggaccuccggacagaagacaaagaucauuagcaacagaggcgaaaauucuugcaaagccaccgggcaagucugucaugcucugugcucccccgaaggcuguuggggaccugagccgcgcgacugcgugagcugucggaacguuucuagaggccgcgaaugcguggauaaguguaaucuccuggagggggagccccgggaguucgucgagaacuccgaaugcauccagugccacccugagugucugccccaggccaugaauaucacgugcacaggaagaggcccugacaacuguauucagugcgcgcacuacaucgaugggccccauugugugaaaaccugcccggcuggagucaugggcgagaauaacacccuuguguggaaguaugccgacgccgggcacguuugucaucucugccacccuaauuguacauacggcugcaccggacccggccuggaaggguguccuacaaacggacccaaaauuccuagcaucgcuacgggcauggugggggcccugcuccugcuucuggucguggcucucggaauuggccuguuuaugcgccggagacauaucguucgcaagcggacccugagacggcuucuccaagagcgcgaacugguggagccccugacaccguccggggaagccccuaaucaggcgcuccugcggauucuuaaggagaccgaguucaaaaagaucaaaguccugggcucuggagccuuuggcacaguguauaaggggcucuggauccccgaaggagagaaagugaagauucccguugcuaucaaggaacugagagaggccaccagcccuaaagcuaacaaggaaauucuggacgaggccuacgucauggcguccguggauaauccgcacgugugcagacuucucggcaucugccugacgucuaccguccagcugauuacacagcucaugcccuucgggugucugcuugacuacgugcgcgagcacaaagauaacaucggaagccaauaucugcucaauuggugcguucagaucgccaagggcaugaacuaccuggaagaccggagacuggugcaucgcgaucuugcugccagaaacguccucgugaaaaccccucagcacguuaagauuacagacuuugggcuggcuaaacugcucggcgccgaggaaaaggaguaucaugccgaaggaggcaaggugcccaucaaauggauggcucuggaguccauucuucaccggaucuacacccaccagagcgaugucuggucuuauggggugacgguuugggagcugaugacauucggauccaagccuuacgacggcauucccgcgagcgaaaucucuuccauccucgagaaaggggaacgccugccucaacccccgauuuguaccaucgauguguauaugauuauggucaagugcuggaugaucgacgccgauagcagaccuaaauuucgggagcugauuaucgaguucucuaagauggcucgcgacccccagagauaccuugugauccagggagaugaacggaugcaucugccuagccccacagacuccaauuuuuaccgcgcccucauggacgaggaagauauggacgauguggucgacgccgaugaguaucugauuccgcaacagggcuucuuuagcucuccuuccaccagcagaacaccccuccuguccucucuuagcgcuaccuccaacaauucuacgguugccuguaucgaccggaacggccugcagagcugcccuauuaaggaagauuccuuccuccagcgcuacucuagcgaccccaccggggcgcugacagaggauuccaucgacgauaccuuccugcccgugccugaguauauuaaucaaagcgugccgaaaagacccgcuggaucuguccagaacccuguguaccacaaucagccccuuaacccugcccccucccgggacccucauuaucaggauccgcacagcacagccguuggcaaucccgaauaccugaacaccgugcaaccuacgugugucaauucuacauuugacucccccgcucauugggcccagaaggggagccaccagaucucucucgacaacccugauuaucagcaagacuucuuucccaaagaggcgaagccgaauggaauuuucaaaggcuccaccgcugaaaacgccgaguaccugagaguggccccucagagcuccgaauuuaucggggcuuga

SEQ ID NO: 1378 - protein, 464 aa, Artificial Sequence [sequence omitted]

SEQ ID NO: 1379 - RNA, 1395 nt, Artificial Sequence
  EGFR__Homo_sapiens__AAI18666
auggcagcugaagacguuaucaucugugcccagcagugcuccgggcgcugccguggcaagucccccagugacugcugccacaaccagugugcugcaggcugcacaggcccccgggagagcgacugccuggucugccgcaaauuccgagacgaagccacgugcaaggacaccugccccccacucaugcucuacaaccccaccacguaccagauggaugugaaccccgagggcaaauacagcuuuggugccaccugcgugaagaaguguccccguaauuauguggugacagaucacggcucgugcguccgagccuguggggccgacagcuaugagauggaggaagacggcguccgcaaguguaagaagugcgaagggccuugccgcaaaguguguaacggaauagguauuggugaauuuaaagacucacucuccauaaaugcuacgaauauuaaacacuucaaaaacugcaccuccaucaguggcgaucuccacauccugccgguggcauuuaggggugacuccuucacacauacuccuccucuggauccacaggaacuggauauucugaaaaccguaaaggaaaucacaggguuuuugcugauucaggcuuggccugaaaacaggacggaccuccaugccuuugagaaccuagaaaucauacgcggcaggaccaagcaacauggucaguuuucucuugcagucgucagccugaacauaacauccuugggauuacgcucccucaaggagauaagugauggagaugugauaauuucaggaaacaaaaauuugugcuaugcaaauacaauaaacuggaaaaaacuguuugggaccuccggucagaaaaccaaaauuauaagcaacagaggugaaaacagcugcaaggccacaggccaggucugccaugccuugugcucccccgagggcugcuggggcccggagcccagggacugcgucucuugccggaaugucagccgaggcagggaaugcguggacaagugcaaccuucuggagggugagccaagggaguuuguggagaacucugagugcauacagugccacccagagugccugccucaggccaugaacaucaccugcacaggacggggaccagacaacuguauccagugugcccacuacauugacggcccccacugcgucaagaccugcccggcaggagucaugggagaaaacaacacccuggucuggaaguacgcagacgcuggccaugugugccaccugugccauccaaacugcaccuacggaugcacagggccaggucuugaaggcuguccaacgaaugggccuaagaucccguccaucgccacugggauggugggggcccuccucuugcugcuggugguggcccuggggaucgggccucuucauggaagauag

SEQ ID NO: 1380 - RNA, 1395 nt, Artificial Sequence
  derived and/or modified sequence opt1 from EGFR__Homo_sapiens__AAI18666
auggccgccgaggacgugaucaucugcgcgcagcagugcagcggccgcugccgggggaagucccccagcgacugcugccacaaccagugcgccgccggcugcaccgggccgcgcgaguccgacugccuggucugccggaaguuccgcgacgaggcgaccugcaaggacacgugcccgccccucaugcuguacaaccccaccaccuaccagauggacgugaaccccgagggcaaguacagcuucggggcgaccugcgugaagaagugcccccggaacuacgucgugacggaccacggcuccugcgugcgcgccugcggcgccgacagcuacgagauggaggaggacgggguccggaagugcaagaagugcgagggccccugccgcaaggugugcaacgggaucggcaucggggaguucaaggacucccugagcaucaacgccaccaacaucaagcacuucaagaacugcaccuccaucagcggcgaccuccacauccugcccguggccuuccggggcgacuccuucacccacacgccgccccuggacccccaggagcucgacauccugaagaccgucaaggagaucaccggguuccugcucauccaggccuggcccgagaaccgcaccgaccugcacgccuucgagaaccuggagaucauccggggccgcacgaagcagcacgggcaguucagccucgccguggugucccugaacaucaccagccugggccuccggucccugaaggagaucagcgacggcgacgucaucaucuccgggaacaagaaccugugcuacgccaacaccaucaacuggaagaagcuguucggcaccagcgggcagaagacgaagaucaucuccaaccgcggcgagaacagcugcaaggccaccggccaggugugccacgcgcucugcagcccggaggggugcuggggccccgagccccgggacugcguguccugccgcaacgucagccgggggcgcgagugcguggacaagugcaaccugcucgagggcgagccccgggaguucguggagaacuccgagugcauccagugccacccggagugccugccccaggccaugaacaucacgugcaccgggcgcggccccgacaacugcauccagugcgcccacuacaucgacgggccccacugcgucaagaccugcccggccggcgugaugggcgagaacaacacccugguguggaaguacgccgacgcggggcacgucugccaccucugccaccccaacugcaccuacggcugcaccgggcccggccuggaggggugccccacgaacggcccgaagauccccagcaucgccaccggcauggugggggcccugcuccugcugcucguggucgcccugggcaucgggccccugcacggccgguga

SEQ ID NO: 1381 - RNA, 1395 nt, Artificial Sequence
  derived and/or modified sequence opt2 from EGFR__Homo_sapiens__AAI18666
auggccgccgaggacgucaucaucugcgcccagcagugcuccggccgcugccgcggcaagucccccuccgacugcugccacaaccagugcgccgccggcugcaccggcccccgcgaguccgacugccucgucugccgcaaguuccgcgacgaggccaccugcaaggacaccugccccccccucaugcucuacaaccccaccaccuaccagauggacgucaaccccgagggcaaguacuccuucggcgccaccugcgucaagaagugcccccgcaacuacgucgucaccgaccacggcuccugcguccgcgccugcggcgccgacuccuacgagauggaggaggacggcguccgcaagugcaagaagugcgagggccccugccgcaaggucugcaacggcaucggcaucggcgaguucaaggacucccucuccaucaacgccaccaacaucaagcacuucaagaacugcaccuccaucuccggcgaccuccacauccuccccgucgccuuccgcggcgacuccuucacccacacccccccccucgacccccaggagcucgacauccucaagaccgucaaggagaucaccggcuuccuccucauccaggccuggcccgagaaccgcaccgaccuccacgccuucgagaaccucgagaucauccgcggccgcaccaagcagcacggccaguucucccucgccgucgucucccucaacaucaccucccucggccuccgcucccucaaggagaucuccgacggcgacgucaucaucuccggcaacaagaaccucugcuacgccaacaccaucaacuggaagaagcucuucggcaccuccggccagaagaccaagaucaucuccaaccgcggcgagaacuccugcaaggccaccggccaggucugccacgcccucugcucccccgagggcugcuggggccccgagccccgcgacugcgucuccugccgcaacgucucccgcggccgcgagugcgucgacaagugcaaccuccucgagggcgagccccgcgaguucgucgagaacuccgagugcauccagugccaccccgagugccucccccaggccaugaacaucaccugcaccggccgcggccccgacaacugcauccagugcgcccacuacaucgacggcccccacugcgucaagaccugccccgccggcgucaugggcgagaacaacacccucgucuggaaguacgccgacgccggccacgucugccaccucugccaccccaacugcaccuacggcugcaccggccccggccucgagggcugccccaccaacggccccaagauccccuccaucgccaccggcauggucggcgcccuccuccuccuccucgucgucgcccucggcaucggcccccuccacggccgcuga

SEQ ID NO: 1382 - RNA, 1395 nt, Artificial Sequence
  derived and/or modified sequence opt3 from EGFR__Homo_sapiens__AAI18666
auggccgcugaggacgugaucauuugcgcacagcaauguagcggcagaugcagggggaagucccccucugauuguugccacaaccagugugccgcgggaugcaccgguccucgggaaucagacugucuggucugccgcaaauuccgagaugaggcuacauguaaggacacuugcccaccgcucaugcuuuacaaucccacgaccuaucagauggauguuaacccugaaggcaaauacaguuuuggggccacaugugugaagaaaugcccacguaauuauguagugacugaccauggaagcugcgucagagcauguggcgccgauuccuacgagauggaagaggacggugugaggaagugcaagaaaugugaggggcccugccggaagguuuguaacggaauaggcaucggcgaguucaaagauucucugucgauuaaugcuaccaacaucaagcacuuuaaaaauugcacaucaauuagcggggacuugcauaucuuaccuguggcauuccgcggagauaguuuuacccacacuccaccccuggacccucaggaacuagauauacucaagacagucaaggaaaucaccgguuuccugcuuauucaagccuggccagagaacagaacggaccugcaugcuuuugagaauuuggaaaucauuaggggccggacuaaacagcacgggcaguucucccucgccgugguaucucugaacaucaccagccugggacuccgcuccuuaaaggagauaucagacggcgauguuauuaucagugguaauaaaaaccuguguuaugcgaauacaauuaacuggaagaaacuuuuugggacuagcggacagaagaccaaaaucaucucuaaucgaggcgaaaacuccugcaaggcaacaggccaagugugucacgccuugugcucaccggagggguguuggggacccgaaccuagagacugcgucagcugcaggaacgugagucggggucgugaguguguggauaagugcaaucugcuagagggcgaaccacgcgaguucgucgaaaacucugaguguauucagugccaucccgaaugucucccucaggcuaugaauauaaccugcacggggagaggaccagacaacuguauccagugcgcccacuacauugauggcccccauuguguuaaaacuugcccggcuggugugaugggggagaauaacacacugguauggaaguaugcagacgccggccacgugugucaccuuugccauccuaauugcaccuacggauguacuggccccgggcuggagggaugcccaacaaacgguccuaaaauccccuccauagcgaccggcauggucggggccuugcuccuguuacuggugguugcacucggaauuggcccacuucacgguagguga

SEQ ID NO: 1383 - RNA, 1395 nt, Artificial Sequence
  derived and/or modified sequence opt4 from EGFR__Homo_sapiens__AAI18666
auggccgccgaggacgugaucaucugcgcccagcagugcagcggcagaugcagaggcaagagccccagcgacugcugccacaaccagugcgccgccggcugcaccggccccagagagagcgacugccuggugugcagaaaguucagagacgaggccaccugcaaggacaccugccccccccugaugcuguacaaccccaccaccuaccagauggacgugaaccccgagggcaaguacagcuucggcgccaccugcgugaagaagugccccagaaacuacguggugaccgaccacggcagcugcgugagagccugcggcgccgacagcuacgagauggaggaggacggcgugagaaagugcaagaagugcgagggccccugcagaaaggugugcaacggcaucggcaucggcgaguucaaggacagccugagcaucaacgccaccaacaucaagcacuucaagaacugcaccagcaucagcggcgaccugcacauccugcccguggccuucagaggcgacagcuucacccacacccccccccuggacccccaggagcuggacauccugaagaccgugaaggagaucaccggcuuccugcugauccaggccuggcccgagaacagaaccgaccugcacgccuucgagaaccuggagaucaucagaggcagaaccaagcagcacggccaguucagccuggccguggugagccugaacaucaccagccugggccugagaagccugaaggagaucagcgacggcgacgugaucaucagcggcaacaagaaccugugcuacgccaacaccaucaacuggaagaagcuguucggcaccagcggccagaagaccaagaucaucagcaacagaggcgagaacagcugcaaggccaccggccaggugugccacgcccugugcagccccgagggcugcuggggccccgagcccagagacugcgugagcugcagaaacgugagcagaggcagagagugcguggacaagugcaaccugcuggagggcgagcccagagaguucguggagaacagcgagugcauccagugccaccccgagugccugccccaggccaugaacaucaccugcaccggcagaggccccgacaacugcauccagugcgcccacuacaucgacggcccccacugcgugaagaccugccccgccggcgugaugggcgagaacaacacccugguguggaaguacgccgacgccggccacgugugccaccugugccaccccaacugcaccuacggcugcaccggccccggccuggagggcugccccaccaacggccccaagauccccagcaucgccaccggcauggugggcgcccugcugcugcugcuggugguggcccugggcaucggcccccugcacggcagauga

SEQ ID NO: 1384 - RNA, 1395 nt, Artificial Sequence
  derived and/or modified sequence opt5 from EGFR__Homo_sapiens__AAI18666
auggccgcugaggacgugaucauuugcgcccagcaauguagcggcagaugccgggggaagucccccucugauuguugccacaaccagugugcggcuggaugcaccggcccucgcgaaagcgacugucuggucugcagaaaauuccgggaugaggccacauguaaggacacgugcccgccccucaugcuguacaauccuaccacauaucagauggauguuaaccccgaagggaaauacuccuuuggagccaccugugugaagaaaugcccucgcaauuauguggucacagaccauggcucuugcgugagagcuuguggggccgauagcuacgagauggaagaggacggaguucggaagugcaagaaaugugagggccccugccgcaagguguguaacggcaucgggauuggagaguucaaagauucccuuucuaucaaugcuaccaacauuaagcacuuuaaaaauugcacaagcaucuccggcgaccugcauauccucccugucgccuucagaggggauagcuuuacccacacgccgccccuggacccucaggaacuugauauucugaagaccgugaaggaaaucacaggauuccuccugauucaagcguggcccgagaaccggaccgaccugcaugccuuugagaaucucgaaaucauucgcggcagaacaaaacagcacgggcaguucucucuggcuguugugucccuuaacaucaccagccugggacuccggucucugaaggagauuuccgacggcgaugucaucaucagcggcaauaaaaaccuuuguuaugccaauacgauuaacuggaagaaacuguuugggacaucuggacagaagaccaaaaucauuuccaaucgcggcgaaaacagcugcaaggcuacagggcaagugugucacgcccucugcuccccugagggauguuggggccccgaaccgagagacugcgugucuugccggaacgucagccgcgggagagaguguguugauaagugcaaucugcuggagggagaaccucgggaguucguggaaaacuccgaguguauccagugccaucccgaaugucucccucaggcgaugaauauuaccugcaccggcagaggccccgacaacuguauccagugcgcccacuacaucgaugggccccauugugugaaaacaugcccugcuggagucaugggcgagaauaacacgcugguguggaaguaugccgacgcugggcacguuugucaccuuugccauccgaauugcaccuacggauguacaggccccgggcuggagggcugcccuaccaacggacccaaaauuccuagcaucgccacaggcauggugggggcccuccugcuucugcucgucguggcucugggaauuggcccccugcacgggcgcuga

SEQ ID NO: 1385 - protein, 1091 aa, Artificial Sequence
  EGFR__Homo_sapiens__Q504U8
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 1386 - RNA, 3276 nt, Artificial Sequence
  EGFR__Homo_sapiens__AAH94761
augcgacccuccgggacggccggggcagcgcuccuggcgcugcuggcugcgcucugcccggcgagucgggcucuggaggaaaagaaaguuugccaaggcacgaguaacaagcucacgcaguugggcacuuuugaagaucauuuucucagccuccagaggauguucaauaacugugaggugguccuugggaauuuggaaauuaccuaugugcagaggaauuaugaucuuuccuucuuaaagaccauccaggagguggcugguuauguccucauugcccucaacacaguggagcgaauuccuuuggaaaaccugcagaucaucagaggaaauauguacuacgaaaauuccuaugccuuagcagucuuaucuaacuaugaugcaaauaaaaccggacugaaggagcugcccaugagaaauuuacagggacaaaagugugauccaagcugucccaaugggagcugcuggggugcaggagaggagaacugccagaaacugaccaaaaucaucugugcccagcagugcuccgggcgcugccguggcaagucccccagugacugcugccacaaccagugugcugcaggcugcacaggcccccgggagagcgacugccuggucugccgcaaauuccgagacgaagccacgugcaaggacaccugccccccacucaugcucuacaaccccaccacguaccagauggaugugaaccccgagggcaaauacagcuuuggugccaccugcgugaagaaguguccccguaauuauguggugacagaucacggcucgugcguccgagccuguggggccgacagcuaugagauggaggaagacggcguccgcaaguguaagaagugcgaagggccuugccgcaaaguguguaacggaauagguauuggugaauuuaaagacucacucuccauaaaugcuacgaauauuaaacacuucaaaaacugcaccuccaucaguggcgaucuccacauccugccgguggcauuuaggggugacuccuucacacauacuccuccucuggauccacaggaacuggauauucugaaaaccguaaaggaaaucacaggguuuuugcugauucaggcuuggccugaaaacaggacggaccuccaugccuuugagaaccuagaaaucauacgcggcaggaccaagcaacauggucaguuuucucuugcagucgucagccugaacauaacauccuugggauuacgcucccucaaggagauaagugauggagaugugauaauuucaggaaacaaaaauuugugcuaugcaaauacaauaaacuggaaaaaacuguuugggaccuccggucagaaaaccaaaauuauaagcaacagaggugaaaacagcugcaaggccacaggccaggucugccaugccuugugcucccccgagggcugcuggggcccggagcccagggacugcgucucuugccggaaugucagccgaggcagggaaugcguggacaagugcaaccuucuggagggugagccaagggaguuuguggagaacucugagugcauacagugccacccagagugccugccucaggccaugaacaucaccugcacaggacggggaccagacaacuguauccagugugcccacuacauugacggcccccacugcgucaagaccugcccggcaggagucaugggagaaaacaacacccuggucuggaaguacgcagacgccggccaugugugccaccugugccauccaaacugcaccuacggaugcacugggccaggucuugaaggcuguccaacgaaugggccuaagaucccguccaucgccacugggauggugggggcccuccucuugcugcuggugguggcccuggggaucggccucuucaugcgaaggcgccacaucguucggaagcgcacgcugcggaggcugcugcaggagagggagcuuguggagccucuuacacccaguggagaagcucccaaccaagcucucuugaggaucuugaaggaaacugaauucaaaaagaucaaagugcugggcuccggugcguucggcacgguguauaagggacucuggaucccagaaggugagaaaguuaaaauucccgucgcuaucaaggaauuaagagaagcaacaucuccgaaagccaacaaggaaauccucgaugaagccuacgugauggccagcguggacaacccccacgugugccgccugcugggcaucugccucaccuccaccgugcagcucaucacgcagcucaugcccuucggcugccuccuggacuauguccgggaacacaaagacaauauuggcucccaguaccugcucaacuggugugugcagaucgcaaagggcaugaacuacuuggaggaccgucgcuuggugcaccgcgaccuggcagccaggaacguacuggugaaaacaccgcagcaugucaagaucacagauuuugggcuggccaaacugcugggugcggaagagaaagaauaccaugcagaaggaggcaaagugccuaucaaguggauggcauuggaaucaauuuuacacagaaucuauacccaccagagugaugucuggagcuacggggugaccguuugggaguugaugaccuuuggauccaagccauaugacggaaucccugccagcgagaucuccuccauccuggagaaaggagaacgccucccucagccacccauauguaccaucgaugucuacaugaucauggucaagugcuggaugauagacgcagauagucgcccaaaguuccgugaguugaucaucgaauucuccaaaauggcccgagacccccagcgcuaccuugucauucagggggaugaaagaaugcauuugccaaguccuacagacuccaacuucuaccgugcccugauggaugaagaagacauggacgacgugguggaugccgacgaguaccucaucccacagcagggcuucuucagcagccccuccacgucacggacuccccuccugagcucucugagugcaaccagcaacaauuccaccguggcuugcauugauagaaaugggcugcaaagcugucccaucaaggaagacagcuucuugcagcgauacagcucagaccccacaggcgccuugacugaggacagcauagacgacaccuuccucccagugccuggugaguggcuugucuggaaacaguccugcuccucaaccuccucgacccacucagcagcagccagucuccaguguccaagccaggugcucccuccagcaucuccagagggggaaacaguggcagauuugcagacacaguga

SEQ ID NO: 1387 - RNA, 3276 nt, Artificial Sequence
  derived and/or modified sequence opt1 from EGFR__Homo_sapiens__AAH94761
augcgccccagcggcaccgccggggccgcgcugcucgcccugcuggccgcccucugccccgccucccgggcgcuggaggagaagaaggugugccagggcaccagcaacaagcugacgcagcucgggaccuucgaggaccacuuccugucccugcagcgcauguucaacaacugcgaggucgugcucggcaaccuggagaucaccuacgugcagcggaacuacgaccugagcuuccucaagaccauccaggaggucgccggguacgugcugaucgcccugaacacgguggagcgcaucccccucgagaaccugcagaucauccggggcaacauguacuacgagaacuccuacgcccuggcgguccucagcaacuacgacgccaacaagaccggccugaaggagcugcccaugcgcaaccuccaggggcagaagugcgaccccuccugcccgaacggcagcugcuggggcgccggggaggagaacugccagaagcugaccaagaucaucugcgcccagcagugcuccgggcggugccgcggcaagagccccuccgacugcugccacaaccagugcgccgcgggcugcaccgggccccgggagagcgacugccuggugugccgcaaguuccgggacgaggccacgugcaaggacacgugcccgccccucaugcuguacaaccccaccaccuaccagauggacgugaaccccgagggcaaguacuccuucggggcgaccugcgucaagaagugcccccgcaacuacguggugaccgaccacggcagcugcguccgggccugcggcgccgacuccuacgagauggaggaggacggggugcgcaagugcaagaagugcgagggcccgugccggaaggugugcaacgggaucggcaucggggaguucaaggacagccuguccaucaacgccaccaacaucaagcacuucaagaacugcaccagcaucuccggcgaccuccacauccugcccgucgccuuccgcggcgacagcuucacgcacaccccgccccuggacccccaggagcucgacauccugaagaccgugaaggagaucaccggguuccugcucauccaggccuggcccgagaaccggacggaccugcacgccuucgagaaccuggagaucauccgcggccggaccaagcagcacgggcaguucagccucgccguggucucccugaacaucaccagccugggccuccgcucccugaaggagaucagcgacggggacgugaucaucuccggcaacaagaaccugugcuacgcgaacaccaucaacuggaagaagcuguucggcacgagcgggcagaagaccaagaucaucuccaaccggggcgagaacagcugcaaggccaccggccaggugugccacgcccugugcucccccgaggggugcugggggcccgagccgcgcgacugcgucagcugccgcaacgugucccggggccgcgagugcguggacaagugcaaccugcucgagggcgagccccgggaguucgucgagaacagcgagugcauccagugccaccccgagugccugccccaggccaugaacaucacgugcaccgggcgcggcccggacaacugcauccagugcgcccacuacaucgacgggccccacugcgugaagaccugccccgcgggcgucaugggcgagaacaacacccugguguggaaguacgccgacgccgggcacgugugccaccucugccaccccaacugcaccuacggcugcacggggccgggccuggaggggugccccaccaacggccccaagaucccguccaucgccaccggcauggucggggcgcugcugcuccugcuggugguggcccucggcaucgggcuguucaugcggcgccggcacaucguccgcaagcggacccugcgccggcuccugcaggagcgcgagcugguggagccccucacgcccagcggcgaggcccccaaccaggcccugcugcggauccucaaggagaccgaguucaagaagaucaaggugcugggguccggcgccuucggcaccgucuacaaggggcuguggaucccggagggcgagaaggugaagauccccguggcgaucaaggagcuccgcgaggccaccagccccaaggccaacaaggagauccuggacgaggccuacgucauggccuccguggacaacccccacgugugccggcugcucgggaucugccugaccagcacgguccagcugaucacccagcucaugccguucggcugccugcuggacuacgugcgcgagcacaaggacaacaucgggucccaguaccuccugaacuggugcgugcagaucgcgaagggcaugaacuaccuggaggaccggcgccucguccaccgggaccuggccgcccgcaacgugcuggugaagacgccccagcacgucaagaucaccgacuucggccucgccaagcugcugggggccgaggagaaggaguaccacgcggagggcgggaaggugcccaucaaguggauggcccucgagagcauccugcaccgcaucuacacccaccagagcgacgugugguccuacggcgucaccgugugggagcugaugaccuucgggagcaagcccuacgacggcaucccggccuccgagaucagcuccauccucgagaagggcgagcggcugccccagccgcccaucugcaccaucgacguguacaugaucauggucaagugcuggaugaucgacgccgacagccgccccaaguuccgggagcugaucaucgaguucuccaagauggcgcgcgacccccagcgguaccucgugauccagggggacgagcgcaugcaccuccccagccccacggacuccaacuucuaccgggcccugauggacgaggaggacauggacgacguggucgacgccgacgaguaccucaucccgcagcagggcuucuucagcucccccagcaccucccgcacgccccugcugagcucccucagcgccaccuccaacaacagcaccguggccugcaucgaccggaacgggcugcagagcugccccaucaaggaggacuccuuccugcagcgcuacagcuccgacccgaccggcgcgcucaccgaggacagcaucgacgacaccuuccugcccgugcccggcgaguggcuggucuggaagcaguccugcagcuccacgagcuccacccacagcgccgccgccucccuccagugcccgagccaggugcugccgcccgccucccccgagggggagaccguggcggaccugcagacccaguga

SEQ ID NO: 1388 - RNA, 3276 nt, Artificial Sequence
  derived and/or modified sequence opt2 from EGFR__Homo_sapiens__AAH94761
augcgccccuccggcaccgccggcgccgcccuccucgcccuccucgccgcccucugccccgccucccgcgcccucgaggagaagaaggucugccagggcaccuccaacaagcucacccagcucggcaccuucgaggaccacuuccucucccuccagcgcauguucaacaacugcgaggucguccucggcaaccucgagaucaccuacguccagcgcaacuacgaccucuccuuccucaagaccauccaggaggucgccggcuacguccucaucgcccucaacaccgucgagcgcaucccccucgagaaccuccagaucauccgcggcaacauguacuacgagaacuccuacgcccucgccguccucuccaacuacgacgccaacaagaccggccucaaggagcuccccaugcgcaaccuccagggccagaagugcgaccccuccugccccaacggcuccugcuggggcgccggcgaggagaacugccagaagcucaccaagaucaucugcgcccagcagugcuccggccgcugccgcggcaagucccccuccgacugcugccacaaccagugcgccgccggcugcaccggcccccgcgaguccgacugccucgucugccgcaaguuccgcgacgaggccaccugcaaggacaccugccccccccucaugcucuacaaccccaccaccuaccagauggacgucaaccccgagggcaaguacuccuucggcgccaccugcgucaagaagugcccccgcaacuacgucgucaccgaccacggcuccugcguccgcgccugcggcgccgacuccuacgagauggaggaggacggcguccgcaagugcaagaagugcgagggccccugccgcaaggucugcaacggcaucggcaucggcgaguucaaggacucccucuccaucaacgccaccaacaucaagcacuucaagaacugcaccuccaucuccggcgaccuccacauccuccccgucgccuuccgcggcgacuccuucacccacacccccccccucgacccccaggagcucgacauccucaagaccgucaaggagaucaccggcuuccuccucauccaggccuggcccgagaaccgcaccgaccuccacgccuucgagaaccucgagaucauccgcggccgcaccaagcagcacggccaguucucccucgccgucgucucccucaacaucaccucccucggccuccgcucccucaaggagaucuccgacggcgacgucaucaucuccggcaacaagaaccucugcuacgccaacaccaucaacuggaagaagcucuucggcaccuccggccagaagaccaagaucaucuccaaccgcggcgagaacuccugcaaggccaccggccaggucugccacgcccucugcucccccgagggcugcuggggccccgagccccgcgacugcgucuccugccgcaacgucucccgcggccgcgagugcgucgacaagugcaaccuccucgagggcgagccccgcgaguucgucgagaacuccgagugcauccagugccaccccgagugccucccccaggccaugaacaucaccugcaccggccgcggccccgacaacugcauccagugcgcccacuacaucgacggcccccacugcgucaagaccugccccgccggcgucaugggcgagaacaacacccucgucuggaaguacgccgacgccggccacgucugccaccucugccaccccaacugcaccuacggcugcaccggccccggccucgagggcugccccaccaacggccccaagauccccuccaucgccaccggcauggucggcgcccuccuccuccuccucgucgucgcccucggcaucggccucuucaugcgccgccgccacaucguccgcaagcgcacccuccgccgccuccuccaggagcgcgagcucgucgagccccucacccccuccggcgaggcccccaaccaggcccuccuccgcauccucaaggagaccgaguucaagaagaucaagguccucggcuccggcgccuucggcaccgucuacaagggccucuggauccccgagggcgagaaggucaagauccccgucgccaucaaggagcuccgcgaggccaccucccccaaggccaacaaggagauccucgacgaggccuacgucauggccuccgucgacaacccccacgucugccgccuccucggcaucugccucaccuccaccguccagcucaucacccagcucaugcccuucggcugccuccucgacuacguccgcgagcacaaggacaacaucggcucccaguaccuccucaacuggugcguccagaucgccaagggcaugaacuaccucgaggaccgccgccucguccaccgcgaccucgccgcccgcaacguccucgucaagaccccccagcacgucaagaucaccgacuucggccucgccaagcuccucggcgccgaggagaaggaguaccacgccgagggcggcaagguccccaucaaguggauggcccucgaguccauccuccaccgcaucuacacccaccaguccgacgucugguccuacggcgucaccgucugggagcucaugaccuucggcuccaagcccuacgacggcauccccgccuccgagaucuccuccauccucgagaagggcgagcgccucccccagccccccaucugcaccaucgacgucuacaugaucauggucaagugcuggaugaucgacgccgacucccgccccaaguuccgcgagcucaucaucgaguucuccaagauggcccgcgacccccagcgcuaccucgucauccagggcgacgagcgcaugcaccuccccucccccaccgacuccaacuucuaccgcgcccucauggacgaggaggacauggacgacgucgucgacgccgacgaguaccucaucccccagcagggcuucuucuccucccccuccaccucccgcaccccccuccucuccucccucuccgccaccuccaacaacuccaccgucgccugcaucgaccgcaacggccuccaguccugccccaucaaggaggacuccuuccuccagcgcuacuccuccgaccccaccggcgcccucaccgaggacuccaucgacgacaccuuccuccccguccccggcgaguggcucgucuggaagcaguccugcuccuccaccuccuccacccacuccgccgccgccucccuccagugccccucccagguccucccccccgccucccccgagggcgagaccgucgccgaccuccagacccaguga

SEQ ID NO: 1389 - RNA, 3276 nt, Artificial Sequence
  derived and/or modified sequence opt3 from EGFR__Homo_sapiens__AAH94761
augagacccagcggcaccgccggggcugcacugcucgcccuucuggcggcuuugugcccugccuccagggcauuagaggaaaagaaagugugucagggaacaucuaacaagcugacucaacuagguacguucgaggaccacuuucucucacugcagcggauguucaauaacugcgaagucguucuuggcaaucuggagaucaccuacgugcagcgcaacuaugauuugaguuuucucaaaacaauucaggaaguagccggguacgugcugauagcucugaauacugucgagcgaaucccacucgagaacuuacaaauuauccguggaaauauguauuacgaaaacagcuaugcacuggccgugcuuuccaauuacgacgcuaacaagaccggcuugaaagagcugccgaugagaaaucuacagggucagaagugugaucccucuugcccuaacgggucguguuggggagccggcgaagagaauugccagaagcucacaaaaauuaucugugcgcaacagugcucagggaggugucggggcaagagcccaagugacugcugucauaaccagugcgcagccggaugcaccgguccccgcgaguccgauugucugguuugcagaaaauucagggacgaagcuacuuguaaggauacaugcccuccacuuaugcuguauaaucccaccacguaccagauggacgugaacccugagggcaaauacucuuuuggggccacuugugucaagaagugcccacggaacuaugugguaaccgaucacggaagcuguguucgcgcaugcggcgcugacuccuacgaaauggaggaagauggugugcgaaaauguaagaaaugcgaggggccguguagaaaggucugcaauggaauaggcaucggcgaguucaaagacucauugaguauuaacgccacaaauaucaagcauuuuaaaaacugcacuagcauuucuggggaucuccacauccugcccguggcguucaggggagacuccuuuacccauacaccuccauuagacccccaagaacuggauauacucaagaccgugaaggagauuacggguuuccuucugauccaggccuggccugaaaaucggacugacuugcacgcauuugagaaccuagaaauuauccguggccgcacaaaacagcacgggcaauucucacuggcugucguuagccucaauaucaccagucugggacuuagaucucugaaggagauuuccgauggcgacgugauaaucagcgguaacaaaaauuuguguuaugccaacacuauuaauuggaagaaacucuuugggacaucgggccagaagaccaagaucauaucuaacaggggagaaaauuccugcaaagcuacgggccagguaugucaugcccugugcucaccagagggguguuggggacccgagccgcgggauugcgugaguugucgaaacgucagccgcgguagagaaugcguggacaaguguaauuuacuggagggcgaaccuagggaguucguugagaacuccgaaugcauucagugucaccccgagugccuaccacaagcaaugaacauuaccugcacagggcggggaccugauaauuguauccagugcgcccauuacaucgacggcccccacugugugaaaacuugcccagcuggugucaugggggaaaacaauacccucguguggaaguaugcggaugcaggccacguaugucaucugugccaccccaacuguacauacggaugcacuggcccugggcuugagggauguccaaccaaugguccgaaaauccccucuauugccacaggcaugguuggggcuuugcugcuccugcuuguggucgcccugggaauaggcuuguucaugcgcagaaggcauaucgugcguaagcggacccuccgaagacuguuacaggagagggaacuggucgagccucuaacuccaagcggugaagcacccaaccaggcccuccugcgcauucuuaaggagacggaauuuaaaaagaucaaaguguuggggucaggcgcuuucggaacaguuuauaagggccuguggaucccugagggggagaaagugaagauuccaguagccauaaaggaacuccgggaggcaaccagucccaaagcgaauaaggaaauccuggacgaggcuuacgucauggccuccguggauaacccgcacguuugcagauuacugggaauuugucuuacuagcaccgugcaauugaucacacagcucaugccuuuuggcugccugcuagacuacgucagggaacauaaagacaauauugguucucaguaucugcucaacuggugcgugcagaucgcaaaggggaugaauuaccuggaggaucgccgacuuguacaccgggacuuggccgcucguaacgugcugguuaaaaccccacaacacgucaagauaacugauuucggauuagccaaacuccugggcgcagaggaaaaggaguaucaugcugaagguggcaaggugcccaucaaauggauggcccuugagucaauucugcacagaaucuacacacaucagagugacguguggagcuauggggucacgguuugggaauugaugaccuuuggauccaagccuuacgauggcauucccgcgucugagaucucgagcauacucgagaaaggggaaaggcugccacagccucccauuuguacuaucgacguguauaugauuauggugaagugcuggaugaucgaugccgacucccgcccaaaauuccgggagcuaauaaucgaauuuucaaagauggcuagagauccgcagagguaccugguaauucaaggagacgagcgaaugcaccucccuagucccacagauucuaauuucuaccgcgcacugauggacgaggaagauauggacgacgucguggaugccgacgaguaucuuaucccacagcagggcuuuuucagcucccccucaaccagccggacaccuuugcugucuuccuuaagugcuacuagcaacaauucuaccguugccuguauugauagaaacggucuccaauccugcccaaucaaggaagacucauuucugcagagguacaguagcgaucccacgggggcacuuaccgaggacucgauagaugacacauuccugccugugccgggagaauggcuagucuggaaacaguccuguucuagcacuucaaguacccacuccgcggccgcuucucuccagugcccaagccaagugcugcccccugccuccccagagggcgagacaguugcagauuugcagacucaguga

SEQ ID NO: 1390 - RNA, 3276 nt, Artificial Sequence
  derived and/or modified sequence opt4 from EGFR__Homo_sapiens__AAH94761
augagacccagcggcaccgccggcgccgcccugcuggcccugcuggccgcccugugccccgccagcagagcccuggaggagaagaaggugugccagggcaccagcaacaagcugacccagcugggcaccuucgaggaccacuuccugagccugcagagaauguucaacaacugcgagguggugcugggcaaccuggagaucaccuacgugcagagaaacuacgaccugagcuuccugaagaccauccaggagguggccggcuacgugcugaucgcccugaacaccguggagagaaucccccuggagaaccugcagaucaucagaggcaacauguacuacgagaacagcuacgcccuggccgugcugagcaacuacgacgccaacaagaccggccugaaggagcugcccaugagaaaccugcagggccagaagugcgaccccagcugccccaacggcagcugcuggggcgccggcgaggagaacugccagaagcugaccaagaucaucugcgcccagcagugcagcggcagaugcagaggcaagagccccagcgacugcugccacaaccagugcgccgccggcugcaccggccccagagagagcgacugccuggugugcagaaaguucagagacgaggccaccugcaaggacaccugccccccccugaugcuguacaaccccaccaccuaccagauggacgugaaccccgagggcaaguacagcuucggcgccaccugcgugaagaagugccccagaaacuacguggugaccgaccacggcagcugcgugagagccugcggcgccgacagcuacgagauggaggaggacggcgugagaaagugcaagaagugcgagggccccugcagaaaggugugcaacggcaucggcaucggcgaguucaaggacagccugagcaucaacgccaccaacaucaagcacuucaagaacugcaccagcaucagcggcgaccugcacauccugcccguggccuucagaggcgacagcuucacccacacccccccccuggacccccaggagcuggacauccugaagaccgugaaggagaucaccggcuuccugcugauccaggccuggcccgagaacagaaccgaccugcacgccuucgagaaccuggagaucaucagaggcagaaccaagcagcacggccaguucagccuggccguggugagccugaacaucaccagccugggccugagaagccugaaggagaucagcgacggcgacgugaucaucagcggcaacaagaaccugugcuacgccaacaccaucaacuggaagaagcuguucggcaccagcggccagaagaccaagaucaucagcaacagaggcgagaacagcugcaaggccaccggccaggugugccacgcccugugcagccccgagggcugcuggggccccgagcccagagacugcgugagcugcagaaacgugagcagaggcagagagugcguggacaagugcaaccugcuggagggcgagcccagagaguucguggagaacagcgagugcauccagugccaccccgagugccugccccaggccaugaacaucaccugcaccggcagaggccccgacaacugcauccagugcgcccacuacaucgacggcccccacugcgugaagaccugccccgccggcgugaugggcgagaacaacacccugguguggaaguacgccgacgccggccacgugugccaccugugccaccccaacugcaccuacggcugcaccggccccggccuggagggcugccccaccaacggccccaagauccccagcaucgccaccggcauggugggcgcccugcugcugcugcuggugguggcccugggcaucggccuguucaugagaagaagacacaucgugagaaagagaacccugagaagacugcugcaggagagagagcugguggagccccugacccccagcggcgaggcccccaaccaggcccugcugagaauccugaaggagaccgaguucaagaagaucaaggugcugggcagcggcgccuucggcaccguguacaagggccuguggauccccgagggcgagaaggugaagauccccguggccaucaaggagcugagagaggccaccagccccaaggccaacaaggagauccuggacgaggccuacgugauggccagcguggacaacccccacgugugcagacugcugggcaucugccugaccagcaccgugcagcugaucacccagcugaugcccuucggcugccugcuggacuacgugagagagcacaaggacaacaucggcagccaguaccugcugaacuggugcgugcagaucgccaagggcaugaacuaccuggaggacagaagacuggugcacagagaccuggccgccagaaacgugcuggugaagaccccccagcacgugaagaucaccgacuucggccuggccaagcugcugggcgccgaggagaaggaguaccacgccgagggcggcaaggugcccaucaaguggauggcccuggagagcauccugcacagaaucuacacccaccagagcgacguguggagcuacggcgugaccgugugggagcugaugaccuucggcagcaagcccuacgacggcauccccgccagcgagaucagcagcauccuggagaagggcgagagacugccccagccccccaucugcaccaucgacguguacaugaucauggugaagugcuggaugaucgacgccgacagcagacccaaguucagagagcugaucaucgaguucagcaagauggccagagacccccagagauaccuggugauccagggcgacgagagaaugcaccugcccagccccaccgacagcaacuucuacagagcccugauggacgaggaggacauggacgacgugguggacgccgacgaguaccugaucccccagcagggcuucuucagcagccccagcaccagcagaaccccccugcugagcagccugagcgccaccagcaacaacagcaccguggccugcaucgacagaaacggccugcagagcugccccaucaaggaggacagcuuccugcagagauacagcagcgaccccaccggcgcccugaccgaggacagcaucgacgacaccuuccugcccgugcccggcgaguggcugguguggaagcagagcugcagcagcaccagcagcacccacagcgccgccgccagccugcagugccccagccaggugcugccccccgccagccccgagggcgagaccguggccgaccugcagacccaguga

SEQ ID NO: 1391 - RNA, 3276 nt, Artificial Sequence
  derived and/or modified sequence opt5 from EGFR__Homo_sapiens__AAH94761
augagacccagcggcaccgccggggcugcccugcucgcgcugcuugcugcccugugcccugccucccgggcucucgaggaaaagaaagugugucagggaacaucuaacaagcugacgcaacuuggcaccuucgaggaccacuuucugagccuccagcgcauguucaauaacugcgaagucguucuggggaaucuggagaucacauacgugcagagaaacuaugaucucuccuuucugaaaaccauucaggaaguggccggauacguccuuaucgcucugaauacaguggagcggauuccgcucgagaaccugcaaaucauucgcggcaauauguauuacgaaaacucuuaugcccuugcgguucugagcaauuacgacgccaacaagaccgggcucaaagagcugcccaugagaaaucugcagggacagaagugugauccuuccugccccaacggcucuuguuggggcgcuggggaagagaauugccagaagcucacaaaaaucaucugugcccaacagugcagcggacggugucgcggcaaguccccuagcgacugcugucauaaccagugcgcugccgggugcaccggacccagagagucugauugucuggugugccggaaauuccgcgacgaagcgacguguaaggauaccugcccuccgcuuaugcuguauaaucccacaaccuaccagauggacgucaacccugagggcaaauacuccuuuggggccacaugugugaagaagugccccagaaacuauguugugaccgaucacggaagcuguguccgggcuugcggcgccgacucuuacgaaauggaggaagauggcgugcgcaaauguaagaaaugcgaggggccuuguagaaaggugugcaauggaauuggcaucggggaguucaaagacucccucagcauuaacgcuacgaauaucaagcauuuuaaaaacugcacaucuauuuccggagaucugcacauccuucccgucgccuuccggggcgacagcuuuacccauacaccgccucuggacccccaagaacucgauauucugaagaccguuaaggagaucaccggguuccugcucauccaggccuggccugaaaaucgcacagaccugcacgcuuuugagaaccuugaaauuaucagaggacggacgaaacagcacggccaauucucccuggcgguggugucucucaauauuaccagccugggccuuagaucccugaaggagaucagcgauggggacgucauuaucucuggaaacaaaaaucucuguuaugccaacacaaucaauuggaagaaacuguuuggcaccuccgggcagaagacaaagauuaucagcaaccgcggagaaaauucuugcaaagcuaccggccaggugugucaugcccugugcagccccgagggguguuggggccccgagccucgggauugcguuuccuguagaaacgugucucgcggacgggaaugcgucgacaaguguaaucuccuggagggcgaaccgagagaguucguggagaacagcgaaugcauucagugucaccccgagugccuuccucaagccaugaacaucacgugcacagggcgcggacccgauaauuguauucagugcgcucauuacaucgacggcccucacuguguuaaaaccugccccgccggggugaugggagaaaacaauacccuggucuggaaguaugcggaugcuggccacgugugucaucucugccacccgaacuguacauacgggugcaccggcccuggacuggagggcugucccacaaaugggccuaaaauccccuccauugccacgggaauggucggcgcccugcuucuccugcuggugguugcucucgggaucggacuguucaugcggagacgccauauugugcggaagagaacccuucgccggcugcuccaggagagagaacuggucgagccucugacacccagcggcgaagccccgaaccaggcccuucuccggauccugaaggagaccgaauuuaaaaagauuaaagugcuggggucuggcgcuuucggaacaguuuauaagggccucuggaucccugagggggagaaagugaagauucccgucgcgaucaaggaacugcgcgaggccaccucccccaaagcuaauaaggaaauccuugacgaggccuacgugauggcuagcguggauaacccucacguuugcagacugcucggaauuugucugacgucuaccguccaacugaucacacagcuuaugccguuuggcugccuccuggacuacgugcgggaacauaaagacaauauugggucccaguaucugcucaacuggugcgugcagaucgccaagggaaugaauuaccuggaggauagacgccuuguccaccgggaccuggcggccagaaacgugcucguuaaaacaccccaacacgugaagauuaccgauuucggccuggcuaaacugcuuggggccgaggaaaaggaguaucaugcugaaggcggaaaggucccuaucaaauggauggcccucgagagcauccugcaccgcauuuacacccaucaguccgacguguggucuuauggcguuacggugugggaacugaugacauuugggagcaagcccuacgauggaaucccugccuccgagauuucuagcauccucgagaaaggcgaaagacugccccagccucccauuuguaccaucgacgucuauaugaucauggugaagugcuggaugauugaugcugacucccggccgaaauuccgcgagcuuaucauugaauuuagcaagauggcgagagauccucagcgguaccugguuauccaaggggacgagcgcaugcaccuccccucuccuacagauuccaauuucuacagagcccugauggacgaggaagauauggacgacguggucgaugcugacgaguaucugauuccccagcagggauuuuucagcucuccguccaccagccggaccccucuucugucuagccucuccgccacaagcaacaauucuacgguggccuguaucgaucgcaacggccugcaauccugccccaucaaggaagacagcuuucuccagagauacuccucugauccuaccggcgcucugacagaggacagcauugaugacaccuuccuucccgugcccggggaauggcuggucuggaaacaguccuguucuagcacauccucuacccacagcgccgcggcuucccuccagugcccuagccaaguucugccgcccgccucuccugagggagagacgguggccgaucugcagacacaguga

SEQ ID NO: 1392 - protein, 71 aa, Artificial Sequence
  EGFR__Homo_sapiens__Q8NDU8
MRPSGTAGAALLALLAALCPASRALEEKKGKGVSRRLPRRPRIAPRTPQPAQPRTGAPARARAPARPFLFP

SEQ ID NO: 1393 - RNA, 216 nt, Artificial Sequence
  EGFR__Homo_sapiens__CAA34902
augcgacccuccgggacggccggggcagcgcuccuggcgcugcuggcugcgcucugcccggcgagucgggcucuggaggaaaagaaagguaagggcgugucucgccggcucccgcgccgcccccggaucgcgccccggaccccgcagcccgcccaaccgcgcaccggcgcaccggcucgcgcccgcgcccccgcccguccuuuccuguuuccuuga

SEQ ID NO: 1394 - RNA, 216 nt, Artificial Sequence
  derived and/or modified sequence opt1 from EGFR__Homo_sapiens__CAA34902
augcgccccagcggcaccgccggggccgcgcugcucgcccugcuggccgcccucugcccggccucccgggcgcuggaggagaagaagggcaagggggugagccgccggcugccccgccggccccgcaucgcgccccggaccccgcagcccgcccagccccgcacgggcgcccccgcccgggcccgcgccccggcccggcccuuccucuuccccuga

SEQ ID NO: 1395 - RNA, 216 nt, Artificial Sequence
  derived and/or modified sequence opt2 from EGFR__Homo_sapiens__CAA34902
augcgccccuccggcaccgccggcgccgcccuccucgcccuccucgccgcccucugccccgccucccgcgcccucgaggagaagaagggcaagggcgucucccgccgccucccccgccgcccccgcaucgccccccgcaccccccagcccgcccagccccgcaccggcgcccccgcccgcgcccgcgcccccgcccgccccuuccucuuccccuga

SEQ ID NO: 1396 - RNA, 216 nt, Artificial Sequence
  derived and/or modified sequence opt3 from EGFR__Homo_sapiens__CAA34902
augagacccagcggcaccgccggggcugcacugcucgcccuucuggcggcuuugugcccugccuccagggcauuagaggaaaagaaaggaaagggugugucucggcgccugccacgacguccgagaaucgcccccaggacaccucagccagcucaaccccggacuggcgccccugcacgcgcuagagccccagcgaggcccuuccuauuuccuuga

SEQ ID NO: 1397 - RNA, 216 nt, Artificial Sequence
  derived and/or modified sequence opt4 from EGFR__Homo_sapiens__CAA34902
augagacccagcggcaccgccggcgccgcccugcuggcccugcuggccgcccugugccccgccagcagagcccuggaggagaagaagggcaagggcgugagcagaagacugcccagaagacccagaaucgcccccagaaccccccagcccgcccagcccagaaccggcgcccccgccagagccagagcccccgccagacccuuccuguuccccuga

SEQ ID NO: 1398 - RNA, 216 nt, Artificial Sequence
  derived and/or modified sequence opt5 from EGFR__Homo_sapiens__CAA34902
augagacccagcggcaccgccggggcugcccugcucgcgcugcuugcugcccugugcccugccucccgggcucucgaggaaaagaaaggaaagggcgugucucgcagacugccgcggcgccccagaaucgccccucggacaccccagccugcucaaccccgcacgggggccccugcgagagcccgggcuccggcccgccccuuccuuuuuccuuga

SEQ ID NO: 1399 - protein, 239 aa, Artificial Sequence
  EGLN3__Homo_sapiens__Q9H6Z9
MPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 1400 - RNA, 720 nt, Artificial Sequence
  EGLN3__Homo_sapiens__AAH10992
augccccugggacacaucaugaggcuggaccuggagaaaauugcccuggaguacaucgugcccugucugcacgaggugggcuucugcuaccuggacaacuuccugggcgagguggugggcgacugcguccuggagcgcgucaagcagcugcacugcaccggggcccugcgggacggccagcuggcggggccgcgcgccggcgucuccaagcgacaccugcggggcgaccagaucacguggaucgggggcaacgaggagggcugcgaggccaucagcuuccuccugucccucaucgacaggcugguccucuacugcgggagccggcugggcaaauacuacgucaaggagaggucuaaggcaaugguggcuugcuauccgggaaauggaacagguuauguucgccacguggacaaccccaacggugauggucgcugcaucaccugcaucuacuaucugaacaagaauugggaugccaagcuacauggugggauccugcggauauuuccagaggggaaaucauucauagcagauguggagcccauuuuugacagacuccuguucuucuggucagaucguaggaacccacacgaagugcagcccucuuacgcaaccagauaugcuaugacugucugguacuuugaugcugaagaaagggcagaagccaaaaagaaauucaggaauuuaacuaggaaaacugaaucugcccucacugaagacuga

SEQ ID NO: 1401 - RNA, 720 nt, Artificial Sequence
  derived and/or modified sequence opt1 from EGLN3__Homo_sapiens__AAH10992
augccccugggccacaucaugcgccucgaccuggagaagaucgcccuggaguacaucgugccgugccuccacgaggucggguucugcuaccuggacaacuuccugggcgagguggugggggacugcguccucgagcgggugaagcagcugcacugcaccggcgcccugcgcgacgggcagcucgcgggcccccgggccggcgugagcaagcgccaccuccgcggggaccagaucaccuggaucggcgggaacgaggagggcugcgaggccaucuccuuccugcucagccugaucgaccggcugguccucuacugcgggucccggcugggcaaguacuacgugaaggagcgcagcaaggccaugguggccugcuaccccggcaacgggacgggcuacguccggcacguggacaaccccaacggggacggccgcugcaucacgugcaucuacuaccugaacaagaacugggacgcgaagcuccacggcgggauccugcggaucuucccggagggcaaguccuucaucgccgacguggagcccaucuucgaccgccugcuguucuucuggagcgaccggcgcaacccccacgagguccagcccuccuacgccacccgguacgccaugaccgugugguacuucgacgcggaggagcgcgccgaggccaagaagaaguuccggaaccugacccgcaagaccgagagcgcccugaccgaggacuga

SEQ ID NO: 1402 - RNA, 720 nt, Artificial Sequence
  derived and/or modified sequence opt2 from EGLN3__Homo_sapiens__AAH10992
augccccucggccacaucaugcgccucgaccucgagaagaucgcccucgaguacaucguccccugccuccacgaggucggcuucugcuaccucgacaacuuccucggcgaggucgucggcgacugcguccucgagcgcgucaagcagcuccacugcaccggcgcccuccgcgacggccagcucgccggcccccgcgccggcgucuccaagcgccaccuccgcggcgaccagaucaccuggaucggcggcaacgaggagggcugcgaggccaucuccuuccuccucucccucaucgaccgccucguccucuacugcggcucccgccucggcaaguacuacgucaaggagcgcuccaaggccauggucgccugcuaccccggcaacggcaccggcuacguccgccacgucgacaaccccaacggcgacggccgcugcaucaccugcaucuacuaccucaacaagaacugggacgccaagcuccacggcggcauccuccgcaucuuccccgagggcaaguccuucaucgccgacgucgagcccaucuucgaccgccuccucuucuucugguccgaccgccgcaacccccacgagguccagcccuccuacgccacccgcuacgccaugaccgucugguacuucgacgccgaggagcgcgccgaggccaagaagaaguuccgcaaccucacccgcaagaccgaguccgcccucaccgaggacuga

SEQ ID NO: 1403 - RNA, 720 nt, Artificial Sequence
  derived and/or modified sequence opt3 from EGLN3__Homo_sapiens__AAH10992
augccccugggccacaucaugagacucgaccuugagaagauugcccuggaauacauagugccuugcuugcaugaggucggguucuguuauuuagauaacuuucugggagaaguugugggugacugcguacuagagagggugaaacagcuccacuguaccggcgcucugcgggaugggcaacuugcaggaccacgcgccggcgucagcaagcgacaucugcguggugaccagaucacauggauugggggaaaugaagagggcugcgaggcgaucuccuucuugcucucucugauugauagacuggugcucuacuguggcucaagguuagggaaauauuacguuaaggaacggaguaaagcuaugguggccugcuauccgggaaacgguacuggcuacguccgccacguggacaaucccaacggggauggaagauguaucacgugcauauauuaccugaauaagaacugggacgcaaaacuucauggcgguaucuugaggauuuuuccugaggggaaguccuucaucgccgauguagaaccaauuuuugaccggcugcuauucuuuuggagcgaucgccgaaauccccacgagguucagccuucuuacgcuaccagauaugcaaugacagugugguacuucgacgccgaggaaagggcugaggccaagaaaaaguuucggaaccucacucguaaaaccgaaucggcgcugacagaggauuga

SEQ ID NO: 1404 - RNA, 720 nt, Artificial Sequence
  derived and/or modified sequence opt4 from EGLN3__Homo_sapiens__AAH10992
augccccugggccacaucaugagacuggaccuggagaagaucgcccuggaguacaucgugcccugccugcacgaggugggcuucugcuaccuggacaacuuccugggcgagguggugggcgacugcgugcuggagagagugaagcagcugcacugcaccggcgcccugagagacggccagcuggccggccccagagccggcgugagcaagagacaccugagaggcgaccagaucaccuggaucggcggcaacgaggagggcugcgaggccaucagcuuccugcugagccugaucgacagacuggugcuguacugcggcagcagacugggcaaguacuacgugaaggagagaagcaaggccaugguggccugcuaccccggcaacggcaccggcuacgugagacacguggacaaccccaacggcgacggcagaugcaucaccugcaucuacuaccugaacaagaacugggacgccaagcugcacggcggcauccugagaaucuuccccgagggcaagagcuucaucgccgacguggagcccaucuucgacagacugcuguucuucuggagcgacagaagaaacccccacgaggugcagcccagcuacgccaccagauacgccaugaccgugugguacuucgacgccgaggagagagccgaggccaagaagaaguucagaaaccugaccagaaagaccgagagcgcccugaccgaggacuga

SEQ ID NO: 1405 - RNA, 720 nt, Artificial Sequence
  derived and/or modified sequence opt5 from EGLN3__Homo_sapiens__AAH10992
augccccugggccacaucaugagacucgaccuggagaagauugcccuugaauacaucgugccuugccugcaugaggucggguucuguuaucucgauaacuuucugggagaaguugugggcgacugcgugcuugagcgggucaaacagcugcacuguaccggggcucuccgcgauggacaacuggccggcccgagagcgggggugagcaagcggcaucugcgcggagaccagauuacauggaucggcggcaaugaagaggggugcgaggcuauuuccuuccuccugucucuuaucgauagacugguucucuacuguggaagccggcugggcaaauauuacgugaaggaacgcuccaaagccauggucgccugcuaucccgggaacggaacgggcuacgugagacacguugacaauccuaacggggauggacgguguauuaccugcaucuauuaccuuaauaagaacugggacgcuaagcugcauggcggcauccuccgcauuuuucccgaggggaaaucuuucaucgccgauguggaaccuauuuuugacagacugcuguucuuuuggagcgaucggcgcaauccccacgagguccagccuuccuacgcuacaagauaugccaugaccgugugguacuucgacgcggaggaacgggccgaggcuaagaaaaaguuucgcaaccucacaagaaaaaccgaaucugcccugacagaggauuga

SEQ ID NO: 1406 - protein, 521 aa, Artificial Sequence
  ELF2/m__Homo_sapiens__B7Z720
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 1407 - RNA, 1566 nt, Artificial Sequence
  ELF2/m__Homo_sapiens__BAH13456
auggcgacgucucugcaugagggacccacgaaccagcuggaucugcucauccgggccguggaagcaucaguucacagcaguaaugcacacuguacagauaagacaauugaagcugcugaagcccugcuucauauggaaucuccuaccugcuugagggauucaagaaguccugaauucauccaugcugcuaugaggccagaugucauuacagaaacuguaguggaggugucaacugaagagucugaacccauggauaccucuccuauuccaacaucaccagauagccaugaaccaaugaaaaagaaaaaaguuggccguaaaccaaagacccagcaaucaccaauuuccaaugggucuccugaguuagguauaaagaagaaaccaagagaaggaaaaggaaacacaaccuauuugugggaguuucuuuuagaucuacuucaagauaaaaauacuugucccagguauauuaaauggacucagagagaaaaaggcauauucaagcugguggauucaaaggcugucucuaagcuuuggggaaagcauaagaacaaaccagacaugaacuaugaaaccaugggacgagcuuugagauacuacuaccaaaggggaauucuugcaaagguugaaggacagaggcuuguauaucaguucaaggauaugccgaaaaacauaguggucauagaugaugacaaaagugaaaccuguaaugaagauuuagcaggaacuacugaugaaaaaucauuagaacgagugucacugucugcagaaagucuccugaaagcagcauccucuguucgcaguggaaaaaauucauccccuauaaacugcuccagagcagagaaggguguagcuagaguugugaauaucacuuccccugggcacgaugcuucauccaggucuccuacuaccacugcaucugugucagcaacagcagcuccaaggacaguucguguggcaaugcagguaccuguuguaaugacaucauugggucagaaaauuucaacuguggcaguucagucaguuaaugcaggugcaccauuaauaaccagcacuaguccaacaacagcgaccucuccaaagguagucauucagacaaucccuacugugaugccagcuucuacugaaaauggagacaaaaucaccaugcagccugccaaaauuauuaccaucccagcuacacagcuugcacagugucaacugcagacaaagucaaaucugacuggaucaggaagcauuaacauuguuggaaccccauuggcugugagagcacuuaccccuguuucaauagcccaugguacaccuguaaugagacuaucaaugccuacucagcaggcaucuggccagacuccuccucgaguuaucagugcagucauaaaggggccagagguuaaaucggaagcaguggcaaaaaagcaagaacaugaugugaaaacuuugcagcuaguagaagaaaaaccagcagauggaaauaagacagugacccacguagugguugucagugcgccuucagcuauugcccuuccuguaacuaugaaaacagaaggacuagugacaugugagaaauaa

SEQ ID NO: 1408 - RNA, 1566 nt, Artificial Sequence
  derived and/or modified sequence opt1 from ELF2/m__Homo_sapiens__BAH13456
auggccaccagccugcacgagggccccaccaaccagcucgaccugcugauccgcgccguggaggcguccguccacagcuccaacgcccacugcacggacaagaccaucgaggccgccgaggcccuccugcacauggagagcccgaccugccugcgggacucccgcagccccgaguucauccacgcggccaugcggcccgacgugaucaccgagacgguggucgagguguccaccgaggagagcgagcccauggacaccuccccgauccccaccagccccgacucccacgagcccaugaagaagaagaagguggggcgcaagccgaagacgcagcagagccccaucuccaacggcagccccgagcucgggaucaagaagaagccccgggagggcaaggggaacaccaccuaccugugggaguuccugcucgaccugcugcaggacaagaacacgugcccgcgcuacaucaaguggacgcagcgggagaagggcaucuucaagcucgucgacuccaaggccgugagcaagcuguggggcaagcacaagaacaagcccgacaugaacuacgagaccauggggcgcgcccugcgguacuacuaccagcgcggcauccucgcgaagguggaggggcagcggcuggucuaccaguucaaggacaugcccaagaacaucguggugaucgacgacgacaaguccgagaccugcaacgaggaccuggccggcaccacggacgagaagucccucgagcgcgucagccugagcgccgagagccugcucaaggccgccuccagcgugcgguccgggaagaacagcucccccaucaacugcagccgcgcggagaagggcguggcccgggucgugaacaucaccuccccgggccacgacgccagcucccgcagccccaccaccacggccuccgugagcgccaccgcggcgccccggaccguccgcguggccaugcagguccccguggugaugaccucccuggggcagaagaucagcacgguggccguccaguccgugaacgccggcgccccgcugaucaccagcaccucccccaccacggccaccagccccaaggucgugauccagaccauccccaccgugaugccggccuccacggagaacggggacaagaucaccaugcagcccgccaagaucaucaccauccccgccacccagcucgcgcagugccagcugcagaccaagagcaaccugaccggcagcggcuccaucaacaucgucgggacgccccucgccgugcgggcccugaccccggugagcaucgcccacggcacccccgucaugcgccuguccaugcccacccagcaggcgagcgggcagaccccgccccgggugaucuccgccgugaucaagggccccgaggucaagagcgaggccguggccaagaagcaggagcacgacgugaagacccuccagcuggucgaggagaagcccgccgacgggaacaagaccgugacgcacguggucgugguguccgcgccgagcgccaucgcccugcccgucaccaugaagaccgagggccucgugaccugcgagaaguga

SEQ ID NO: 1409 - RNA, 1566 nt, Artificial Sequence
  derived and/or modified sequence opt2 from ELF2/m__Homo_sapiens__BAH13456
auggccaccucccuccacgagggccccaccaaccagcucgaccuccucauccgcgccgucgaggccuccguccacuccuccaacgcccacugcaccgacaagaccaucgaggccgccgaggcccuccuccacauggagucccccaccugccuccgcgacucccgcucccccgaguucauccacgccgccaugcgccccgacgucaucaccgagaccgucgucgaggucuccaccgaggaguccgagcccauggacaccucccccauccccaccucccccgacucccacgagcccaugaagaagaagaaggucggccgcaagcccaagacccagcagucccccaucuccaacggcucccccgagcucggcaucaagaagaagccccgcgagggcaagggcaacaccaccuaccucugggaguuccuccucgaccuccuccaggacaagaacaccugcccccgcuacaucaaguggacccagcgcgagaagggcaucuucaagcucgucgacuccaaggccgucuccaagcucuggggcaagcacaagaacaagcccgacaugaacuacgagaccaugggccgcgcccuccgcuacuacuaccagcgcggcauccucgccaaggucgagggccagcgccucgucuaccaguucaaggacaugcccaagaacaucgucgucaucgacgacgacaaguccgagaccugcaacgaggaccucgccggcaccaccgacgagaagucccucgagcgcgucucccucuccgccgagucccuccucaaggccgccuccuccguccgcuccggcaagaacuccucccccaucaacugcucccgcgccgagaagggcgucgcccgcgucgucaacaucaccucccccggccacgacgccuccucccgcucccccaccaccaccgccuccgucuccgccaccgccgccccccgcaccguccgcgucgccaugcagguccccgucgucaugaccucccucggccagaagaucuccaccgucgccguccaguccgucaacgccggcgccccccucaucaccuccaccucccccaccaccgccaccucccccaaggucgucauccagaccauccccaccgucaugcccgccuccaccgagaacggcgacaagaucaccaugcagcccgccaagaucaucaccauccccgccacccagcucgcccagugccagcuccagaccaaguccaaccucaccggcuccggcuccaucaacaucgucggcaccccccucgccguccgcgcccucacccccgucuccaucgcccacggcacccccgucaugcgccucuccaugcccacccagcaggccuccggccagacccccccccgcgucaucuccgccgucaucaagggccccgaggucaaguccgaggccgucgccaagaagcaggagcacgacgucaagacccuccagcucgucgaggagaagcccgccgacggcaacaagaccgucacccacgucgucgucgucuccgcccccuccgccaucgcccuccccgucaccaugaagaccgagggccucgucaccugcgagaaguga

SEQ ID NO: 1410 - RNA, 1566 nt, Artificial Sequence
  derived and/or modified sequence opt3 from ELF2/m__Homo_sapiens__BAH13456
auggccaccagccugcacgagggccccacaaaccagcucgaccuucugaucagagcuguggaagcauccguccauucuucaaaugcccacugcacugauaagacgauugaggcggcugaagccuuguuacauauggagaguccuaccugucugagggacagccgguccccagaguucauacacgcagccaugcgcccggauguuaucacagaaacugugguagaggugucuaccgaagagucggaacccauggacacaucaccuauuccaaccagccccgauagucaugagccuaugaaaaagaaaaaggucgggcgaaaaccaaagacucaacagucccccaucucuaacggaagcccugagcuagguauuaagaaaaagccacgugaaggcaaagggaauacaaccuaccucugggaguuucugcuugaccuguugcaggauaagaacacgugcccgagauauaucaaauggacucagagggaaaagggaauauucaagcucguggacuccaaagcuguuucaaagcuguggggcaaacacaagaauaaacccgauaugaacuacgagaccaugggucgggcacugcgcuauuacuaucaaagagggauccucgccaagguggaaggacagagguuagucuaccaguuuaaagacaugccuaagaauauugugguaaucgaugacgauaagagugagacauguaacgaggaccuggcuggcacuaccgacgagaaaagccuugaacggguuucuuuguccgccgaaucacugcuaaaggcggcaagcagugugcgcucuggcaaaaauuccagcccaauuaacugcucgcgagccgagaagggggucgcuagaguggugaauaucacaucucccggacacgaugccuccucaaggaguccuaccacgacugcaagcgucuccgcuacagccgcgccacggaccguucguguggccaugcagguacccguggucaugacuucucucggucagaaaauaagcacaguggcaguucaaucagugaacgcuggcgccccgcugauuaccaguacguccccuaccacagcuacuagccccaaggucgugauccagaccauuccaacaguaaugccugccucuacugaaaauggggacaagaucaccaugcagcccgcaaaaaucauuacaauaccagccacccaacuugcucagugucagcugcaaacuaagucaaacuugacgggaaguggcagcaucaauauuguugguacaccccucgcggugcgcgcacugaccccugucuccaucgcccaugggacuccagugaugagauuaucuaugccgacccagcaggcuucgggacagacacccccuagggucauaagcgccgugauuaaaggcccagagguuaaguccgaggcaguggccaaaaagcaagaacacgauguaaagacccugcagcucgucgaggaaaaacccgcugacggcaacaagacugugacacauguuguggucgugucagccccuagugcaaucgcgcuuccaguaacgaugaaaaccgaggggcuggugacuugcgaaaaguga

SEQ ID NO: 1411 - RNA, 1566 nt, Artificial Sequence
  derived and/or modified sequence opt4 from ELF2/m__Homo_sapiens__BAH13456
auggccaccagccugcacgagggccccaccaaccagcuggaccugcugaucagagccguggaggccagcgugcacagcagcaacgcccacugcaccgacaagaccaucgaggccgccgaggcccugcugcacauggagagccccaccugccugagagacagcagaagccccgaguucauccacgccgccaugagacccgacgugaucaccgagaccgugguggaggugagcaccgaggagagcgagcccauggacaccagccccauccccaccagccccgacagccacgagcccaugaagaagaagaaggugggcagaaagcccaagacccagcagagccccaucagcaacggcagccccgagcugggcaucaagaagaagcccagagagggcaagggcaacaccaccuaccugugggaguuccugcuggaccugcugcaggacaagaacaccugccccagauacaucaaguggacccagagagagaagggcaucuucaagcugguggacagcaaggccgugagcaagcuguggggcaagcacaagaacaagcccgacaugaacuacgagaccaugggcagagcccugagauacuacuaccagagaggcauccuggccaagguggagggccagagacugguguaccaguucaaggacaugcccaagaacaucguggugaucgacgacgacaagagcgagaccugcaacgaggaccuggccggcaccaccgacgagaagagccuggagagagugagccugagcgccgagagccugcugaaggccgccagcagcgugagaagcggcaagaacagcagccccaucaacugcagcagagccgagaagggcguggccagaguggugaacaucaccagccccggccacgacgccagcagcagaagccccaccaccaccgccagcgugagcgccaccgccgcccccagaaccgugagaguggccaugcaggugcccguggugaugaccagccugggccagaagaucagcaccguggccgugcagagcgugaacgccggcgccccccugaucaccagcaccagccccaccaccgccaccagccccaagguggugauccagaccauccccaccgugaugcccgccagcaccgagaacggcgacaagaucaccaugcagcccgccaagaucaucaccauccccgccacccagcuggcccagugccagcugcagaccaagagcaaccugaccggcagcggcagcaucaacaucgugggcaccccccuggccgugagagcccugacccccgugagcaucgcccacggcacccccgugaugagacugagcaugcccacccagcaggccagcggccagaccccccccagagugaucagcgccgugaucaagggccccgaggugaagagcgaggccguggccaagaagcaggagcacgacgugaagacccugcagcugguggaggagaagcccgccgacggcaacaagaccgugacccacguggugguggugagcgcccccagcgccaucgcccugcccgugaccaugaagaccgagggccuggugaccugcgagaaguga

SEQ ID NO: 1412 - RNA, 1566 nt, Artificial Sequence
  derived and/or modified sequence opt5 from ELF2/m__Homo_sapiens__BAH13456
auggccaccagccugcacgagggccccacaaaccagcucgaccugcuuaucagagcuguggaagccuccguccauucuagcaaugcgcacugcacggauaagaccauugaggcugccgaagcccugcuccauauggaguccccuacaugucugcgggacucucgcagcccggaguucauccacgcugccaugagacccgauguuauuaccgaaacagugguggaggucuccaccgaagagucugaaccuauggacacaagccccaucccuaccucccccgauagccaugagccuaugaaaaagaaaaagguggggcggaaaccgaagacgcaacagucucccauuuccaacggaagcccugagcuuggcaucaagaaaaagccccgcgaagggaaaggaaauaccacauaccugugggaguuucuccuggaccugcuccaggauaagaauaccugcccuagauauaucaaauggacacagcgggaaaagggcauuuucaagcugguugacucuaaagcuguguccaaacuuugggggaaacacaagaacaaacccgauaugaacuacgagaccaugggacgcgcccugagauauuacuaucaacggggcauccucgcgaaggucgaaggccagcgccugguguaccaguuuaaagacaugccgaagaauauuguugugaucgaugacgauaagagcgagacguguaacgaggaccuugccgggacaaccgacgaaaaaucucuggagagagucucccucagcgcugaaucccugcugaaggccgcuucuagcgugcgguccggaaagaauagcucuccuauuaacugcucccgcgccgagaagggcguggcgagagucguuaauaucacaagccccgggcacgaugccucuagccgguccccuaccaccacagcuucugugagcgccacggcugcuccccgcaccgugagagucgccaugcaagugcccguugugaugacaucccucggacagaaaauuagcaccgucgccgugcagucuguuaacgcgggcgccccucugaucacauccaccagcccgacgacagcuaccucucccaagguggucauccagaccauuccuacagugaugcccgccuccaccgaaaauggggacaagaucacaaugcagccugccaaaauuaucacgauucccgcuacccaacuugcccagugucagcugcaaacaaagagcaaccucaccggauccggcucuaucaauaucgucggcacaccgcuggcggugcgggcucuuaccccuguuagcauugcccaugggacgcccgugaugagacuguccaugccuacccagcaggccucuggacagacacccccucgcgucaucagcgcugugauuaaaggccccgagguuaaguccgaggccguggcuaaaaagcaagaacacgaugucaagacccuccagcugguggaggaaaaaccggccgacgggaacaagacagugacccauguugucguggugagcgcgccuucugccaucgcucugcccgucacgaugaaaacagagggacucgugaccugcgaaaaguga

SEQ ID NO: 1413 - protein, 269 aa, Artificial Sequence
  EMMPRIN__Homo_sapiens__Q54A51
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1414 - RNA, 810 nt, Artificial Sequence
  EMMPRIN__Homo_sapiens__BAC67168
auggcggcugcgcuguucgugcugcugggauucgcgcugcugggcacccacggagccuccggggcugccggcacagucuucacuaccguagaagaccuuggcuccaagauacuccucaccugcuccuugaaugacagcgccacagaggucacagggcaccgcuggcugaaggggggcguggugcugaaggaggacgcgcugcccggccagaaaacggaguucaagguggacuccgacgaccaguggggagaguacuccugcgucuuccuccccgagcccaugggcacggccaacauccagcuccacgggccucccagagugaaggcugugaagucgucagaacacaucaacgagggggagacggccaugcuggucugcaagucagaguccgugccaccugucacugacugggccugguacaagaucacugacucugaggacaaggcccucaugaacggcuccgagagcagguucuucgugaguuccucgcagggccggucagagcuacacauugagaaccugaacauggaggccgaccccggccaguaccggugcaacggcaccagcuccaagggcuccgaccaggccaucaucacgcuccgcgugcgcagccaccuggccgcccucuggcccuuccugggcaucguggcugaggugcuggugcuggucaccaucaucuucaucuacgagaagcgccggaagcccgaggacguccuggaugaugacgacgccggcucugcaccccugaagagcagcgggcagcaccagaaugacaaaggcaagaacguccgccagaggaacucuuccuga

SEQ ID NO: 1415 - RNA, 810 nt, Artificial Sequence
  derived and/or modified sequence opt1 from EMMPRIN__Homo_sapiens__BAC67168
auggccgccgcccuguucgugcuccugggcuucgcccugcucgggacccacggcgccagcggggccgccggcaccgucuucacgaccguggaggaccugggguccaagauccugcugaccugcagccucaacgacuccgcgaccgaggugacgggccaccgcuggcugaagggcggggucgugcucaaggaggacgcccugcccggccagaagaccgaguucaagguggacagcgacgaccaguggggcgaguacuccugcgucuuccugccggagcccauggggaccgccaacauccagcuccacgggccgccccgggugaaggccgucaagagcuccgagcacaucaacgagggcgagaccgcgaugcuggugugcaagagcgaguccgugccgcccgugacggacugggccugguacaagaucaccgacagcgaggacaaggcccugaugaacggcuccgagagccgcuucuucgucuccagcucccaggggcggagcgagcuccacaucgagaaccugaacauggaggccgaccccggccaguaccgcugcaacgggaccuccagcaagggcuccgaccaggccaucaucacccugcgggugcgcagccaccucgcggcccuguggcccuuccugggcaucguggccgagguccucgugcuggugacgaucaucuucaucuacgagaagcggcgcaagcccgaggacguccuggacgacgacgacgccgggagcgcgccccucaaguccagcggccagcaccagaacgacaaggggaagaacgugcggcagcgcaacuccagcuga

SEQ ID NO: 1416 - RNA, 810 nt, Artificial Sequence
  derived and/or modified sequence opt2 from EMMPRIN__Homo_sapiens__BAC67168
auggccgccgcccucuucguccuccucggcuucgcccuccucggcacccacggcgccuccggcgccgccggcaccgucuucaccaccgucgaggaccucggcuccaagauccuccucaccugcucccucaacgacuccgccaccgaggucaccggccaccgcuggcucaagggcggcgucguccucaaggaggacgcccuccccggccagaagaccgaguucaaggucgacuccgacgaccaguggggcgaguacuccugcgucuuccuccccgagcccaugggcaccgccaacauccagcuccacggccccccccgcgucaaggccgucaaguccuccgagcacaucaacgagggcgagaccgccaugcucgucugcaaguccgaguccgucccccccgucaccgacugggccugguacaagaucaccgacuccgaggacaaggcccucaugaacggcuccgagucccgcuucuucgucuccuccucccagggccgcuccgagcuccacaucgagaaccucaacauggaggccgaccccggccaguaccgcugcaacggcaccuccuccaagggcuccgaccaggccaucaucacccuccgcguccgcucccaccucgccgcccucuggcccuuccucggcaucgucgccgagguccucguccucgucaccaucaucuucaucuacgagaagcgccgcaagcccgaggacguccucgacgacgacgacgccggcuccgccccccucaaguccuccggccagcaccagaacgacaagggcaagaacguccgccagcgcaacuccuccuga

SEQ ID NO: 1417 - RNA, 810 nt, Artificial Sequence
  derived and/or modified sequence opt3 from EMMPRIN__Homo_sapiens__BAC67168
auggccgcugcacuguucgugcuccuuggauuugcccuguuggggacccacggagcgagcggugcugccggcacagucuucacuacgguugaggacuuaggguccaagauccugcuaaccugcucucucaacgauucagcaacagaagugacuggacauagauggcugaaaggcgguguagugcuuaaggaggacgcccugcccgggcagaaaaccgaauuuaaggucgauagugacgaucaauggggagaguacagcuguguguucuugccugaaccaaugggcacagcuaauauucagcuccacggcccgcccaggguuaaagcagugaaguccucugagcauauaaacgagggggaaaccgccaugcuggucugcaagucggagucagugccuccaguaacugacugggcuugguauaaaaucacagauagcgaagacaaggcccugaugaauggaagugagucccgguuuuucguuucuagcucccagggucgcucagagcuccacauugaaaacuuaaauauggaggcggaucccggccaguaccgauguaacgggaccaguagcaaaggaucugaccaagcaaucauuacgcugcgugugagaucccaucuugccgcuuuguggccuuuucugggcaucgucgccgaagugcuagugcucgucacuauaaucuucauuuaugagaagaggcggaaaccagaagauguucuggacgaugacgacgcagguucagcuccccuuaagagcagugggcagcaccagaaugauaagggcaaaaacgugcgccagagaaauucuuccuga

SEQ ID NO: 1418 - RNA, 810 nt, Artificial Sequence
  derived and/or modified sequence opt4 from EMMPRIN__Homo_sapiens__BAC67168
auggccgccgcccuguucgugcugcugggcuucgcccugcugggcacccacggcgccagcggcgccgccggcaccguguucaccaccguggaggaccugggcagcaagauccugcugaccugcagccugaacgacagcgccaccgaggugaccggccacagauggcugaagggcggcguggugcugaaggaggacgcccugcccggccagaagaccgaguucaagguggacagcgacgaccaguggggcgaguacagcugcguguuccugcccgagcccaugggcaccgccaacauccagcugcacggcccccccagagugaaggccgugaagagcagcgagcacaucaacgagggcgagaccgccaugcuggugugcaagagcgagagcgugccccccgugaccgacugggccugguacaagaucaccgacagcgaggacaaggcccugaugaacggcagcgagagcagauucuucgugagcagcagccagggcagaagcgagcugcacaucgagaaccugaacauggaggccgaccccggccaguacagaugcaacggcaccagcagcaagggcagcgaccaggccaucaucacccugagagugagaagccaccuggccgcccuguggcccuuccugggcaucguggccgaggugcuggugcuggugaccaucaucuucaucuacgagaagagaagaaagcccgaggacgugcuggacgacgacgacgccggcagcgccccccugaagagcagcggccagcaccagaacgacaagggcaagaacgugagacagagaaacagcagcuga

SEQ ID NO: 1419 - RNA, 810 nt, Artificial Sequence
  derived and/or modified sequence opt5 from EMMPRIN__Homo_sapiens__BAC67168
auggccgccgcccuguucgugcuccugggauuugcgcuucuggggacccacggagcuagcggcgccgccgggacagucuucacgaccguugaggaccucggauccaagauccugcuuacaugcucucugaacgauagcgcuaccgaagugacaggccaucgguggcucaaagggggagugguccugaaggaggacgcccugcccggccagaaaaccgaauuuaagguggauuccgacgaucaauggggcgaguacucuuguguuuuccucccugaaccgauggggacagcuaauauucagcugcacggacccccucgggugaaagccgucaagagcuccgagcauaucaacgagggcgaaaccgcgaugcuugugugcaagucugagagcguucccccugugacggacugggccugguauaaaauuaccgauuccgaagacaaggcucugaugaaugggagcgagucucgcuuuuucgucuccagcucucagggaagauccgagcuccacaucgaaaaccugaauauggaggccgaucccggccaguaccgguguaacgggacaagcucuaaaggauccgaccaagcuauuaucacccuucgcgugagaagccaucuggccgcgcucuggccuuuucugggcaucguggccgaaguccugguucucgugacaauuaucuucauuuaugagaagcggcgcaaaccggaagaugugcuggacgaugacgacgcuggcuccgcuccccuuaagucuagcgggcagcaccagaaugauaagggcaaaaacgucagacagagaaauuccagcuga

SEQ ID NO: 1420 - protein, 314 aa, Artificial Sequence
  EpCam__Homo_sapiens__P16422
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 1421 - RNA, 945 nt, Artificial Sequence
  EpCam__Homo_sapiens__AAA35723
auggcgcccccgcagguccucgcguucgggcuucugcuugccgcggcgacggcgacuuuugccgcagcucaggaagaaugugucugugaaaacuacaagcuggccguaaacugcuuugugaauaauaaucgucaaugccaguguacuucaguuggugcacaaaauacugucauuugcucaaagcuggcugccaaauguuuggugaugaaggcagaaaugaauggcucaaaacuugggagaagagcaaaaccugaaggggcccuccagaacaaugaugggcuuuaugauccugacugcgaugagagcgggcucuuuaaggccaagcagugcaacggcaccuccaugugcuggugugugaacacugcuggggucagaagaacagacaaggacacugaaauaaccugcucugagcgagugagaaccuacuggaucaucauugaacuaaaacacaaagcaagagaaaaaccuuaugauaguaaaaguuugcggacugcacuucagaaggagaucacaacgcguuaucaacuggauccaaaauuuaucacgaguauuuuguaugagaauaauguuaucacuauugaucugguucaaaauucuucucaaaaaacucagaaugauguggacauagcugauguggcuuauuauuuugaaaaagauguuaaaggugaauccuuguuucauucuaagaaaauggaccugacaguaaauggggaacaacuggaucuggauccuggucaaacuuuaauuuauuauguugaugaaaaagcaccugaauucucaaugcagggucuaaaagcugguguuauugcuguuauugugguuguggugauagcaguuguugcuggaauuguugugcugguuauuuccagaaagaagagaauggcaaaguaugagaaggcugagauaaaggagaugggugagaugcauagggaacucaaugcauaa

SEQ ID NO: 1422 - RNA, 945 nt, Artificial Sequence
  derived and/or modified sequence opt1 from EpCam__Homo_sapiens__AAA35723
auggccccgccccaggugcuggccuucggccuccugcuggcggccgccaccgccaccuucgccgcggcccaggaggagugcgucugcgagaacuacaagcucgccgugaacugcuucgugaacaacaaccgccagugccagugcacgagcgucggggcccagaacaccgugaucugcuccaagcuggcggccaagugccuggugaugaaggccgagaugaacggcagcaagcucgggcggcgcgccaagcccgagggcgcccugcagaacaacgacgggcuguacgaccccgacugcgacgaguccggccucuucaaggcgaagcagugcaacggcaccagcaugugcuggugcgucaacaccgccggggugcggcgcacggacaaggacaccgagaucacgugcuccgagcgggugcgcaccuacuggaucaucaucgagcugaagcacaaggcccgggagaagcccuacgacagcaagucccugcgcaccgcccuccagaaggagaucaccacccgguaccagcuggacccgaaguucaucaccagcauccuguacgagaacaacgucaucacgaucgaccucgugcagaacuccagccagaagacccagaacgacguggacaucgccgacgucgcguacuacuucgagaaggacgugaagggcgagucccuguuccacagcaagaagauggaccugaccgugaacggggagcagcucgaccuggaccccggccagacccugaucuacuacgucgacgagaaggcccccgaguucuccaugcaggggcucaaggccggcgugaucgccgugaucgucgugguggucaucgccgugguggcgggcaucgucgugcuggucaucagccgcaagaagcggauggccaaguacgagaaggccgagaucaaggagaugggggagaugcaccgcgagcugaacgccuga

SEQ ID NO: 1423 - RNA, 945 nt, Artificial Sequence
  derived and/or modified sequence opt2 from EpCam__Homo_sapiens__AAA35723
auggcccccccccagguccucgccuucggccuccuccucgccgccgccaccgccaccuucgccgccgcccaggaggagugcgucugcgagaacuacaagcucgccgucaacugcuucgucaacaacaaccgccagugccagugcaccuccgucggcgcccagaacaccgucaucugcuccaagcucgccgccaagugccucgucaugaaggccgagaugaacggcuccaagcucggccgccgcgccaagcccgagggcgcccuccagaacaacgacggccucuacgaccccgacugcgacgaguccggccucuucaaggccaagcagugcaacggcaccuccaugugcuggugcgucaacaccgccggcguccgccgcaccgacaaggacaccgagaucaccugcuccgagcgcguccgcaccuacuggaucaucaucgagcucaagcacaaggcccgcgagaagcccuacgacuccaagucccuccgcaccgcccuccagaaggagaucaccacccgcuaccagcucgaccccaaguucaucaccuccauccucuacgagaacaacgucaucaccaucgaccucguccagaacuccucccagaagacccagaacgacgucgacaucgccgacgucgccuacuacuucgagaaggacgucaagggcgagucccucuuccacuccaagaagauggaccucaccgucaacggcgagcagcucgaccucgaccccggccagacccucaucuacuacgucgacgagaaggcccccgaguucuccaugcagggccucaaggccggcgucaucgccgucaucgucgucgucgucaucgccgucgucgccggcaucgucguccucgucaucucccgcaagaagcgcauggccaaguacgagaaggccgagaucaaggagaugggcgagaugcaccgcgagcucaacgccuga

SEQ ID NO: 1424 - RNA, 945 nt, Artificial Sequence
  derived and/or modified sequence opt3 from EpCam__Homo_sapiens__AAA35723
auggcucccccucaggugcuggccuucggccuccuucuggcagccgcgaccgcuacauuugccgcagcccaagaggaaugcgucugugagaacuacaaguuggcuguuaauugcuucgugaacaauaacagacagugucagugcacuagcguaggggcacagaauacggugaucuguuccaaauuagccgcuaagugccuggucaugaaagccgaaaugaacggaucuaagcuagguaggcgggcgaaaccagagggcgcacuccaaaauaacgacgggcuguaugauccggacugugaugaaucaggacuuuuuaaggccaagcagugcaauggcaccaguauguguuggugcgugaacacagcugguguucgccgaacugacaaagauaccgagauuacauguagcgagcgugugagaaccuacuggauaaucauugaacugaagcacaaagccagggagaagcccuaugacuccaaaucuuugcggacugcacuccagaaggaaaucacaacccgcuaccagcuggauccuaaguucauuacgucgauccuguaugagaauaacgucauaacuaucgaccucgugcaaaauucaagccagaaaacccagaacgauguagacauugcugauguugccuacuauuuugagaaggacgugaaaggggaaaguuuauuccauuccaagaaaauggaucugacagucaauggagagcagcuugacuuggacccaggccaaacucugaucuacuacguggaugaaaaggcgcccgaguuuucuaugcagggccuaaaagccggggugauugcagucaucguugugguagugauagcugucguggccggaauuguugugcucgucaucagcagaaagaagaggauggcuaaauaugaaaaggccgagauuaaagagaugggugaaaugcaccgggagcugaacgcauga

SEQ ID NO: 1425 - RNA, 945 nt, Artificial Sequence
  derived and/or modified sequence opt4 from EpCam__Homo_sapiens__AAA35723
auggcccccccccaggugcuggccuucggccugcugcuggccgccgccaccgccaccuucgccgccgcccaggaggagugcgugugcgagaacuacaagcuggccgugaacugcuucgugaacaacaacagacagugccagugcaccagcgugggcgcccagaacaccgugaucugcagcaagcuggccgccaagugccuggugaugaaggccgagaugaacggcagcaagcugggcagaagagccaagcccgagggcgcccugcagaacaacgacggccuguacgaccccgacugcgacgagagcggccuguucaaggccaagcagugcaacggcaccagcaugugcuggugcgugaacaccgccggcgugagaagaaccgacaaggacaccgagaucaccugcagcgagagagugagaaccuacuggaucaucaucgagcugaagcacaaggccagagagaagcccuacgacagcaagagccugagaaccgcccugcagaaggagaucaccaccagauaccagcuggaccccaaguucaucaccagcauccuguacgagaacaacgugaucaccaucgaccuggugcagaacagcagccagaagacccagaacgacguggacaucgccgacguggccuacuacuucgagaaggacgugaagggcgagagccuguuccacagcaagaagauggaccugaccgugaacggcgagcagcuggaccuggaccccggccagacccugaucuacuacguggacgagaaggcccccgaguucagcaugcagggccugaaggccggcgugaucgccgugaucguggugguggugaucgccgugguggccggcaucguggugcuggugaucagcagaaagaagagaauggccaaguacgagaaggccgagaucaaggagaugggcgagaugcacagagagcugaacgccuga

SEQ ID NO: 1426 - RNA, 945 nt, Artificial Sequence
  derived and/or modified sequence opt5 from EpCam__Homo_sapiens__AAA35723
auggcucccccucaggugcuggccuucggccuccugcuugccgcggcuaccgccacauuugccgcugcccaagaggaaugcgucugugagaacuacaagcuggcuguuaauugcuucgugaacaauaacagacagugucagugcacgagcgugggggcccagaauaccgucaucuguuccaaacucgcggccaagugccuggugaugaaagcugaaaugaacggaucuaaacuuggccggcgcgccaagccggagggggcucugcaaaauaacgacggacucuaugaucccgacugugaugaaagcggccuguuuaaggccaagcagugcaaugggacauccauguguuggugcguuaacaccgcgggagugagacggacagacaaagauaccgagauuacauguucugagcgcgucagaaccuacuggaucauuaucgaacugaagcacaaagcccgggagaagccuuaugacagcaaaucccuccgcacggcucugcagaaggaaauuaccacaagauaccagcuugaucccaaguucaucaccucuauccuguaugagaauaacgugauuacaaucgaccucguucaaaauagcucccagaaaacccagaacgauguggacauugccgaugucgcuuacuauuuugagaaggacgugaaaggcgaaagccuguuccauucuaagaaaauggaucuuacggugaauggcgagcagcuggaccucgacccugggcaaacacugaucuacuacgucgaugaaaaggcccccgaguuuuccaugcagggacugaaagccggcguuauugcugugaucguggucgugguuauugcgguggucgccgggaucgugguucucgugaucagccggaagaagcgcauggcuaaauaugaaaaggccgagauuaaagagaugggagaaaugcacagagagcugaacgccuga

SEQ ID NO: 1427 - protein, 976 aa, Artificial Sequence
  EphA2__Homo_sapiens__P29317
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 1428 - RNA, 2931 nt, Artificial Sequence
  EphA2__Homo_sapiens__CCDS169.1
auggagcuccaggcagcccgcgccugcuucgcccugcuguggggcugugcgcuggccgcggccgcggcggcgcagggcaaggaagugguacugcuggacuuugcugcagcuggaggggagcucggcuggcucacacacccguauggcaaagggugggaccugaugcagaacaucaugaaugacaugccgaucuacauguacuccgugugcaacgugaugucuggcgaccaggacaacuggcuccgcaccaacuggguguaccgaggagaggcugagcguaucuucauugagcucaaguuuacuguacgugacugcaacagcuucccugguggcgccagcuccugcaaggagacuuucaaccucuacuaugccgagucggaccuggacuacggcaccaacuuccagaagcgccuguucaccaagauugacaccauugcgcccgaugagaucaccgucagcagcgacuucgaggcacgccacgugaagcugaacguggaggagcgcuccguggggccgcucacccgcaaaggcuucuaccuggccuuccaggauaucggugccuguguggcgcugcucuccguccgugucuacuacaagaagugccccgagcugcugcagggccuggcccacuucccugagaccaucgccggcucugaugcaccuucccuggccacuguggccggcaccuguguggaccaugccguggugccaccggggggugaagagccccguaugcacugugcaguggauggcgaguggcuggugcccauugggcagugccugugccaggcaggcuacgagaagguggaggaugccugccaggccugcucgccuggauuuuuuaaguuugaggcaucugagagccccugcuuggagugcccugagcacacgcugccauccccugagggugccaccuccugcgagugugaggaaggcuucuuccgggcaccucaggacccagcgucgaugccuugcacacgaccccccuccgccccacacuaccucacagccgugggcaugggugccaagguggagcugcgcuggacgcccccucaggacagcgggggccgcgaggacauugucuacagcgucaccugcgaacagugcuggcccgagucuggggaaugcgggccgugugaggccagugugcgcuacucggagccuccucacggacugacccgcaccagugugacagugagcgaccuggagccccacaugaacuacaccuucaccguggaggcccgcaauggcgucucaggccugguaaccagccgcagcuuccguacugccagugucagcaucaaccagacagagccccccaaggugaggcuggagggccgcagcaccaccucgcuuagcgucuccuggagcauccccccgccgcagcagagccgaguguggaaguacgaggucacuuaccgcaagaagggagacuccaacagcuacaaugugcgccgcaccgaggguuucuccgugacccuggacgaccuggccccagacaccaccuaccugguccaggugcaggcacugacgcaggagggccagggggccggcagcaaggugcacgaauuccagacgcuguccccggagggaucuggcaacuuggcggugauuggcggcguggcugucggugugguccugcuucuggugcuggcaggaguuggcuucuuuauccaccgcaggaggaagaaccagcgugcccgccaguccccggaggacguuuacuucuccaagucagaacaacugaagccccugaagacauacguggacccccacacauaugaggaccccaaccaggcuguguugaaguucacuaccgagauccauccauccugugucacucggcagaaggugaucggagcaggagaguuuggggagguguacaagggcaugcugaagacauccucggggaagaaggaggugccgguggccaucaagacgcugaaagccggcuacacagagaagcagcgaguggacuuccucggcgaggccggcaucaugggccaguucagccaccacaacaucauccgccuagagggcgucaucuccaaauacaagcccaugaugaucaucacugaguacauggagaauggggcccuggacaaguuccuucgggagaaggauggcgaguucagcgugcugcagcuggugggcaugcugcggggcaucgcagcuggcaugaaguaccuggccaacaugaacuaugugcaccgugaccuggcugcccgcaacauccucgucaacagcaaccuggucugcaaggugucugacuuuggccugucccgcgugcuggaggacgaccccgaggccaccuacaccaccaguggcggcaagauccccauccgcuggaccgccccggaggccauuuccuaccggaaguucaccucugccagcgacguguggagcuuuggcauugucaugugggaggugaugaccuauggcgagcggcccuacugggaguuguccaaccacgaggugaugaaagccaucaaugauggcuuccggcuccccacacccauggacugccccuccgccaucuaccagcucaugaugcagugcuggcagcaggagcgugcccgccgccccaaguucgcugacaucgucagcauccuggacaagcucauucgugccccugacucccucaagacccuggcugacuuugacccccgcgugucuauccggcuccccagcacgagcggcucggagggggugcccuuccgcacgguguccgaguggcuggaguccaucaagaugcagcaguauacggagcacuucauggcggccggcuacacugccaucgagaagguggugcagaugaccaacgacgacaucaagaggauuggggugcggcugcccggccaccagaagcgcaucgccuacagccugcugggacucaaggaccaggugaacacuguggggauccccaucuga

SEQ ID NO: 1429 - RNA, 2931 nt, Artificial Sequence
  derived and/or modified sequence opt1 from EphA2__Homo_sapiens__CCDS169.1
auggagcugcaggccgcccgcgcgugcuucgcccuccuguggggcugcgcccuggccgccgcggccgccgcccaggggaaggaggugguccuccuggacuucgcggccgccggcggggagcugggcuggcucacccaccccuacgggaagggcugggaccugaugcagaacaucaugaacgacaugccgaucuacauguacagcgugugcaacgugauguccggcgaccaggacaacuggcugcggaccaacugggucuaccgcggggaggccgagcggaucuucaucgagcucaaguucacggugcgcgacugcaacagcuuccccggcggggccuccagcugcaaggagaccuucaaccuguacuacgcggaguccgaccuggacuacggcaccaacuuccagaagcgccucuucaccaagaucgacacgaucgcccccgacgagaucaccgugagcuccgacuucgaggcccgccacgucaagcugaacguggaggagcggagcguggggccccugacccgcaagggcuucuaccucgccuuccaggacaucggcgccugcgucgcgcugcuguccgugcggguguacuacaagaagugcccggagcuccugcaggggcuggcccacuuccccgagaccaucgccggcagcgacgcccccucccucgccacggucgcggggaccugcguggaccacgccguggugcccccgggcggcgaggagccccgcaugcacugcgccguggacggggaguggcuggugcccaucggccagugccugugccaggccggguacgagaaggucgaggacgccugccaggcgugcagccccggcuucuucaaguucgaggccuccgagagcccgugccucgagugccccgagcacacccugcccucccccgagggggccaccagcugcgagugcgaggagggcuucuuccgggccccgcaggaccccgcguccaugcccugcacgcggcccccgagcgcgccccacuaccugaccgccgugggcaugggggccaagguggagcuccgguggaccccgccccaggacuccggcgggcgcgaggacaucgucuacagcgugaccugcgagcagugcuggcccgagagcggcgagugcgggcccugcgaggccuccgugcgguacagcgagccgccccacggccugacgcgcaccuccgucaccgugagcgaccuggagccccacaugaacuacaccuucacggucgaggcccggaacggcguguccgggcucgugaccagccgcuccuuccggaccgccagcgucuccaucaaccagaccgagccgcccaaggugcgccuggagggccggagcacgaccucccugagcguguccuggagcaucccgccgccccagcagucccgcgucuggaaguacgaggugaccuaccgcaagaagggggacagcaacuccuacaacgugcggcgcaccgagggcuucagcgucacgcucgacgaccuggcccccgacaccaccuaccugguccaggugcaggcccucacccaggaggggcagggcgccggcuccaagguccacgaguuccagacgcugagccccgaggggagcggcaaccuggcggugaucgggggcguggccgucggcguggugcuccugcugguccucgccggggugggcuucuucauccaccggcgccggaagaaccagcgcgcccggcagucccccgaggacguguacuucagcaaguccgagcagcugaagccccugaagaccuacgucgacccccacaccuacgaggaccccaaccaggccgugcucaaguucaccacggagauccaccccagcugcgugacccgccagaaggucaucggggcgggcgaguucggggagguguacaagggcaugcugaagaccuccagcggcaagaaggaggugcccgucgccaucaagacccugaaggccggguacaccgagaagcagcggguggacuuccucggcgaggccgggaucaugggccaguucucccaccacaacaucauccgccuggagggggugaucagcaaguacaagcccaugaugaucaucacggaguacauggagaacggcgcgcuggacaaguuccugcgggagaaggacggcgaguucuccguccuccagcugguggggaugcugcgcggcaucgccgccgggaugaaguaccucgccaacaugaacuacgugcaccgggaccuggccgcgcgcaacauccuggucaacagcaaccucgugugcaagguguccgacuucggccugagccggguccuggaggacgacccggaggccaccuacaccaccuccgggggcaagauccccauccgcuggacggcccccgaggccaucagcuaccggaaguucaccuccgccagcgacgugugguccuucggcaucgugaugugggaggucaugaccuacggggagcgccccuacugggagcucagcaaccacgaggugaugaaggcgaucaacgacggcuuccggcugccgacccccauggacugccccagcgccaucuaccagcugaugaugcagugcuggcagcaggagcgcgcccgccggcccaaguucgccgacaucguguccauccucgacaagcugauccgcgccccggacagccugaagacgcucgcggacuucgacccccgggucuccauccgccugcccagcaccuccgggagcgagggcgugcccuuccggaccguguccgaguggcuggagagcaucaagaugcagcaguacaccgagcacuucauggccgccggguacacggccaucgagaaggucgugcagaugaccaacgacgacaucaagcgcaucggcgugcggcucccgggccaccagaagcgcaucgcguacucccugcuggggcucaaggaccaggucaacaccgugggcauccccaucuga

SEQ ID NO: 1430 - RNA, 2931 nt, Artificial Sequence
  derived and/or modified sequence opt2 from EphA2__Homo_sapiens__CCDS169.1
auggagcuccaggccgcccgcgccugcuucgcccuccucuggggcugcgcccucgccgccgccgccgccgcccagggcaaggaggucguccuccucgacuucgccgccgccggcggcgagcucggcuggcucacccaccccuacggcaagggcugggaccucaugcagaacaucaugaacgacaugcccaucuacauguacuccgucugcaacgucauguccggcgaccaggacaacuggcuccgcaccaacugggucuaccgcggcgaggccgagcgcaucuucaucgagcucaaguucaccguccgcgacugcaacuccuuccccggcggcgccuccuccugcaaggagaccuucaaccucuacuacgccgaguccgaccucgacuacggcaccaacuuccagaagcgccucuucaccaagaucgacaccaucgcccccgacgagaucaccgucuccuccgacuucgaggcccgccacgucaagcucaacgucgaggagcgcuccgucggcccccucacccgcaagggcuucuaccucgccuuccaggacaucggcgccugcgucgcccuccucuccguccgcgucuacuacaagaagugccccgagcuccuccagggccucgcccacuuccccgagaccaucgccggcuccgacgcccccucccucgccaccgucgccggcaccugcgucgaccacgccgucgucccccccggcggcgaggagccccgcaugcacugcgccgucgacggcgaguggcucguccccaucggccagugccucugccaggccggcuacgagaaggucgaggacgccugccaggccugcucccccggcuucuucaaguucgaggccuccgagucccccugccucgagugccccgagcacacccuccccucccccgagggcgccaccuccugcgagugcgaggagggcuucuuccgcgccccccaggaccccgccuccaugcccugcacccgcccccccuccgccccccacuaccucaccgccgucggcaugggcgccaaggucgagcuccgcuggacccccccccaggacuccggcggccgcgaggacaucgucuacuccgucaccugcgagcagugcuggcccgaguccggcgagugcggccccugcgaggccuccguccgcuacuccgagcccccccacggccucacccgcaccuccgucaccgucuccgaccucgagccccacaugaacuacaccuucaccgucgaggcccgcaacggcgucuccggccucgucaccucccgcuccuuccgcaccgccuccgucuccaucaaccagaccgagccccccaagguccgccucgagggccgcuccaccaccucccucuccgucuccugguccaucccccccccccagcagucccgcgucuggaaguacgaggucaccuaccgcaagaagggcgacuccaacuccuacaacguccgccgcaccgagggcuucuccgucacccucgacgaccucgcccccgacaccaccuaccucguccagguccaggcccucacccaggagggccagggcgccggcuccaagguccacgaguuccagacccucucccccgagggcuccggcaaccucgccgucaucggcggcgucgccgucggcgucguccuccuccucguccucgccggcgucggcuucuucauccaccgccgccgcaagaaccagcgcgcccgccagucccccgaggacgucuacuucuccaaguccgagcagcucaagccccucaagaccuacgucgacccccacaccuacgaggaccccaaccaggccguccucaaguucaccaccgagauccaccccuccugcgucacccgccagaaggucaucggcgccggcgaguucggcgaggucuacaagggcaugcucaagaccuccuccggcaagaaggagguccccgucgccaucaagacccucaaggccggcuacaccgagaagcagcgcgucgacuuccucggcgaggccggcaucaugggccaguucucccaccacaacaucauccgccucgagggcgucaucuccaaguacaagcccaugaugaucaucaccgaguacauggagaacggcgcccucgacaaguuccuccgcgagaaggacggcgaguucuccguccuccagcucgucggcaugcuccgcggcaucgccgccggcaugaaguaccucgccaacaugaacuacguccaccgcgaccucgccgcccgcaacauccucgucaacuccaaccucgucugcaaggucuccgacuucggccucucccgcguccucgaggacgaccccgaggccaccuacaccaccuccggcggcaagauccccauccgcuggaccgcccccgaggccaucuccuaccgcaaguucaccuccgccuccgacgucugguccuucggcaucgucaugugggaggucaugaccuacggcgagcgccccuacugggagcucuccaaccacgaggucaugaaggccaucaacgacggcuuccgccuccccacccccauggacugccccuccgccaucuaccagcucaugaugcagugcuggcagcaggagcgcgcccgccgccccaaguucgccgacaucgucuccauccucgacaagcucauccgcgcccccgacucccucaagacccucgccgacuucgacccccgcgucuccauccgccuccccuccaccuccggcuccgagggcguccccuuccgcaccgucuccgaguggcucgaguccaucaagaugcagcaguacaccgagcacuucauggccgccggcuacaccgccaucgagaaggucguccagaugaccaacgacgacaucaagcgcaucggcguccgccuccccggccaccagaagcgcaucgccuacucccuccucggccucaaggaccaggucaacaccgucggcauccccaucuga

SEQ ID NO: 1431 - RNA, 2931 nt, Artificial Sequence
  derived and/or modified sequence opt3 from EphA2__Homo_sapiens__CCDS169.1
auggagcugcaggccgcuagagcaugcuucgcccuccuuuggggcugugcgcuggcugccgcagccgcugcacaagggaaggaaguggucuuguuagacuuugccgcugccggaggugagcugggcuggcuaacccaccccuacgggaaaggaugggaucucaugcagaacaucaugaaugacaugccuauuuauauguacagcguuugcaacgugauguccggcgaucaggacaauuggcugaggacaaacuggguauaucggggugaagcggagcgcauauucaucgaacuuaaguuuacugugcgagauuguaauucuuucccagggggagcaucaaguugcaaagagacguuuaaccuguacuaugccgagagcgacuuggauuacggcaccaauuuccagaagcgucucuuuacaaaaauugacacuaucgcuccggaugaaauuaccgucuccucugacuucgaggccagacaugugaagcugaacguugaagagaggucggugggcccccugacacggaagggguuuuaucucgcauuccaagauaucggagcuugugucgccuuacugucagugcgcguauacuacaaaaagugcccugagcuuuugcagggucuggcgcacuuuccagaaaccauagccggcagcgacgcacccagucuagcuacuguugccgggacauguguggaucaugcugucgugccuccaggaggcgaggaacccagaaugcacugcgccguggacggugaguggcucgucccuaucgggcagugucugugccaggcaggauaugaaaaaguugaggacgccugucaagccugcuccccaggcuucuuuaaguucgaggcgucugaaagcccgugccuugagugucccgaacauacccugccuuccccagagggcgcaacgucaugcgaaugugaggagggguucuuuagggcuccccaggauccugcuaguaugccaugcacucggcccccgagcgccccucacuacuugaccgcagugggaaugggugccaaaguagaacuccgcuggacacccccacaggacucuggcgggcgagaggauauuguguauuccgucacuugugaacagugcuggccugagucaggagaauguggccccugcgaggcuagcgugagauacagugagccaccccacggucugaccaggacaucuguuaccguguccgacuuagaaccucauaugaauuauacguucacugucgaggcccggaacggggugagcggccugguaacaucgcguucuuuucgcaccgcauccguuucaaucaaucaaacugaaccaccgaaggugagacucgagggaaggaguacaaccagccuuuccgucucuuggagcauucccccuccacagcagucacggguguggaaguacgaggucacguaucgcaaaaagggcgauaguaacuccuacaaugugcgaagaaccgaaggguucagcguuacacuggacgauuuggcgcccgacacuaccuaccuagugcaaguacaggcucugacacaggagggacagggugccggcucuaaaguccacgaauuucaaacucucucaccugaggggaguggaaaccuggcagugaucggcgguguugccgugggggucgugcuucuguugguacucgcuggcgugggauucuuuauacauaggcggcgcaagaaucagagagccaggcagagcccagaagauguuuauuucuccaaaucugagcagcugaagcccuuaaaaaccuacgucgacccgcacacauaugaggauccuaaccaagcagugcugaaguuuaccacugaaauucacccaucgugugugacgcgucagaaggucaucggcgcuggggaguucggagaaguuuacaaagguaugcuaaagacaagcuccggcaaaaaggaggugcccguggccauuaaaacccucaaggcgggguauacugaaaagcagcggguagacuuucugggagaggccggcaucaugggucaguucucacaucacaacaucauucgacuugagggggucauaaguaaauacaagccuaugaugaucauuaccgaauauauggagaauggcgcuuuggacaaauuucugagagaaaaggauggagaguucucugugcuccaacugguuggcaugcuuagggggaucgcagccggaaugaaauaccuggcuaacaugaauuacgugcaucgcgacuuggccgcacggaacauacucgucaauagcaaccuggugugcaagguuuccgauuucggcuuaucaagagugcuggaagacgaucccgaggcgacauauaccacuagcggugggaagauuccaaucagguggacagccccugaggcuaucucuuaccgcaaauuuacguccgccagugacguauggagcuucggaauugucaugugggaagugaugaccuauggcgagcgacccuacugggaacuaucuaaucacgaggugaugaaggcaaucaacgaugguuuucggcucccaacuccgauggacuguccuuccgcuauuuaucagcugaugaugcagugcuggcagcaagagcgugccagaaggcccaaauucgcagauauagucucaauccuugacaaguugauucgcgccccagauagucugaaaacacucgcugacuuugauccccggguuagcaucagacugccuucgaccuccggcucugaaggggugccauucaggacaguaagcgagugguuagaaucaaucaagaugcagcaguacacugagcauuuuauggcggccggauauaccgcaauugaaaaggugguccaaaugacgaaugacgacauaaaacgaaucggcgugcgccugcccgggcaccagaagcggauugcuuacagucuuuugggacucaaagaucagguuaacaccgugggcaucccuauuuga

SEQ ID NO: 1432 - RNA, 2931 nt, Artificial Sequence
  derived and/or modified sequence opt4 from EphA2__Homo_sapiens__CCDS169.1
auggagcugcaggccgccagagccugcuucgcccugcuguggggcugcgcccuggccgccgccgccgccgcccagggcaaggagguggugcugcuggacuucgccgccgccggcggcgagcugggcuggcugacccaccccuacggcaagggcugggaccugaugcagaacaucaugaacgacaugcccaucuacauguacagcgugugcaacgugaugagcggcgaccaggacaacuggcugagaaccaacuggguguacagaggcgaggccgagagaaucuucaucgagcugaaguucaccgugagagacugcaacagcuuccccggcggcgccagcagcugcaaggagaccuucaaccuguacuacgccgagagcgaccuggacuacggcaccaacuuccagaagagacuguucaccaagaucgacaccaucgcccccgacgagaucaccgugagcagcgacuucgaggccagacacgugaagcugaacguggaggagagaagcgugggcccccugaccagaaagggcuucuaccuggccuuccaggacaucggcgccugcguggcccugcugagcgugagaguguacuacaagaagugccccgagcugcugcagggccuggcccacuuccccgagaccaucgccggcagcgacgcccccagccuggccaccguggccggcaccugcguggaccacgccguggugccccccggcggcgaggagcccagaaugcacugcgccguggacggcgaguggcuggugcccaucggccagugccugugccaggccggcuacgagaagguggaggacgccugccaggccugcagccccggcuucuucaaguucgaggccagcgagagccccugccuggagugccccgagcacacccugcccagccccgagggcgccaccagcugcgagugcgaggagggcuucuucagagccccccaggaccccgccagcaugcccugcaccagaccccccagcgccccccacuaccugaccgccgugggcaugggcgccaagguggagcugagauggacccccccccaggacagcggcggcagagaggacaucguguacagcgugaccugcgagcagugcuggcccgagagcggcgagugcggccccugcgaggccagcgugagauacagcgagcccccccacggccugaccagaaccagcgugaccgugagcgaccuggagccccacaugaacuacaccuucaccguggaggccagaaacggcgugagcggccuggugaccagcagaagcuucagaaccgccagcgugagcaucaaccagaccgagccccccaaggugagacuggagggcagaagcaccaccagccugagcgugagcuggagcaucccccccccccagcagagcagaguguggaaguacgaggugaccuacagaaagaagggcgacagcaacagcuacaacgugagaagaaccgagggcuucagcgugacccuggacgaccuggcccccgacaccaccuaccuggugcaggugcaggcccugacccaggagggccagggcgccggcagcaaggugcacgaguuccagacccugagccccgagggcagcggcaaccuggccgugaucggcggcguggccgugggcguggugcugcugcuggugcuggccggcgugggcuucuucauccacagaagaagaaagaaccagagagccagacagagccccgaggacguguacuucagcaagagcgagcagcugaagccccugaagaccuacguggacccccacaccuacgaggaccccaaccaggccgugcugaaguucaccaccgagauccaccccagcugcgugaccagacagaaggugaucggcgccggcgaguucggcgagguguacaagggcaugcugaagaccagcagcggcaagaaggaggugcccguggccaucaagacccugaaggccggcuacaccgagaagcagagaguggacuuccugggcgaggccggcaucaugggccaguucagccaccacaacaucaucagacuggagggcgugaucagcaaguacaagcccaugaugaucaucaccgaguacauggagaacggcgcccuggacaaguuccugagagagaaggacggcgaguucagcgugcugcagcuggugggcaugcugagaggcaucgccgccggcaugaaguaccuggccaacaugaacuacgugcacagagaccuggccgccagaaacauccuggugaacagcaaccuggugugcaaggugagcgacuucggccugagcagagugcuggaggacgaccccgaggccaccuacaccaccagcggcggcaagauccccaucagauggaccgcccccgaggccaucagcuacagaaaguucaccagcgccagcgacguguggagcuucggcaucgugaugugggaggugaugaccuacggcgagagacccuacugggagcugagcaaccacgaggugaugaaggccaucaacgacggcuucagacugcccacccccauggacugccccagcgccaucuaccagcugaugaugcagugcuggcagcaggagagagccagaagacccaaguucgccgacaucgugagcauccuggacaagcugaucagagcccccgacagccugaagacccuggccgacuucgaccccagagugagcaucagacugcccagcaccagcggcagcgagggcgugcccuucagaaccgugagcgaguggcuggagagcaucaagaugcagcaguacaccgagcacuucauggccgccggcuacaccgccaucgagaagguggugcagaugaccaacgacgacaucaagagaaucggcgugagacugcccggccaccagaagagaaucgccuacagccugcugggccugaaggaccaggugaacaccgugggcauccccaucuga

SEQ ID NO: 1433 - RNA, 2931 nt, Artificial Sequence
  derived and/or modified sequence opt5 from EphA2__Homo_sapiens__CCDS169.1
auggagcugcaggccgcuagagccugcuucgcgcuccuguggggcugugcucuugccgccgcugccgcugcccaagggaaggaagugguccugcucgacuuugcggccgcuggaggcgagcugggguggcuuacccaccccuacggaaaaggcugggaucugaugcagaacaucaugaaugacaugccuauuuauauguacagcguuugcaacgugauguccggggaucaggacaauuggcuccggacaaacuggguguaucgcggagaagccgagagaaucuucauugaacugaaguuuacgguccgggauuguaauucuuucccgggcggcgcuagcuccugcaaagagaccuuuaaccuguacuaugccgagucugaccucgauuacgggacaaauuuccagaagcgccuguuuaccaaaaucgacacaauugcgcccgaugaaaucaccgugagcuccgacuucgaggccagacauguuaaacuuaacguggaagagagaucugucggaccucugacacgcaagggcuuuuaucucgcuuuccaagauaucggggccuguguggcucugcuuagcguuagaguguacuacaaaaagugccccgagcugcuccagggacuggcccacuuuccugaaaccauugccggcuccgacgcucccagccuggcgacggucgccgggaccuguguggaucaugcuguggucccuccgggaggcgaggaaccccggaugcacugcgccguugacggcgaguggcucgugccuaucgggcagugucugugccaggccggauaugaaaaaguggaggacgcuugucaagccugcucucccggcuucuuuaaguucgaggcguccgaaagcccuugccuugagugucccgaacauacacugccgucuccugagggggcuaccuccugcgaaugugaggagggauucuuucgcgcuccccaggauccugccagcaugcccugcacaagacccccuucugccccgcacuaccucaccgccgucggcaugggggcuaaaguggaacugcgguggacgcccccucaggacuccggaggccgcgaggauauuguuuauagcgugacaugugaacagugcuggcccgaguccggcgaaugugggccuugcgaggccucugucagauacagcgagcccccgcacggacuuacccggacauccgugaccguuagcgaccuggaaccucauaugaauuauaccuucacaguggaggcgcgcaacggcgucucugggcucgugacgucccggagcuuucggaccgccucugucagcaucaaucaaacagaacccccuaaggugagacuggagggacgcuccaccacaucucugagcguuuccuggagcauucccccuccccagcagucucggguguggaaguacgaggucaccuauagaaagaagggcgauuccaacagcuacaaugugcgccggacggaaggguucucuguuacacucgacgaucuggcuccggacaccaccuaccuugugcaaguccaggcccugacacaggagggccagggagcuggcuccaaagugcacgaauuucaaacccucagcccugagggguccggaaaccuggccgugaucggcgggguugcggucggaguggugcuucugcucguccuggccggcgugggguucuuuauucauagacgccggaagaaucagagagcucgccagucucccgaagauguuuauuucagcaaauccgagcagcugaagccccucaaaacauacguggacccucacacguaugaggauccgaaccaagccguccugaaguuuaccacagaaauccaccccucuugugugacccggcagaagguuaucggcgcuggagaguucggcgaaguguacaaagggaugcuuaagacaagcuccggcaaaaaggaggucccuguggccauuaaaacccugaaggccggauauacggaaaagcagagaguugacuuucucggggaggcuggaaucaugggccaguucagccaucacaacauuauccgccuggagggggugauuucuaaauacaagcccaugaugaucaucaccgaauauauggagaauggcgcgcuggacaaauuucuucgggaaaaggauggagaguucuccguccuccaacuggugggcaugcugagagggauugccgcuggaaugaaauaccucgccaacaugaauuacgugcaucgggaccuggccgcucgcaacauccuugucaauagcaaccugguuugcaaggugucugauuucggccucuccagagugcuggaagacgauccugaggccacauauaccacaagcgggggaaagauucccauccgguggaccgcgccugaggcuauuucuuacagaaaauuuacgagcgccuccgacgucuggagcuucggcaucgugaugugggaaguuaugacauauggggagcgccccuacugggaacugucuaaucacgaggugaugaaggccaucaacgauggcuuucggcuuccgaccccuauggacugucccuccgcuauuuaucagcucaugaugcagugcuggcagcaagagagagcccgcagaccuaaauucgcggauaucgucagcauucuggacaagcugauccgggcucccgauucccucaaaacacuggccgacuuugauccgcgcgugucuauuagacuuccuagcaccuccggaucugaaggcguucccuuccggaccgugagcgaguggcuggaauccaucaagaugcagcaguacacagagcauuuuauggccgcuggguauacggccauugaaaaggucgugcaaaugaccaaugacgacaucaaacgcaucggaguuagacucccuggccaccagaagcggauugcuuacucucugcuggggcuuaaagaucaggugaacacagucggaauccccauuuga

SEQ ID NO: 1434 - protein, 983 aa, Artificial Sequence
  EphA3__Homo_sapiens__P29320
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 1435 - RNA, 2952 nt, Artificial Sequence
  EphA3__Homo_sapiens__AAG43576
auggauugucagcucuccauccuccuccuucucagcugcucuguucucgacagcuucggggaacugauuccgcagccuuccaaugaagucaaucuacuggauucaaaaacaauucaaggggagcugggcuggaucucuuauccaucacaugggugggaagagaucagugguguggaugaacauuacacacccaucaggacuuaccaggugugcaaugucauggaccacagucaaaacaauuggcugagaacaaacuggguccccaggaacucagcucagaagauuuauguggagcucaaguucacucuacgagacugcaauagcauuccauugguuuuaggaacuugcaaggagacauucaaccuguacuacauggagucugaugaugaucauggggugaaauuucgagagcaucaguuuacaaagauugacaccauugcagcugaugaaaguuucacucaaauggaucuuggggaccguauucugaagcucaacacugagauuagagaaguagguccugucaacaagaagggauuuuauuuggcauuucaagauguuggugcuuguguugccuuggugucugugagaguauacuucaaaaagugcccauuuacagugaagaaucuggcuauguuuccagacacgguacccauggacucccagucccugguggagguuagagggucuugugucaacaauucuaaggaggaagauccuccaaggauguacugcaguacagaaggcgaauggcuuguacccauuggcaaguguuccugcaaugcuggcuaugaagaaagagguuuuaugugccaagcuugucgaccagguuucuacaaggcauuggaugguaauaugaagugugcuaagugcccgccucacaguucuacucaggaagaugguucaaugaacugcaggugugagaauaauuacuuccgggcagacaaagacccuccauccauggcuuguacccgaccuccaucuucaccaagaaauguuaucucuaauauaaacgagaccucaguuauccuggacuggaguuggccccuggacacaggaggccggaaagauguuaccuucaacaucauauguaaaaaauguggguggaauauaaaacagugugagccaugcagcccaaauguccgcuuccucccucgacaguuuggacucaccaacaccacggugacagugacagaccuucuggcacauacuaacuacaccuuugagauugaugccguuaauggggugucagagcugagcuccccaccaagacaguuugcugcggucagcaucacaacuaaucaggcugcuccaucaccuguccugacgauuaagaaagaucggaccuccagaaauagcaucucuuuguccuggcaagaaccugaacauccuaaugggaucauauuggacuacgaggucaaauacuaugaaaagcaggaacaagaaacaaguuauaccauucugagggcaagaggcacaaauguuaccaucaguagccucaagccugacacuauauacguauuccaaauccgagcccgaacagccgcuggauaugggacgaacagccgcaaguuugaguuugaaacuaguccagacucuuucuccaucucuggugaaaguagccaaguggucaugaucgccauuucagcggcaguagcaauuauucuccucacuguugucaucuauguuuugauugggagguucuguggcuauaagucaaaacauggggcagaugaaaaaagacuucauuuuggcaaugggcauuuaaaacuuccaggucucaggacuuauguugacccacauacauaugaagacccuacccaagcuguucaugaguuugccaaggaauuggaugccaccaacauauccauugauaaaguuguuggagcaggugaauuuggagaggugugcaguggucgcuuaaaacuuccuucaaaaaaagagauuucaguggccauuaagacccugaaaguuggcuacacagaaaagcagaggagagacuuccugggagaagcaagcauuaugggacaguuugaccaccccaauaucauucgacuggaaggaguuguuaccaaaaguaagccaguuaugauugucacagaauacauggagaaugguuccuuggauaguuuccuacguaaacacgaugcccaguuuacugucauucagcuaguggggaugcuucgagggauagcaucuggcaugaaguaccugucagacaugggcuauguucaccgagaccucgcugcucggaacaucuugaucaacaguaacuugguguguaagguuucugauuucggacuuucgcguguccuggaggaugacccagaagcugcuuauacaacaagaggagggaagaucccaaucagguggacaucaccagaagcuauagccuaccgcaaguucacgucagccagcgauguauggaguuaugggauuguucucugggaggugaugucuuauggagagagaccauacugggagauguccaaucaggauguaauuaaagcuguagaugagggcuaucgacugccaccccccauggacugcccagcugccuuguaucagcugaugcuggacugcuggcagaaagacaggaacaacagacccaaguuugagcagauuguuaguauucuggacaagcuuauccggaaucccggcagccugaagaucaucaccagugcagccgcaaggccaucaaaccuucuucuggaccaaagcaauguggauaucacuaccuuccgcacaacaggugacuggcuuaauggugucuggacagcacacugcaaggaaaucuucacggguguggaguacaguucuugugacacaauagccaagauuuccacagaugacaugaaaaagguuggugucaccgugguugggccacagaagaagaucaucaguagcauuaaagcucuagaaacgcaaucaaagaauggcccaguucccguguaa

SEQ ID NO: 1436 - RNA, 2952 nt, Artificial Sequence
  derived and/or modified sequence opt1 from EphA3__Homo_sapiens__AAG43576
auggacugccagcugagcauccuccugcugcucuccugcagcgugcuggacuccuucggcgagcugaucccccagccgagcaacgaggucaaccuccuggacuccaagaccauccagggggagcugggcuggaucagcuaccccucccacgggugggaggagaucagcggcguggacgagcacuacacccccauccgcacguaccaggugugcaacgucauggaccacucccagaacaacuggcuccggaccaacugggugccccgcaacagcgcccagaagaucuacguggagcugaaguucacccugcgggacugcaacuccaucccgcucguccuggggaccugcaaggagacguucaaccuguacuacauggagagcgacgacgaccacggcgugaaguuccgcgagcaccaguucaccaagaucgacaccaucgccgcggacgaguccuucacccagauggaccucggcgaccggauccugaagcugaacacggagauccgcgagguggggcccgucaacaagaagggcuucuaccucgccuuccaggacgugggggccugcguggcccuggucagcgugcggguguacuucaagaagugccccuucaccgucaagaaccuggccauguuccccgacaccgugccgauggacucccagagccucguggagguccgcggcuccugcgugaacaacagcaaggaggaggacccgccccggauguacugcuccaccgagggggaguggcuggugcccaucggcaagugcagcugcaacgcgggcuacgaggagcgcggguucaugugccaggccugccggcccggcuucuacaaggcccuggacgggaacaugaagugcgccaagugcccgccccacagcuccacgcaggaggacggcagcaugaacugccgcugcgagaacaacuacuuccgggcggacaaggacccgcccuccauggccugcacccgcccgcccagcagcccccggaacgucaucuccaacaucaacgagaccuccgugauccucgacuggagcuggccccuggacaccggcgggcgcaaggacgugacguucaacaucaucugcaagaagugcggcuggaacaucaagcagugcgagcccugcucccccaacguccgguuccugccccgccaguucgggcucaccaacaccaccgugacggucaccgaccugcuggcccacaccaacuacaccuucgagaucgacgccgugaacggcgugagcgagcucuccagcccgccccggcaguucgccgcggucuccaucacgaccaaccaggccgcccccagccccgugcugaccaucaagaaggaccgcaccucccggaacagcaucucccugagcuggcaggagcccgagcaccccaacgggaucauccucgacuacgaggugaaguacuacgagaagcaggagcaggagacguccuacaccauccugcgcgcccgcggcaccaacgucaccaucagcagccugaagcccgacacgaucuacguguuccagauccgggcccgcaccgcggccggcuacgggaccaacucccggaaguucgaguucgagaccagcccggacuccuucagcaucuccggcgagagcucccagguggucaugaucgccaucagcgccgccguggcgaucauccuccugacgguggucaucuacgugcugaucgggcgcuucugcggcuacaaguccaagcacggggccgacgagaagcggcuccacuucggcaacggccaccugaagcugcccgggcuccgcaccuacguggacccccacaccuacgaggaccccacccaggccguccacgaguucgccaaggagcuggacgccaccaacaucagcaucgacaagguggugggcgcgggggaguucggcgaggucugcuccgggcggcugaagcucccgagcaagaaggagaucuccguggccaucaagacgcugaaggugggcuacaccgagaagcagcgccgggacuuccugggcgaggccagcaucauggggcaguucgaccaccccaacaucauccgccucgagggcgucgugaccaaguccaagcccgugaugaucgucaccgaguacauggagaacgggagccuggacuccuuccugcggaagcacgacgcccaguucacggugauccagcuggugggcaugcuccgcggcaucgcgagcgggaugaaguaccugagcgacaugggcuacguccaccgggaccuggccgcccgcaacauccucaucaacuccaaccuggugugcaaggugagcgacuucgggcugucccggguccucgaggacgaccccgaggccgccuacaccacccgcggcgggaagaucccgauccgguggaccagccccgaggcgaucgccuaccgcaaguucacguccgccagcgacgugugguccuacggcaucgugcugugggaggucaugagcuacggcgagcggcccuacugggagauguccaaccaggacgugaucaaggccguggacgagggguaccgccugcccccgcccauggacugccccgccgcgcucuaccagcugaugcuggacugcuggcagaaggaccgcaacaaccggcccaaguucgagcagaucgucagcauccucgacaagcugauccgcaacccgggcucccugaagaucaucaccagcgccgccgcccggcccuccaaccuccugcuggaccagagcaacguggacaucaccaccuuccgcacgaccggggacuggcucaacggcguguggaccgcccacugcaaggagaucuucaccggggucgaguacuccagcugcgacacgaucgcgaagaucuccaccgacgacaugaagaaggugggcgugaccgucgugggcccccagaagaagaucaucagcuccaucaaggcccuggagacccagagcaagaacgggcccgugccggucuga

SEQ ID NO: 1437 - RNA, 2952 nt, Artificial Sequence
  derived and/or modified sequence opt2 from EphA3__Homo_sapiens__AAG43576
auggacugccagcucuccauccuccuccuccucuccugcuccguccucgacuccuucggcgagcucaucccccagcccuccaacgaggucaaccuccucgacuccaagaccauccagggcgagcucggcuggaucuccuaccccucccacggcugggaggagaucuccggcgucgacgagcacuacacccccauccgcaccuaccaggucugcaacgucauggaccacucccagaacaacuggcuccgcaccaacugggucccccgcaacuccgcccagaagaucuacgucgagcucaaguucacccuccgcgacugcaacuccaucccccucguccucggcaccugcaaggagaccuucaaccucuacuacauggaguccgacgacgaccacggcgucaaguuccgcgagcaccaguucaccaagaucgacaccaucgccgccgacgaguccuucacccagauggaccucggcgaccgcauccucaagcucaacaccgagauccgcgaggucggccccgucaacaagaagggcuucuaccucgccuuccaggacgucggcgccugcgucgcccucgucuccguccgcgucuacuucaagaagugccccuucaccgucaagaaccucgccauguuccccgacaccguccccauggacucccagucccucgucgagguccgcggcuccugcgucaacaacuccaaggaggaggaccccccccgcauguacugcuccaccgagggcgaguggcucguccccaucggcaagugcuccugcaacgccggcuacgaggagcgcggcuucaugugccaggccugccgccccggcuucuacaaggcccucgacggcaacaugaagugcgccaagugccccccccacuccuccacccaggaggacggcuccaugaacugccgcugcgagaacaacuacuuccgcgccgacaaggacccccccuccauggccugcacccgcccccccuccuccccccgcaacgucaucuccaacaucaacgagaccuccgucauccucgacugguccuggccccucgacaccggcggccgcaaggacgucaccuucaacaucaucugcaagaagugcggcuggaacaucaagcagugcgagcccugcucccccaacguccgcuuccucccccgccaguucggccucaccaacaccaccgucaccgucaccgaccuccucgcccacaccaacuacaccuucgagaucgacgccgucaacggcgucuccgagcucuccucccccccccgccaguucgccgccgucuccaucaccaccaaccaggccgcccccucccccguccucaccaucaagaaggaccgcaccucccgcaacuccaucucccucuccuggcaggagcccgagcaccccaacggcaucauccucgacuacgaggucaaguacuacgagaagcaggagcaggagaccuccuacaccauccuccgcgcccgcggcaccaacgucaccaucuccucccucaagcccgacaccaucuacgucuuccagauccgcgcccgcaccgccgccggcuacggcaccaacucccgcaaguucgaguucgagaccucccccgacuccuucuccaucuccggcgaguccucccaggucgucaugaucgccaucuccgccgccgucgccaucauccuccucaccgucgucaucuacguccucaucggccgcuucugcggcuacaaguccaagcacggcgccgacgagaagcgccuccacuucggcaacggccaccucaagcuccccggccuccgcaccuacgucgacccccacaccuacgaggaccccacccaggccguccacgaguucgccaaggagcucgacgccaccaacaucuccaucgacaaggucgucggcgccggcgaguucggcgaggucugcuccggccgccucaagcuccccuccaagaaggagaucuccgucgccaucaagacccucaaggucggcuacaccgagaagcagcgccgcgacuuccucggcgaggccuccaucaugggccaguucgaccaccccaacaucauccgccucgagggcgucgucaccaaguccaagcccgucaugaucgucaccgaguacauggagaacggcucccucgacuccuuccuccgcaagcacgacgcccaguucaccgucauccagcucgucggcaugcuccgcggcaucgccuccggcaugaaguaccucuccgacaugggcuacguccaccgcgaccucgccgcccgcaacauccucaucaacuccaaccucgucugcaaggucuccgacuucggccucucccgcguccucgaggacgaccccgaggccgccuacaccacccgcggcggcaagauccccauccgcuggaccucccccgaggccaucgccuaccgcaaguucaccuccgccuccgacgucugguccuacggcaucguccucugggaggucauguccuacggcgagcgccccuacugggagauguccaaccaggacgucaucaaggccgucgacgagggcuaccgccuccccccccccauggacugccccgccgcccucuaccagcucaugcucgacugcuggcagaaggaccgcaacaaccgccccaaguucgagcagaucgucuccauccucgacaagcucauccgcaaccccggcucccucaagaucaucaccuccgccgccgcccgccccuccaaccuccuccucgaccaguccaacgucgacaucaccaccuuccgcaccaccggcgacuggcucaacggcgucuggaccgcccacugcaaggagaucuucaccggcgucgaguacuccuccugcgacaccaucgccaagaucuccaccgacgacaugaagaaggucggcgucaccgucgucggcccccagaagaagaucaucuccuccaucaaggcccucgagacccaguccaagaacggccccguccccgucuga

SEQ ID NO: 1438 - RNA, 2952 nt, Artificial Sequence
  derived and/or modified sequence opt3 from EphA3__Homo_sapiens__AAG43576
auggacugccagcugagcauccuccuucuguuguccuguucuguguuagauucauucggcgagcugauuccccaaccuaguaacgaagucaaucuacucgacagcaagaccauacagggggagcugggauggaucuccuacccaucucacgguugggaagagauuucgggcguugaugaacauuauacaccgaucagaacuuaccaggugugcaacguaauggaccacucacagaauaacuggcuuaggacgaauugggugccccggaacagcgcccagaaaauuuaugucgagcugaaguuuaccuugcgcgauuguaauaguaucccucucgugcuggggacaugcaaagagacuuucaaccuguacuauauggaauccgacgaugaccauggaguuaaguuucgagagcaccaauucaccaaaauagauacaaucgcugcagacgaaucuuuuacccagauggaucucggcgaccguauuuuaaagcugaauacugagaucagagagguggguccagucaacaagaaaggguucuaccuugccuuucaggaugugggagcguguguagcuuugguuagcgugagggucuauuucaagaaaugccccuuuacagugaagaaucuggccauguucccugacaccgugccaauggacucccaaagucuagucgaaguucggggcucaugugugaacaauagcaaagaggaagaucccccucgcauguacugcucuacggagggcgaauggcucguaccaauugggaaguguuccugcaacgcaggauacgaggagagagguuuuaugugucaggccugcaggccgggcuucuauaaggcucuggacgggaauaugaaaugcgcaaagugucccccucauucaagcacucaggaagauggaaguaugaacugccggugugagaacaauuacuuucgcgccgacaaagauccacccucuauggcuugcacccgaccuccauccagccccagaaacgugaucucgaauauaaacgaaacaucugucauucuugacugguccuggccgcuggauacuggcgguaggaaggacgugaccuucaauaucauuuguaaaaagugcggguggaacaucaaacagugugagccuugcucacccaauguucgguucuugccacgucaauuuggacucacaaacaccacggugacugucacagaucuguuagcccacaccaauuauacuuucgaaaucgacgcggugaacggcguaagugagcugagcuccccuccccgccaguuugcagccguuucuauuacaaccaaucaggcugccccaagccccgugcucacgauaaagaaggauagaaccucaaggaacaguaucucccuuagcuggcaagagccugaacacccaaauggcauuauccuggacuacgaggucaaauauuacgaaaagcaggagcaggaaacaucuuauacuauauugcgggcacgagggaccaacgugacaauuucaagucuaaaaccggacacuaucuacgucuuccagauccgcgcuagaaccgccgcgggauacgguacaaauagcaggaaguuugaguucgagaccucccccgauucuuuuucgauuagcggcgaauccucacaagugguuaugaucgccauuagugcagcuguggccauaauccugcucacuguagucauuuaugugcugaucgggcgguucuguggauacaaaucuaagcauggcgcugacgagaagcgccuucacuuugguaacgggcaucugaaauugccuggccucagaacguauguugauccacacacauacgaagaccccacccaggccgugcacgaguucgcaaaggagcuggaugccacuaacaucagcauugacaaagucgugggagcuggcgaauuuggggagguaugcuccggaagguuaaagcugccuagcaaaaaggaaauaucaguggcgaucaagacccuaaaaguugguuauacagagaagcagcgucgggauuuccucggcgaagcaucuauuauggggcaguuugaccauccaaauaucauucgacuggagggagucgugaccaaauccaagcccgugaugaucgucacugaguacauggaaaacggcagucuugauagcuucuugagaaaacacgacgcccaauucacaguuauacagcugguggguaugcucagggggaucgcuucuggcaugaaguaucuguccgauaugggauacgugcaucgcgaccuugccgcacggaauauucugaucaacucaaauuugguauguaaggucagugauuuuggccucagcagagugcuggaggacgacccggaagccgcuuacacgacccgcgggggaaaaauuccuaucagguggacuucgccagaggccauagcauaucgaaaguucacauccgcgucugauguuuggagcuacgguauuguguuaugggaagucaugucauauggcgagcggcccuacugggagaugaguaaccaggacgugaucaaagcuguugaugaaggguaucgucugccucccccaauggacugcccugccgcacuauaccagcucaugcuggauugcuggcaaaaggacagaaauaacaggcccaaauuugagcagauuguguccauccuugauaaguugauacgcaauccaggaucucugaaaaucauuaccagcgccgcugcccggccguccaaccuccuguuagaccagucaaauguagauaucacaacuuucagaaccacgggcgacuggcugaacggugucuggaccgcacacuguaaggaaauuuuuacagggguggaguauagcaguugcgauacuaucgcuaagauaucuaccgacgauaugaaaaaggugggcgucacaguugugggaccucagaaaaagauuaucuccagcaucaaagcccuugaaacucaaucgaagaauggccccguaccaguguga

SEQ ID NO: 1439 - RNA, 2952 nt, Artificial Sequence
  derived and/or modified sequence opt4 from EphA3__Homo_sapiens__AAG43576
auggacugccagcugagcauccugcugcugcugagcugcagcgugcuggacagcuucggcgagcugaucccccagcccagcaacgaggugaaccugcuggacagcaagaccauccagggcgagcugggcuggaucagcuaccccagccacggcugggaggagaucagcggcguggacgagcacuacacccccaucagaaccuaccaggugugcaacgugauggaccacagccagaacaacuggcugagaaccaacugggugcccagaaacagcgcccagaagaucuacguggagcugaaguucacccugagagacugcaacagcaucccccuggugcugggcaccugcaaggagaccuucaaccuguacuacauggagagcgacgacgaccacggcgugaaguucagagagcaccaguucaccaagaucgacaccaucgccgccgacgagagcuucacccagauggaccugggcgacagaauccugaagcugaacaccgagaucagagaggugggccccgugaacaagaagggcuucuaccuggccuuccaggacgugggcgccugcguggcccuggugagcgugagaguguacuucaagaagugccccuucaccgugaagaaccuggccauguuccccgacaccgugcccauggacagccagagccugguggaggugagaggcagcugcgugaacaacagcaaggaggaggacccccccagaauguacugcagcaccgagggcgaguggcuggugcccaucggcaagugcagcugcaacgccggcuacgaggagagaggcuucaugugccaggccugcagacccggcuucuacaaggcccuggacggcaacaugaagugcgccaagugccccccccacagcagcacccaggaggacggcagcaugaacugcagaugcgagaacaacuacuucagagccgacaaggacccccccagcauggccugcaccagaccccccagcagccccagaaacgugaucagcaacaucaacgagaccagcgugauccuggacuggagcuggccccuggacaccggcggcagaaaggacgugaccuucaacaucaucugcaagaagugcggcuggaacaucaagcagugcgagcccugcagccccaacgugagauuccugcccagacaguucggccugaccaacaccaccgugaccgugaccgaccugcuggcccacaccaacuacaccuucgagaucgacgccgugaacggcgugagcgagcugagcagcccccccagacaguucgccgccgugagcaucaccaccaaccaggccgcccccagccccgugcugaccaucaagaaggacagaaccagcagaaacagcaucagccugagcuggcaggagcccgagcaccccaacggcaucauccuggacuacgaggugaaguacuacgagaagcaggagcaggagaccagcuacaccauccugagagccagaggcaccaacgugaccaucagcagccugaagcccgacaccaucuacguguuccagaucagagccagaaccgccgccggcuacggcaccaacagcagaaaguucgaguucgagaccagccccgacagcuucagcaucagcggcgagagcagccagguggugaugaucgccaucagcgccgccguggccaucauccugcugaccguggugaucuacgugcugaucggcagauucugcggcuacaagagcaagcacggcgccgacgagaagagacugcacuucggcaacggccaccugaagcugcccggccugagaaccuacguggacccccacaccuacgaggaccccacccaggccgugcacgaguucgccaaggagcuggacgccaccaacaucagcaucgacaagguggugggcgccggcgaguucggcgaggugugcagcggcagacugaagcugcccagcaagaaggagaucagcguggccaucaagacccugaaggugggcuacaccgagaagcagagaagagacuuccugggcgaggccagcaucaugggccaguucgaccaccccaacaucaucagacuggagggcguggugaccaagagcaagcccgugaugaucgugaccgaguacauggagaacggcagccuggacagcuuccugagaaagcacgacgcccaguucaccgugauccagcuggugggcaugcugagaggcaucgccagcggcaugaaguaccugagcgacaugggcuacgugcacagagaccuggccgccagaaacauccugaucaacagcaaccuggugugcaaggugagcgacuucggccugagcagagugcuggaggacgaccccgaggccgccuacaccaccagaggcggcaagauccccaucagauggaccagccccgaggccaucgccuacagaaaguucaccagcgccagcgacguguggagcuacggcaucgugcugugggaggugaugagcuacggcgagagacccuacugggagaugagcaaccaggacgugaucaaggccguggacgagggcuacagacugcccccccccauggacugccccgccgcccuguaccagcugaugcuggacugcuggcagaaggacagaaacaacagacccaaguucgagcagaucgugagcauccuggacaagcugaucagaaaccccggcagccugaagaucaucaccagcgccgccgccagacccagcaaccugcugcuggaccagagcaacguggacaucaccaccuucagaaccaccggcgacuggcugaacggcguguggaccgcccacugcaaggagaucuucaccggcguggaguacagcagcugcgacaccaucgccaagaucagcaccgacgacaugaagaaggugggcgugaccguggugggcccccagaagaagaucaucagcagcaucaaggcccuggagacccagagcaagaacggccccgugcccguguga

SEQ ID NO: 1440 - RNA, 2952 nt, Artificial Sequence
  derived and/or modified sequence opt5 from EphA3__Homo_sapiens__AAG43576
auggacugccagcugagcauccuccugcuucuguccuguucugugcucgauagcuucggcgagcugauuccccaaccuuccaacgaagucaaucuucuggacucuaagaccauccagggggagcucggauggauuagcuacccgucccacggcugggaagagaucucugggguugaugaacauuauacacccauuagaacguaccaggugugcaacgugauggaccacagccagaauaacuggcugcggaccaauugggucccucgcaacuccgcccaaaagaucuauguggagcugaaguuuacacucagagauuguaauagcaucccccugguucuuggaaccugcaaagagacauucaaccuguacuauauggaaucugacgaugaccauggcgugaaguuucgggagcaccaguucaccaaaauugauacaaucgcugccgacgaauccuuuacccagauggaucucggggaccgcauucugaaacuuaauacggagaucagagaggucggaccugugaacaagaaaggcuucuaccuggcguuucaggauguuggcgcuuguguggcccucgucagcgugcggguguauuucaagaaaugccccuuuaccgucaagaaucuggccauguucccugacacaguuccgauggacucucaaucccugguggaagugcgcgggagcugugucaacaauucuaaagaggaagaucccccuagaauguacugcuccaccgagggagaauggcucgugcccauuggcaaguguagcugcaacgcuggguacgaggagcggggauuuaugugucaggccugccgcccuggcuucuauaaggcucuggacgggaauaugaaaugcgccaagugucccccgcauuccucuacacaggaagauggaagcaugaacugcagaugugagaacaauuacuuucgggcggacaaagauccucccuccauggccugcacccgcccucccagcucucccagaaacguuaucuccaauauuaacgaaacgagcgugauccuugacuggucuuggccucuggauacaggcggccggaaggacgucaccuucaauaucauuuguaaaaagugcggguggaacaucaaacagugugagccgugcagccccaaugugcgcuuccucccuagacaauuuggacugacaaacaccaccguuacagugacggaucuucuggcucacaccaauuauacauucgaaauugacgccgucaacggcguguccgagcucucuucucccccucggcaguuugcugccgucuccaucaccacaaaucaggcggcccccagcccggugcugaccauuaagaaggauagaacgucucgcaacuccaucagccugucuuggcaagagccugaacaccccaaugggaucauucucgacuacgagguuaaauauuacgaaaagcaggagcaggaaacauccuauaccauccugcgggcuagaggaaccaacgugacaauuagcucccuuaaaccugacaccaucuacgucuuccagauucgcgcccggacagcugccggcuacgggaccaauucuagaaaguuugaguucgagacgagccccgauuccuuuucuaucagcggagaauccagccaagugguuaugaucgccauuucugcugcgguggccaucauucugcucacagucgugaucuaugugcugauuggccgcuucuguggcuacaaauccaagcauggggcugacgagaagcggcuucacuuuggaaacggccaucugaaacucccugggcugagaaccuauguugauccccacacauacgaagacccgacccaggccguccacgaguucgccaaggagcuggaugcuacgaacaucagcauugacaaaguggugggagccggcgaauuuggggaggucugcucuggccgccucaagcugccuuccaaaaaggaaaucagcguggcgaucaagacccuuaaaguuggauauacagagaagcagcggagagauuuccugggcgaagcuagcauuauggggcaguuugaccaucccaauaucauucgccucgagggaguggucaccaaaagcaagcccgugaugaucguuacagaguacauggaaaacggcucccuggauagcuuccugcggaaacacgacgcccaauucaccgugauucagcuugucgggaugcucagaggaaucgccucuggcaugaaguaucuguccgauaugggguacgugcaucgggaccuggcugcccgcaauauccucauuaacagcaaucugguuuguaagguguccgauuuuggccuuucuagaguccuggaggacgacccugaagcugccuacacgacacggggaggcaaaaucccgauuagauggaccagccccgaggcgaucgccuaucgcaaguucacauccgcuucugauguguggagcuacgggauugugcucugggaagucauguccuauggagagcggccuuacugggagaugucuaaccaggacguuaucaaagccguggaugaaggcuauagacugcccccucccauggacugcccugcugcccuguaccagcuuaugcucgauugcuggcaaaaggaccgcaauaacagacccaaauuugagcagaucgugagcauucuggauaagcugauccggaauccggggucccucaaaauuaucaccagcgcggccgcucgcccuucuaaccugcuucuggaccaguccaaugucgauauuaccacauucagaacgaccggagacuggcucaacggcguguggacagcccacuguaaggaaaucuuuaccgggguugaguauagcucuugcgauacaaucgcuaagauuuccaccgacgauaugaaaaaggugggcgucacggugguuggaccccagaaaaagaucauuagcucuaucaaagcccuggaaacacaauccaagaauggcccugugcccgucuga

SEQ ID NO: 1441 - protein, 983 aa, Artificial Sequence [sequence omitted]

SEQ ID NO: 1442 - RNA, 2952 nt, Artificial Sequence
  EphA3__Homo_sapiens__AAH63282
auggauugucagcucuccauccuccuccuucucagcugcucuguucucgacagcuucggggaacugauuccgcagccuuccaaugaagucaaucuacuggauucaaaaacaauucaaggggagcugggcuggaucucuuauccaucacaugggugggaagagaucagugguguggaugaacauuacacacccaucaggacuuaccaggugugcaaugucauggaccacagucaaaacaauuggcugagaacaaacuggguccccaggaacucagcucagaagauuuauguggagcucaaguucacucuacgagacugcaauagcauuccauugguuuuaggaacuugcaaggagacauucaaccuguacuacauggagucugaugaugaucauggggugaaauuucgagagcaucaguuuacaaagauugacaccauugcagcugaugaaaguuucacucaaauggaucuuggggaccguauucugaagcucaacacugagauuagagaaguagguccugucaacaagaagggauuuuauuuggcauuucaagauguuggugcuuguguugccuuggugucugugagaguauacuucaaaaagugcccauuuacagugaagaaucuggcuauguuuccagacacgguacccauggacucccagucccugguggagguuagagggucuugugucaacaauucuaaggaggaagauccuccaaggauguacugcaguacagaaggcgaauggcuuguacccauuggcaaguguuccugcaaugcuggcuaugaagaaagagguuuuaugugccaagcuugucgaccagguuucuacaaggcauuggaugguaauaugaagugugcuaagugcccgccucacaguucuacucaggaagaugguucaaugaacugcaggugugagaauaauuacuuccgggcagacaaagacccuccauccauggcuuguacccgaccuccaucuucaccaagaaauguuaucucuaauauaaacgagaccucaguuauccuggacuggaguuggccccuggacacaggaggccggaaagauguuaccuucaacaucauauguaaaaaauguggguggaauauaaaacagugugagccaugcagcccaaauguccgcuuccucccucgacaguuuggacucaccaacaccacggugacagugacagaccuucuggcacauacuaacuacaccuuugagauugaugccguuaauggggugucagagcugagcuccccaccaagacaguuugcugcggucagcaucacaacuaaucaggcugcuccaucaccuguccugacgauuaagaaagaucggaccuccagaaauagcaucucuuuguccuggcaagaaccugaacauccuaaugggaucauauuggacuacgaggucaaauacuaugaaaagcaggaacaagaaacaaguuauaccauucugagggcaagaggcacaaauguuaccaucaguagccucaagccugacacuauauacguauuccaaauccgagcccgaacagccgcuggauaugggacgaacagccgcaaguuugaguuugaaacuaguccagacucuuucuccaucucuggugaaaguagccaaguggucaugaucgccauuucagcggcaguagcaauuauucuccucacuguugucaucuauguuuugauugggagguucuguggcuauaagucaaaacauggggcagaugaaaaaagacuucauuuuggcaaugggcauuuaaaacuuccaggucucaggacuuauguugacccacauacauaugaagacccuacccaaacuguucaugaguuugccaaggaauuggaugccaccaacauauccauugauaaaguuguuggagcaggugaauuuggagaggugugcaguggucgcuuaaaacuuccuucaaaaaaagagauuucaguggccauuaagacccugaaaguuggcuacacagaaaagcagaggagagacuuccugggagaagcaagcauuaugggacaguuugaccaccccaauaucauucgacuggaaggaguuguuaccaaaaguaagccaguuaugauugucacagaauacauggagaaugguuccuuggauaguuuccuacguaaacacgaugcccaguuuacugucauucagcuaguggggaugcuucgagggauagcaucuggcaugaaguaccugucagacaugggcuauguucaccgagaccucgcugcucggaacaucuugaucaacaguaacuugguguguaagguuucugauuucggacuuucgcguguccuggaggaugacccagaagcugcuuauacaacaagaggagggaagaucccaaucagguggacaucaccagaagcuauagccuaccgcaaguucacgucagccagcgauguauggaguuaugggauuguucucugggaggugaugucuuauggagagagaccauacugggagauguccaaucaggauguaauuaaagcuguagaugagggcuaucgacugccaccccccauggacugcccagcugccuuguaucagcugaugcuggacugcuggcagaaagacaggaacaacagacccaaguuugagcagauuguuaguauucuggacaagcuuauccggaaucccggcagccugaagaucaucaccagugcagccgcaaggccaucaaaccuucuucuggaccaaagcaauguggauaucacuaccuuccgcacaacaggugacuggcuuaauggugucuggacagcacacugcaaggaaaucuucacggguguggaguacaguucuugugacacaauagccaagauuuccacagaugacaugaaaaagguuggugucaccgugguugggccacagaagaagaucaucaguagcauuaaagcucuagaaacgcaaucaaagaauggcccaguucccguguaa

SEQ ID NO: 1443 - RNA, 2952 nt, Artificial Sequence
  derived and/or modified sequence opt1 from EphA3__Homo_sapiens__AAH63282
auggacugccagcugagcauccuccugcugcucuccugcagcgugcuggacuccuucggcgagcugaucccccagccgagcaacgaggucaaccuccuggacuccaagaccauccagggggagcugggcuggaucagcuaccccucccacgggugggaggagaucagcggcguggacgagcacuacacccccauccgcacguaccaggugugcaacgucauggaccacucccagaacaacuggcuccggaccaacugggugccccgcaacagcgcccagaagaucuacguggagcugaaguucacccugcgggacugcaacuccaucccgcucguccuggggaccugcaaggagacguucaaccuguacuacauggagagcgacgacgaccacggcgugaaguuccgcgagcaccaguucaccaagaucgacaccaucgccgcggacgaguccuucacccagauggaccucggcgaccggauccugaagcugaacacggagauccgcgagguggggcccgucaacaagaagggcuucuaccucgccuuccaggacgugggggccugcguggcccuggucagcgugcggguguacuucaagaagugccccuucaccgucaagaaccuggccauguuccccgacaccgugccgauggacucccagagccucguggagguccgcggcuccugcgugaacaacagcaaggaggaggacccgccccggauguacugcuccaccgagggggaguggcuggugcccaucggcaagugcagcugcaacgcgggcuacgaggagcgcggguucaugugccaggccugccggcccggcuucuacaaggcccuggacgggaacaugaagugcgccaagugcccgccccacagcuccacgcaggaggacggcagcaugaacugccgcugcgagaacaacuacuuccgggcggacaaggacccgcccuccauggccugcacccgcccgcccagcagcccccggaacgucaucuccaacaucaacgagaccuccgugauccucgacuggagcuggccccuggacaccggcgggcgcaaggacgugacguucaacaucaucugcaagaagugcggcuggaacaucaagcagugcgagcccugcucccccaacguccgguuccugccccgccaguucgggcucaccaacaccaccgugacggucaccgaccugcuggcccacaccaacuacaccuucgagaucgacgccgugaacggcgugagcgagcucuccagcccgccccggcaguucgccgcggucuccaucacgaccaaccaggccgcccccagccccgugcugaccaucaagaaggaccgcaccucccggaacagcaucucccugagcuggcaggagcccgagcaccccaacgggaucauccucgacuacgaggugaaguacuacgagaagcaggagcaggagacguccuacaccauccugcgcgcccgcggcaccaacgucaccaucagcagccugaagcccgacacgaucuacguguuccagauccgggcccgcaccgcggccggcuacgggaccaacucccggaaguucgaguucgagaccagcccggacuccuucagcaucuccggcgagagcucccagguggucaugaucgccaucagcgccgccguggcgaucauccuccugacgguggucaucuacgugcugaucgggcgcuucugcggcuacaaguccaagcacggggccgacgagaagcggcuccacuucggcaacggccaccugaagcugcccgggcuccgcaccuacguggacccccacaccuacgaggaccccacccagaccguccacgaguucgccaaggagcuggacgccacgaacaucagcaucgacaagguggugggcgccggggaguucggcgaggucugcuccgggcggcugaagcucccgagcaagaaggagaucuccguggcgaucaagacccugaaggugggcuacaccgagaagcagcgccgggacuuccugggcgaggccagcaucauggggcaguucgaccaccccaacaucauccgccucgagggcgucgugaccaaguccaagcccgugaugaucgucacggaguacauggagaacgggagccuggacuccuuccugcggaagcacgacgcccaguucaccgugauccagcuggugggcaugcuccgcggcaucgccagcgggaugaaguaccugagcgacaugggcuacguccaccgggaccuggcggcccgcaacauccucaucaacuccaaccuggugugcaaggugagcgacuucgggcugucccggguccucgaggacgaccccgaggccgccuacaccacccgcggcgggaagaucccgauccgguggacgagccccgaggccaucgcguaccgcaaguucaccuccgccagcgacgugugguccuacggcaucgugcugugggaggucaugagcuacggcgagcggcccuacugggagauguccaaccaggacgugaucaaggccguggacgagggguaccgccugcccccgcccauggacugccccgccgcccucuaccagcugaugcuggacugcuggcagaaggaccgcaacaaccggcccaaguucgagcagaucgucagcauccucgacaagcugauccgcaacccgggcucccugaagaucaucaccagcgcggccgcccggcccuccaaccuccugcuggaccagagcaacguggacaucaccacguuccgcaccaccggggacuggcucaacggcguguggaccgcccacugcaaggagaucuucacgggggucgaguacuccagcugcgacaccaucgccaagaucuccaccgacgacaugaagaaggugggcgugaccgucgugggcccccagaagaagaucaucagcuccaucaaggcgcuggagacgcagagcaagaacgggcccgugccggucuga

SEQ ID NO: 1444 - RNA, 2952 nt, Artificial Sequence
  derived and/or modified sequence opt2 from EphA3__Homo_sapiens__AAH63282
auggacugccagcucuccauccuccuccuccucuccugcuccguccucgacuccuucggcgagcucaucccccagcccuccaacgaggucaaccuccucgacuccaagaccauccagggcgagcucggcuggaucuccuaccccucccacggcugggaggagaucuccggcgucgacgagcacuacacccccauccgcaccuaccaggucugcaacgucauggaccacucccagaacaacuggcuccgcaccaacugggucccccgcaacuccgcccagaagaucuacgucgagcucaaguucacccuccgcgacugcaacuccaucccccucguccucggcaccugcaaggagaccuucaaccucuacuacauggaguccgacgacgaccacggcgucaaguuccgcgagcaccaguucaccaagaucgacaccaucgccgccgacgaguccuucacccagauggaccucggcgaccgcauccucaagcucaacaccgagauccgcgaggucggccccgucaacaagaagggcuucuaccucgccuuccaggacgucggcgccugcgucgcccucgucuccguccgcgucuacuucaagaagugccccuucaccgucaagaaccucgccauguuccccgacaccguccccauggacucccagucccucgucgagguccgcggcuccugcgucaacaacuccaaggaggaggaccccccccgcauguacugcuccaccgagggcgaguggcucguccccaucggcaagugcuccugcaacgccggcuacgaggagcgcggcuucaugugccaggccugccgccccggcuucuacaaggcccucgacggcaacaugaagugcgccaagugccccccccacuccuccacccaggaggacggcuccaugaacugccgcugcgagaacaacuacuuccgcgccgacaaggacccccccuccauggccugcacccgcccccccuccuccccccgcaacgucaucuccaacaucaacgagaccuccgucauccucgacugguccuggccccucgacaccggcggccgcaaggacgucaccuucaacaucaucugcaagaagugcggcuggaacaucaagcagugcgagcccugcucccccaacguccgcuuccucccccgccaguucggccucaccaacaccaccgucaccgucaccgaccuccucgcccacaccaacuacaccuucgagaucgacgccgucaacggcgucuccgagcucuccucccccccccgccaguucgccgccgucuccaucaccaccaaccaggccgcccccucccccguccucaccaucaagaaggaccgcaccucccgcaacuccaucucccucuccuggcaggagcccgagcaccccaacggcaucauccucgacuacgaggucaaguacuacgagaagcaggagcaggagaccuccuacaccauccuccgcgcccgcggcaccaacgucaccaucuccucccucaagcccgacaccaucuacgucuuccagauccgcgcccgcaccgccgccggcuacggcaccaacucccgcaaguucgaguucgagaccucccccgacuccuucuccaucuccggcgaguccucccaggucgucaugaucgccaucuccgccgccgucgccaucauccuccucaccgucgucaucuacguccucaucggccgcuucugcggcuacaaguccaagcacggcgccgacgagaagcgccuccacuucggcaacggccaccucaagcuccccggccuccgcaccuacgucgacccccacaccuacgaggaccccacccagaccguccacgaguucgccaaggagcucgacgccaccaacaucuccaucgacaaggucgucggcgccggcgaguucggcgaggucugcuccggccgccucaagcuccccuccaagaaggagaucuccgucgccaucaagacccucaaggucggcuacaccgagaagcagcgccgcgacuuccucggcgaggccuccaucaugggccaguucgaccaccccaacaucauccgccucgagggcgucgucaccaaguccaagcccgucaugaucgucaccgaguacauggagaacggcucccucgacuccuuccuccgcaagcacgacgcccaguucaccgucauccagcucgucggcaugcuccgcggcaucgccuccggcaugaaguaccucuccgacaugggcuacguccaccgcgaccucgccgcccgcaacauccucaucaacuccaaccucgucugcaaggucuccgacuucggccucucccgcguccucgaggacgaccccgaggccgccuacaccacccgcggcggcaagauccccauccgcuggaccucccccgaggccaucgccuaccgcaaguucaccuccgccuccgacgucugguccuacggcaucguccucugggaggucauguccuacggcgagcgccccuacugggagauguccaaccaggacgucaucaaggccgucgacgagggcuaccgccuccccccccccauggacugccccgccgcccucuaccagcucaugcucgacugcuggcagaaggaccgcaacaaccgccccaaguucgagcagaucgucuccauccucgacaagcucauccgcaaccccggcucccucaagaucaucaccuccgccgccgcccgccccuccaaccuccuccucgaccaguccaacgucgacaucaccaccuuccgcaccaccggcgacuggcucaacggcgucuggaccgcccacugcaaggagaucuucaccggcgucgaguacuccuccugcgacaccaucgccaagaucuccaccgacgacaugaagaaggucggcgucaccgucgucggcccccagaagaagaucaucuccuccaucaaggcccucgagacccaguccaagaacggccccguccccgucuga

SEQ ID NO: 1445 - RNA, 2952 nt, Artificial Sequence
  derived and/or modified sequence opt3 from EphA3__Homo_sapiens__AAH63282
auggacugccagcugagcauccuccuucuguuguccuguucuguguuagauucauucggcgagcugauuccccaaccuaguaacgaagucaaucuacucgacagcaagaccauacagggggagcugggauggaucuccuacccaucucacgguugggaagagauuucgggcguugaugaacauuauacaccgaucagaacuuaccaggugugcaacguaauggaccacucacagaauaacuggcuuaggacgaauugggugccccggaacagcgcccagaaaauuuaugucgagcugaaguuuaccuugcgcgauuguaauaguaucccucucgugcuggggacaugcaaagagacuuucaaccuguacuauauggaauccgacgaugaccauggaguuaaguuucgagagcaccaauucaccaaaauagauacaaucgcugcagacgaaucuuuuacccagauggaucucggcgaccguauuuuaaagcugaauacugagaucagagagguggguccagucaacaagaaaggguucuaccuugccuuucaggaugugggagcguguguagcuuugguuagcgugagggucuauuucaagaaaugccccuuuacagugaagaaucuggccauguucccugacaccgugccaauggacucccaaagucuagucgaaguucggggcucaugugugaacaauagcaaagaggaagaucccccucgcauguacugcucuacggagggcgaauggcucguaccaauugggaaguguuccugcaacgcaggauacgaggagagagguuuuaugugucaggccugcaggccgggcuucuauaaggcucuggacgggaauaugaaaugcgcaaagugucccccucauucaagcacucaggaagauggaaguaugaacugccggugugagaacaauuacuuucgcgccgacaaagauccacccucuauggcuugcacccgaccuccauccagccccagaaacgugaucucgaauauaaacgaaacaucugucauucuugacugguccuggccgcuggauacuggcgguaggaaggacgugaccuucaauaucauuuguaaaaagugcggguggaacaucaaacagugugagccuugcucacccaauguucgguucuugccacgucaauuuggacucacaaacaccacggugacugucacagaucuguuagcccacaccaauuauacuuucgaaaucgacgcggugaacggcguaagugagcugagcuccccuccccgccaguuugcagccguuucuauuacaaccaaucaggcugccccaagccccgugcucacgauaaagaaggauagaaccucaaggaacaguaucucccuuagcuggcaagagccugaacacccaaauggcauuauccuggacuacgaggucaaauauuacgaaaagcaggagcaggaaacaucuuauacuauauugcgggcacgagggaccaacgugacaauuucaagucuaaaaccggacacuaucuacgucuuccagauccgcgcuagaaccgccgcgggauacgguacaaauagcaggaaguuugaguucgagaccucccccgauucuuuuucgauuagcggcgaauccucacaagugguuaugaucgccauuagugcagcuguggccauaauccugcucacuguagucauuuaugugcugaucgggcgguucuguggauacaaaucuaagcauggcgcugacgagaagcgccuucacuuugguaacgggcaucugaaauugccuggccucagaacguauguugauccacacacauacgaagaccccacccagacugugcacgaguucgccaaggagcuggaugcaaccaacaucagcauugacaaagucgugggagccggcgaauuuggggagguaugcuccggaagguuaaagcugccuagcaaaaaggaaauaucaguggcuaucaagacacuaaaaguugguuauaccgagaagcagcgucgggauuuccucggcgaagcgucuauuauggggcaguuugaccauccaaauaucauucgacuggagggagucgugacuaaauccaagcccgugaugaucgucacagaguacauggaaaacggcagucuugauagcuucuugagaaaacacgacgcacaauucacgguuauacagcugguggguaugcucagggggaucgccucuggcaugaaguaucuguccgauaugggauacgugcaucgcgaccuugcugcccggaauauucugaucaacucaaauuugguauguaaggucagugauuuuggccucagcagagugcuggaggacgacccggaagcagccuacaccacucgcgggggaaaaauuccuaucagguggacaucgccagaggcuauagccuaucgaaaguucaccuccgcaucugauguuuggagcuacgguauuguguuaugggaagucaugucauauggcgagcggcccuacugggagaugaguaaccaggacgugaucaaagcgguugaugaaggguaucgucugccucccccaauggacugcccugcugcccuauaccagcucaugcuggauugcuggcaaaaggacagaaauaacaggcccaaauuugagcagauuguguccauccuugauaaguugauacgcaauccaggaucucugaaaaucauuacaagcgcagccgcucggccguccaaccuccuguuagaccagucaaauguagauaucacuaccuucagaacgaccggcgacuggcugaacggugucuggacagcccacuguaaggaaauuuuuacugggguggaguauagcaguugcgauaccaucgcaaagauaucuacagacgauaugaaaaaggugggcgucacuguugugggaccucagaaaaagauuaucuccagcaucaaagcucuugaaacccaaucgaagaauggccccguaccaguguga

SEQ ID NO: 1446 - RNA, 2952 nt, Artificial Sequence
  derived and/or modified sequence opt4 from EphA3__Homo_sapiens__AAH63282
auggacugccagcugagcauccugcugcugcugagcugcagcgugcuggacagcuucggcgagcugaucccccagcccagcaacgaggugaaccugcuggacagcaagaccauccagggcgagcugggcuggaucagcuaccccagccacggcugggaggagaucagcggcguggacgagcacuacacccccaucagaaccuaccaggugugcaacgugauggaccacagccagaacaacuggcugagaaccaacugggugcccagaaacagcgcccagaagaucuacguggagcugaaguucacccugagagacugcaacagcaucccccuggugcugggcaccugcaaggagaccuucaaccuguacuacauggagagcgacgacgaccacggcgugaaguucagagagcaccaguucaccaagaucgacaccaucgccgccgacgagagcuucacccagauggaccugggcgacagaauccugaagcugaacaccgagaucagagaggugggccccgugaacaagaagggcuucuaccuggccuuccaggacgugggcgccugcguggcccuggugagcgugagaguguacuucaagaagugccccuucaccgugaagaaccuggccauguuccccgacaccgugcccauggacagccagagccugguggaggugagaggcagcugcgugaacaacagcaaggaggaggacccccccagaauguacugcagcaccgagggcgaguggcuggugcccaucggcaagugcagcugcaacgccggcuacgaggagagaggcuucaugugccaggccugcagacccggcuucuacaaggcccuggacggcaacaugaagugcgccaagugccccccccacagcagcacccaggaggacggcagcaugaacugcagaugcgagaacaacuacuucagagccgacaaggacccccccagcauggccugcaccagaccccccagcagccccagaaacgugaucagcaacaucaacgagaccagcgugauccuggacuggagcuggccccuggacaccggcggcagaaaggacgugaccuucaacaucaucugcaagaagugcggcuggaacaucaagcagugcgagcccugcagccccaacgugagauuccugcccagacaguucggccugaccaacaccaccgugaccgugaccgaccugcuggcccacaccaacuacaccuucgagaucgacgccgugaacggcgugagcgagcugagcagcccccccagacaguucgccgccgugagcaucaccaccaaccaggccgcccccagccccgugcugaccaucaagaaggacagaaccagcagaaacagcaucagccugagcuggcaggagcccgagcaccccaacggcaucauccuggacuacgaggugaaguacuacgagaagcaggagcaggagaccagcuacaccauccugagagccagaggcaccaacgugaccaucagcagccugaagcccgacaccaucuacguguuccagaucagagccagaaccgccgccggcuacggcaccaacagcagaaaguucgaguucgagaccagccccgacagcuucagcaucagcggcgagagcagccagguggugaugaucgccaucagcgccgccguggccaucauccugcugaccguggugaucuacgugcugaucggcagauucugcggcuacaagagcaagcacggcgccgacgagaagagacugcacuucggcaacggccaccugaagcugcccggccugagaaccuacguggacccccacaccuacgaggaccccacccagaccgugcacgaguucgccaaggagcuggacgccaccaacaucagcaucgacaagguggugggcgccggcgaguucggcgaggugugcagcggcagacugaagcugcccagcaagaaggagaucagcguggccaucaagacccugaaggugggcuacaccgagaagcagagaagagacuuccugggcgaggccagcaucaugggccaguucgaccaccccaacaucaucagacuggagggcguggugaccaagagcaagcccgugaugaucgugaccgaguacauggagaacggcagccuggacagcuuccugagaaagcacgacgcccaguucaccgugauccagcuggugggcaugcugagaggcaucgccagcggcaugaaguaccugagcgacaugggcuacgugcacagagaccuggccgccagaaacauccugaucaacagcaaccuggugugcaaggugagcgacuucggccugagcagagugcuggaggacgaccccgaggccgccuacaccaccagaggcggcaagauccccaucagauggaccagccccgaggccaucgccuacagaaaguucaccagcgccagcgacguguggagcuacggcaucgugcugugggaggugaugagcuacggcgagagacccuacugggagaugagcaaccaggacgugaucaaggccguggacgagggcuacagacugcccccccccauggacugccccgccgcccuguaccagcugaugcuggacugcuggcagaaggacagaaacaacagacccaaguucgagcagaucgugagcauccuggacaagcugaucagaaaccccggcagccugaagaucaucaccagcgccgccgccagacccagcaaccugcugcuggaccagagcaacguggacaucaccaccuucagaaccaccggcgacuggcugaacggcguguggaccgcccacugcaaggagaucuucaccggcguggaguacagcagcugcgacaccaucgccaagaucagcaccgacgacaugaagaaggugggcgugaccguggugggcccccagaagaagaucaucagcagcaucaaggcccuggagacccagagcaagaacggccccgugcccguguga

SEQ ID NO: 1447 - RNA, 2952 nt, Artificial Sequence
  derived and/or modified sequence opt5 from EphA3__Homo_sapiens__AAH63282
auggacugccagcugagcauccuccugcuucuguccuguucugugcucgauagcuucggcgagcugauuccccaaccuuccaacgaagucaaucuucuggacucuaagaccauccagggggagcucggauggauuagcuacccgucccacggcugggaagagaucucugggguugaugaacauuauacacccauuagaacguaccaggugugcaacgugauggaccacagccagaauaacuggcugcggaccaauugggucccucgcaacuccgcccaaaagaucuauguggagcugaaguuuacacucagagauuguaauagcaucccccugguucuuggaaccugcaaagagacauucaaccuguacuauauggaaucugacgaugaccauggcgugaaguuucgggagcaccaguucaccaaaauugauacaaucgcugccgacgaauccuuuacccagauggaucucggggaccgcauucugaaacuuaauacggagaucagagaggucggaccugugaacaagaaaggcuucuaccuggcguuucaggauguuggcgcuuguguggcccucgucagcgugcggguguauuucaagaaaugccccuuuaccgucaagaaucuggccauguucccugacacaguuccgauggacucucaaucccugguggaagugcgcgggagcugugucaacaauucuaaagaggaagaucccccuagaauguacugcuccaccgagggagaauggcucgugcccauuggcaaguguagcugcaacgcuggguacgaggagcggggauuuaugugucaggccugccgcccuggcuucuauaaggcucuggacgggaauaugaaaugcgccaagugucccccgcauuccucuacacaggaagauggaagcaugaacugcagaugugagaacaauuacuuucgggcggacaaagauccucccuccauggccugcacccgcccucccagcucucccagaaacguuaucuccaauauuaacgaaacgagcgugauccuugacuggucuuggccucuggauacaggcggccggaaggacgucaccuucaauaucauuuguaaaaagugcggguggaacaucaaacagugugagccgugcagccccaaugugcgcuuccucccuagacaauuuggacugacaaacaccaccguuacagugacggaucuucuggcucacaccaauuauacauucgaaauugacgccgucaacggcguguccgagcucucuucucccccucggcaguuugcugccgucuccaucaccacaaaucaggcggcccccagcccggugcugaccauuaagaaggauagaacgucucgcaacuccaucagccugucuuggcaagagccugaacaccccaaugggaucauucucgacuacgagguuaaauauuacgaaaagcaggagcaggaaacauccuauaccauccugcgggcuagaggaaccaacgugacaauuagcucccuuaaaccugacaccaucuacgucuuccagauucgcgcccggacagcugccggcuacgggacgaauagcagaaaguuugaguucgagaccagccccgauuccuuuucuaucagcggagaauccagccaagugguuaugaucgccauuucugcugcgguggccaucauucugcucacagucgugaucuaugugcugauuggccgcuucuguggcuacaaauccaagcauggggcugacgagaagcggcuucacuuuggaaacggccaucugaaacucccugggcugagaaccuauguugauccccacacauacgaagacccgacccagacgguccacgaguucgccaaggagcuggaugccaccaacaucagcauugacaaaguggugggagcuggcgaauuuggggaggucugcucuggccgccucaagcugccuuccaaaaaggaaaucagcguggccaucaagacacuuaaaguuggauauaccgagaagcagcggagagauuuccugggcgaagcgucuauuauggggcaguuugaccaucccaauaucauucgccucgagggaguggucacaaaaagcaagcccgugaugaucguuaccgaguacauggaaaacggcucccuggauagcuuccugcggaaacacgacgcucaauucacggugauucagcuugucgggaugcucagaggaaucgccucuggcaugaaguaucuguccgauaugggguacgugcaucgggaccuggccgcucgcaauauccucauuaacagcaaucugguuuguaagguguccgauuuuggccuuucuagaguccuggaggacgacccugaagccgcuuacacaacccggggaggcaaaaucccgauuagauggacaagccccgaggccaucgcguaucgcaaguucaccuccgccucugauguguggagcuacgggauugugcucugggaagucauguccuauggagagcggccuuacugggagaugucuaaccaggacguuaucaaagcuguggaugaaggcuauagacugcccccucccauggacugcccugccgcucuguaccagcuuaugcucgauugcuggcaaaaggaccgcaauaacagacccaaauuugagcagaucgugagcauucuggauaagcugauccggaauccggggucccucaaaauuaucaccagcgccgcggcccgcccuucuaaccugcuucuggaccaguccaaugucgauauuacaacguucagaaccacaggagacuggcucaacggcguguggaccgcucacuguaaggaaaucuuuacagggguugaguauagcucuugcgauaccaucgccaagauuuccacggacgauaugaaaaaggugggcgucacagugguuggaccccagaaaaagaucauuagcucuaucaaagcucuggaaacccaauccaagaauggcccugugcccgucuga

SEQ ID NO: 1448 - protein, 462 aa, Artificial Sequence
  ErbB3__Homo_sapiens__B3KWG5
MPMSTILPVTSPCLPATGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 1449 - RNA, 1389 nt, Artificial Sequence
  ErbB3__Homo_sapiens__BAG54127
augcccaugucuacuauuuugccagugacuaguccaugucuuccugcaacaggugugacaguuugggaguugaugaccuucggggcagagcccuaugcagggcuacgauuggcugaaguaccagaccugcuagagaagggggagcgguuggcacagccccagaucugcacaauugaugucuacauggugauggucaaguguuggaugauugaugagaacauucgcccaaccuuuaaagaacuagccaaugaguucaccaggauggcccgagacccaccacgguaucuggucauaaagagagagagugggccuggaauagccccugggccagagccccauggucugacaaacaagaagcuagaggaaguagagcuggagccagaacuagaccuagaccuagacuuggaagcagaggaggacaaccuggcaaccaccacacugggcuccgcccucagccuaccaguuggaacacuuaaucggccacgugggagccagagccuuuuaaguccaucaucuggauacaugcccaugaaccaggguaaucuuggggagucuugccaggagucugcaguuucugggagcagugaacggugcccccguccagucucucuacacccaaugccacggggaugccuggcaucagagucaucagaggggcauguaacaggcucugaggcugagcuccaggagaaagugucaauguguagaagccggagcaggagccggagcccacggccacgcggagauagcgccuaccauucccagcgccacagucugcugacuccuguuaccccacucuccccacccggguuagaggaagaggaugucaacgguuaugucaugccagauacacaccucaaagguacucccuccucccgggaaggcacccuuucuucagugggucucaguucuguccuggguacugaagaagaagaugaagaugaggaguaugaauacaugaaccggaggagaaggcacaguccaccucaucccccuaggccaaguucccuugaggagcuggguuaugaguacauggauguggggucagaccucagugccucucugggcagcacacagaguugcccacuccacccuguacccaucaugcccacugcaggcacaacuccagaugaagacuaugaauauaugaaucggcaacgagauggaggugguccugggggugauuaugcagccaugggggccugcccagcaucugagcaaggguaugaagagaugagagcuuuucaggggccuggacaucaggccccccauguccauuaugcccgccuaaaaacucuacguagcuuagaggcuacagacucugccuuugauaacccugauuacuggcauagcaggcuuuuccccaaggcuaaugcccagagaacguaa

SEQ ID NO: 1450 - RNA, 1389 nt, Artificial Sequence
  derived and/or modified sequence opt1 from ErbB3__Homo_sapiens__BAG54127
augcccaugagcaccauccugccggugaccucccccugccuccccgccacgggcgucaccgugugggagcugaugaccuucggggccgagcccuacgcgggccugcgccucgccgaggugccggaccugcuggagaagggggagcggcucgcccagccccagaucugcaccaucgacgucuacauggugauggugaagugcuggaugaucgacgagaacauccgccccacguucaaggagcuggccaacgaguucacccggauggcccgcgacccgccccgguaccuggucaucaagcgcgagagcggccccgggaucgcgcccggccccgagccgcacggccucaccaacaagaagcuggaggagguggagcuggagcccgagcucgaccuggaccuggaccucgaggccgaggaggacaaccuggccaccacgacccugggguccgcccucagccugcccgugggcacccugaaccggccccgcgggucccagagccuccuguccccgagcuccggcuacaugcccaugaaccaggggaaccugggcgagagcugccaggaguccgcggucagcggcuccagcgagcggugcccccgccccgugucccuccacccgaugccccgggggugccuggccagcgaguccagcgagggccacgugaccggguccgaggccgagcugcaggagaaggucagcaugugccgcagccggucccgcagccggagcccccgcccccggggcgacuccgccuaccacucccagcgccacagccuccugacgccggugacgccccuguccccgcccggccucgaggaggaggacgugaacggguacgucaugcccgacacccaccugaagggcacccccagcucccgggaggggacccugagcuccgugggccucagcuccgugcuggggaccgaggaggaggacgaggacgaggaguacgaguacaugaaccgccggcgccgccacagcccgccccacccgccccggcccuccagccuggaggagcucggcuacgaguacauggacgucggcuccgaccugagcgccucccuggggagcacccagagcugcccccuccaccccgugcccaucaugcccaccgcgggcacgaccccggacgaggacuacgaguacaugaaccgccagcgggacgggggcgggcccggcggcgacuacgccgccaugggggccugccccgccuccgagcagggcuacgaggagaugcgcgcguuccaggggcccggccaccaggccccgcacgugcacuacgcccggcugaagacccugcgcagccucgaggccaccgacuccgccuucgacaaccccgacuacuggcacagccggcuguuccccaaggcgaacgcccagcgcacguga

SEQ ID NO: 1451 - RNA, 1389 nt, Artificial Sequence
  derived and/or modified sequence opt2 from ErbB3__Homo_sapiens__BAG54127
augcccauguccaccauccuccccgucaccucccccugccuccccgccaccggcgucaccgucugggagcucaugaccuucggcgccgagcccuacgccggccuccgccucgccgagguccccgaccuccucgagaagggcgagcgccucgcccagccccagaucugcaccaucgacgucuacauggucauggucaagugcuggaugaucgacgagaacauccgccccaccuucaaggagcucgccaacgaguucacccgcauggcccgcgaccccccccgcuaccucgucaucaagcgcgaguccggccccggcaucgcccccggccccgagccccacggccucaccaacaagaagcucgaggaggucgagcucgagcccgagcucgaccucgaccucgaccucgaggccgaggaggacaaccucgccaccaccacccucggcuccgcccucucccuccccgucggcacccucaaccgcccccgcggcucccagucccuccucucccccuccuccggcuacaugcccaugaaccagggcaaccucggcgaguccugccaggaguccgccgucuccggcuccuccgagcgcugcccccgccccgucucccuccaccccaugccccgcggcugccucgccuccgaguccuccgagggccacgucaccggcuccgaggccgagcuccaggagaaggucuccaugugccgcucccgcucccgcucccgcuccccccgcccccgcggcgacuccgccuaccacucccagcgccacucccuccucacccccgucaccccccucuccccccccggccucgaggaggaggacgucaacggcuacgucaugcccgacacccaccucaagggcacccccuccucccgcgagggcacccucuccuccgucggccucuccuccguccucggcaccgaggaggaggacgaggacgaggaguacgaguacaugaaccgccgccgccgccacucccccccccaccccccccgccccuccucccucgaggagcucggcuacgaguacauggacgucggcuccgaccucuccgccucccucggcuccacccaguccugcccccuccaccccguccccaucaugcccaccgccggcaccacccccgacgaggacuacgaguacaugaaccgccagcgcgacggcggcggccccggcggcgacuacgccgccaugggcgccugccccgccuccgagcagggcuacgaggagaugcgcgccuuccagggccccggccaccaggccccccacguccacuacgcccgccucaagacccuccgcucccucgaggccaccgacuccgccuucgacaaccccgacuacuggcacucccgccucuuccccaaggccaacgcccagcgcaccuga

SEQ ID NO: 1452 - RNA, 1389 nt, Artificial Sequence
  derived and/or modified sequence opt3 from ErbB3__Homo_sapiens__BAG54127
augcccaugagcaccauccugccugugacauccccaugccucccggccacuggcgucacgguuugggagcuuaugaccuucggggcugaacccuacgcaggacugagauuggccgaggugccugacuuacuggaaaagggugagaggcuagcgcagccacaaauuuguacaauagauguauauauggugauggucaaaugcuggaugaucgacgaaaacauucggcccacuuuuaaggagcucgcuaaugaguucacccgcauggcccgagauccuccacguuaccuggugaucaaaagagaaucuggccccgggauugcaccuggaccagagccgcacggccuuacaaacaagaaacuggaagagguugaguuggaacccgagcucgaccuggaucuggaccucgaagccgaggaagauaauuuagcuaccacuacacuggguucagcacuuaguuugccuguggggacccugaacaggccacggggaagccagucccuacucucucccucgucaggcuauaugccuaugaaucagggcaaccugggggagagcugucaggagagugccgucuccggaucuagcgaacgcugcccaagacccgugucccuucauccgaugccuagggguugucuggcuucagagaguagcgaaggccacguaacggggucugaggccgaauugcaagagaagguuuccaugugccggucacgcagccgaaguagaucucccaggccacggggagacuccgcguaccauagccagcgucacucgcuccugacuccugugacccccuuaucuccacccggccuggaggaagaggaugucaaugguuaugugaugccugacacacaucucaaggggacuccauccucacgcgaaggaacccuuaguagcgugggccuguccucugucuugggcacagaggaagaggaugaggacgaagaguacgaauauaugaacagaaggcggcgacacagcccgccccacccuccacgccccucaagucuagaggagcugggguacgaauacauggauguuggauccgaccucagcgcaucucuggguucaacccagaguuguccucuucauccagugcccaucaugccgacggccggcacuacaccugacgaggauuaugaauacaugaauagacagagggacgggggaggcccagguggggauuaugcugccaugggcgcaugccccgcuagcgagcaaggauacgaagagaugcgggccuuucagggcccugggcaccaggcgccccauguacacuaugcccgccugaaaaccuugagaucccucgaggcaacugacucugcuuucgauaacccagacuacuggcacucgaggcuguuuccuaaggccaaugcucagcguacauga

SEQ ID NO: 1453 - RNA, 1389 nt, Artificial Sequence
  derived and/or modified sequence opt4 from ErbB3__Homo_sapiens__BAG54127
augcccaugagcaccauccugcccgugaccagccccugccugcccgccaccggcgugaccgugugggagcugaugaccuucggcgccgagcccuacgccggccugagacuggccgaggugcccgaccugcuggagaagggcgagagacuggcccagccccagaucugcaccaucgacguguacauggugauggugaagugcuggaugaucgacgagaacaucagacccaccuucaaggagcuggccaacgaguucaccagaauggccagagacccccccagauaccuggugaucaagagagagagcggccccggcaucgcccccggccccgagccccacggccugaccaacaagaagcuggaggagguggagcuggagcccgagcuggaccuggaccuggaccuggaggccgaggaggacaaccuggccaccaccacccugggcagcgcccugagccugcccgugggcacccugaacagacccagaggcagccagagccugcugagccccagcagcggcuacaugcccaugaaccagggcaaccugggcgagagcugccaggagagcgccgugagcggcagcagcgagagaugccccagacccgugagccugcaccccaugcccagaggcugccuggccagcgagagcagcgagggccacgugaccggcagcgaggccgagcugcaggagaaggugagcaugugcagaagcagaagcagaagcagaagccccagacccagaggcgacagcgccuaccacagccagagacacagccugcugacccccgugaccccccugagcccccccggccuggaggaggaggacgugaacggcuacgugaugcccgacacccaccugaagggcacccccagcagcagagagggcacccugagcagcgugggccugagcagcgugcugggcaccgaggaggaggacgaggacgaggaguacgaguacaugaacagaagaagaagacacagccccccccacccccccagacccagcagccuggaggagcugggcuacgaguacauggacgugggcagcgaccugagcgccagccugggcagcacccagagcugcccccugcaccccgugcccaucaugcccaccgccggcaccacccccgacgaggacuacgaguacaugaacagacagagagacggcggcggccccggcggcgacuacgccgccaugggcgccugccccgccagcgagcagggcuacgaggagaugagagccuuccagggccccggccaccaggccccccacgugcacuacgccagacugaagacccugagaagccuggaggccaccgacagcgccuucgacaaccccgacuacuggcacagcagacuguuccccaaggccaacgcccagagaaccuga

SEQ ID NO: 1454 - RNA, 1389 nt, Artificial Sequence
  derived and/or modified sequence opt5 from ErbB3__Homo_sapiens__BAG54127
augcccaugagcaccauccugccugugacauccccgugccuccccgccacgggcgucaccguuugggagcugaugacauucggggcugaaccuuacgccggacuuagacuggcggaggugcccgaccuccuggaaaagggcgagcggcuugcucagccucaaauuuguaccaucgauguguauauggucauggugaaaugcuggaugauugacgaaaacauccgccccacauuuaaggagcuggccaaugaguucaccagaauggcccgggauccuccgcgcuaccucguuauuaaaagagaaucugggcccggaaucgcuccuggccccgagccucacgggcugacaaacaagaaacuggaagagguggagcucgaacccgagcuggaccuugaucuggaccucgaagccgaggaagauaaucuggcuaccacgacccuuggaagcgcccugucccucccggucggcacacugaaccggccucgcggcucucagagccugcucucccccucuagcggguauaugccuaugaaucagggaaaccugggcgaguccugucaggagagcgcggugucuggguccagcgaaagaugcccccggcccguuucucuucauccuaugccgcgcggaugucuggccuccgagagcucugaaggccacgugaccggguccgaggcugaacuccaagagaaggucagcaugugcagaucccggucucgcagcagauccccucggccccgcggagacagcgccuaccauucucagagacacucccugcuuacacccgugaccccucugucucccccgggccucgaggaagaggaugugaauggcuaugucaugccugacacgcaucugaaggggacacccagcagccgggaaggaacccuguccucuguuggccucagcuccgugcuggggacagaggaagaggaugaggacgaagaguacgaauauaugaacagacgccggagacacagcccuccccacccuccccgcccgucuucccuugaggagcugggauacgaauacauggaugugggcagcgaccucucugcuucccuggggagcacccaguccuguccucuucaucccguccccaucaugccuaccgccggaacaacgccggacgaggauuaugaauacaugaaucggcagagagacggcggcgggcccggaggcgauuaugcggccaugggggcuugcccugccucugagcaaggauacgaagagaugcgcgcuuuucagggccccgggcaccaggccccucaugugcacuaugcccggcugaaaacccucagaagccuggaggcuacagacuccgcguucgauaaccccgacuacuggcacucucgccuguuuccuaaggccaaugcucagcggaccuga

SEQ ID NO: 1455 - protein, 921 aa, Artificial Sequence
  ErbB3__Homo_sapiens__B4DGQ7
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGQCIWMPSLPSLAPVSNLPFETPS

SEQ ID NO: 1456 - RNA, 2766 nt, Artificial Sequence
  ErbB3__Homo_sapiens__BAG57868
augagggcgaacgacgcucugcaggugcugggcuugcuuuucagccuggcccggggcuccgaggugggcaacucucaggcaguguguccugggacucugaauggccugagugugaccggcgaugcugagaaccaauaccagacacuguacaagcucuacgagaggugugagguggugauggggaaccuugagauugugcucacgggacacaaugccgaccucuccuuccugcaguggauucgagaagugacaggcuauguccucguggccaugaaugaauucucuacucuaccauugcccaaccuccgcguggugcgagggacccaggucuacgaugggaaguuugccaucuucgucauguugaacuauaacaccaacuccagccacgcucugcgccagcuccgcuugacucagcucaccgagauucugucaggggguguuuauauugagaagaacgauaagcuuugucacauggacacaauugacuggagggacaucgugagggaccgagaugcugagauaguggugaaggacaauggcagaagcuguccccccugucaugagguuugcaaggggcgaugcugggguccuggaucagaagacugccagacauugaccaagaccaucugugcuccucaguguaauggucacugcuuugggcccaaccccaaccagugcugccaugaugagugugccgggggcugcucaggcccucaggacacagacugcuuugccugccggcacuucaaugacaguggagccuguguaccucgcuguccacagccucuugucuacaacaagcuaacuuuccagcuggaacccaauccccacaccaaguaucaguauggaggaguuuguguagccagcuguccccauaacuuugugguggaucaaacauccugugucagggccuguccuccugacaagauggaaguagauaaaaaugggcucaagaugugugagccuugugggggacuaugucccaaagccugugagggaacaggcucugggagccgcuuccagacuguggacucgagcaacauugauggauuugugaacugcaccaagauccugggcaaccuggacuuucugaucaccggccucaauggagaccccuggcacaagaucccugcccuggacccagagaagcucaaugucuuccggacaguacgggagaucacagguuaccugaacauccaguccuggccgccccacaugcacaacuucaguguuuuuuccaauuugacaaccauuggaggcagaagccucuacaaccggggcuucucauuguugaucaugaagaacuugaaugucacaucucugggcuuccgaucccugaaggaaauuagugcugggcguaucuauauaagugccaauaggcagcucugcuaccaccacucuuugaacuggaccaaggugcuucgggggccuacggaagagcgacuagacaucaagcauaaucggccgcgcagagacugcguggcagagggcaaagugugugacccacugugcuccucugggggaugcuggggcccaggcccuggucagugcuuguccugucgaaauuauagccgaggaggugucugugugacccacugcaacuuucugaauggggagccucgagaauuugcccaugaggccgaaugcuucuccugccacccggaaugccaacccauggagggcacugccacaugcaauggcucgggcucugauacuugugcucaaugugcccauuuucgagaugggccccacugugugagcagcugcccccauggaguccuaggugccaagggcccaaucuacaaguacccagauguucagaaugaaugucggcccugccaugagaacugcacccagggguguaaaggaccagagcuucaagacuguuuaggacaaacacuggugcugaucggcaaaacccaucugacaauggcuuugacagugauagcaggauugguagugauuuucaugaugcugggcggcacuuuucucuacuggcgugggcgccggauucagaauaaaagggcuaugaggcgauacuuggaacggggugagagcauagagccucuggaccccagugagaaggcuaacaaagucuuggccagaaucuucaaagagacagagcuaaggaagcuuaaagugcuuggcucgggugucuuuggaacugugcacaaaggaguguggaucccugagggugaaucaaucaagauuccagucugcauuaaagucauugaggacaagaguggacggcagaguuuucaagcugugacagaucauaugcuggccauuggcagccuggaccaugcccacauuguaaggcugcugggacuaugcccagggucaucucugcagcuugucacucaauauuugccucuggguucucugcuggaucaugugagacaacaccggggggcacuggggccacagcugcugcucaacuggggaguacaaauugccaagggaauguacuaccuugaggaacaugguauggugcauagaaaccuggcugcccgaaacgugcuacucaagucacccagucagguucagguggcagauuuugguguggcugaccugcugccuccugaugauaagcagcugcuauacagugaggccaagacuccaauuaaguggauggcccuugagaguauccacuuugggaaauacacacaccagagugaugucuggagcuauggucagugcaucuggaugcccucucuaccaucacuggccccaguuucaaauuuaccuuuugagacccccucuuag

SEQ ID NO: 1457 - RNA, 2766 nt, Artificial Sequence
  derived and/or modified sequence opt1 from ErbB3__Homo_sapiens__BAG57868
augcgcgccaacgacgcccuccaggugcugggccugcuguucagccucgcgcggggguccgaggucggcaacagccaggccgugugccccgggacccugaacggccuguccgugaccggggacgccgagaaccaguaccagacgcucuacaagcuguacgagcgcugcgaggucgugaugggcaaccuggagaucgugcucaccggccacaacgccgaccugagcuuccugcaguggauccgggaggucaccggguacgugcucguggccaugaacgaguucuccacccugccgcugcccaaccuccgcgucgugcggggcacccagguguacgacgggaaguucgcgaucuucgucaugcugaacuacaacaccaacagcucccacgcccugcgccagcuccggcugacccagcugaccgagauccucagcggcgggguguacaucgagaagaacgacaagcugugccacauggacacgaucgacuggcgcgacaucgugcgggaccgcgacgccgagaucgucgugaaggacaacggccgguccugcccgcccugccacgaggugugcaagggccgcugcugggggcccggcagcgaggacugccagacccugaccaagaccaucugcgcgccccagugcaacgggcacugcuucggccccaaccccaaccagugcugccacgacgagugcgccggcgggugcuccggcccgcaggacacggacugcuucgccugccggcacuucaacgacagcggggccugcgucccccgcugcccccagccccucguguacaacaagcugaccuuccagcuggagccgaacccccacaccaaguaccaguacggcggggugugcgucgccuccugcccccacaacuucgugguggaccagaccagcugcguccgggccugcccgcccgacaagauggagguggacaagaacggccucaagaugugcgagcccugcggcgggcugugccccaaggcgugcgagggcacgggguccggcagccgcuuccagaccgucgacuccagcaacaucgacggguucgugaacugcaccaagauccugggcaaccucgacuuccugaucaccggccugaacggggaccccuggcacaagaucccggcccucgaccccgagaagcugaacguguuccggacgguccgcgagaucaccggcuaccugaacauccaguccuggccgccccacaugcacaacuucagcguguucagcaaccucaccaccaucgggggccggucccuguacaaccgcggguucagccugcucaucaugaagaaccugaacgugacgucccugggcuuccggagccucaaggagaucuccgccggccgcaucuacaucagcgccaaccgccagcugugcuaccaccacucccugaacuggaccaagguccuccgggggcccaccgaggagcgccuggacaucaagcacaaccggccccgccgggacugcguggccgagggcaaggugugcgacccccugugcagcuccgggggcugcuggggccccgggccgggccagugccucagcugccgcaacuacucccgcgggggcgucugcgugacccacugcaacuuccugaacggggagccccgggaguucgcgcacgaggccgagugcuucagcugccaccccgagugccagccgauggagggcacggcgaccugcaacggcuccgggagcgacacgugcgcccagugcgcccacuuccgggacggcccccacugcguguccagcugcccccacgggguccugggcgccaaggggcccaucuacaaguacccggacgugcagaacgagugccgccccugccacgagaacugcacccagggcugcaagggccccgagcugcaggacugccucgggcagacgcuggugcugaucggcaagacccaccucaccauggcccugaccgucaucgccgggcugguggugaucuucaugaugcucggcgggacguuccuguacuggcggggccgccggauccagaacaagcgcgccaugcggcgcuaccuggagcggggcgaguccaucgagccccucgacccgagcgagaaggccaacaagguccuggcgcgcaucuucaaggagaccgagcugcggaagcucaaggugcugggguccggcguguucgggaccguccacaagggcguguggauccccgagggggagagcaucaagauccccgugugcaucaaggucaucgaggacaagagcggccgccaguccuuccaggccgugaccgaccacaugcuggccaucggcagccucgaccacgcccacaucgugcgccugcuggggcucugccccggcuccagccugcagcuggucacccaguaccucccgcuggggucccugcucgaccacgugcggcagcaccgcggcgcgcugggcccccagcugcuccugaacuggggcgugcagaucgccaaggggauguacuaccuggaggagcacgggaugguccaccggaaccucgccgcccgcaacgugcugcucaagagccccucccaggugcaggucgccgacuucggcguggcggaccugcugcccccggacgacaagcagcugcucuacagcgaggccaagacgcccaucaaguggauggcccuggaguccauccacuucgggaaguacacccaccagagcgacgugugguccuacggccagugcaucuggaugcccagccugcccucccucgccccggucagcaaccugcccuucgagacccccuccuga

SEQ ID NO: 1458 - RNA, 2766 nt, Artificial Sequence
  derived and/or modified sequence opt2 from ErbB3__Homo_sapiens__BAG57868
augcgcgccaacgacgcccuccagguccucggccuccucuucucccucgcccgcggcuccgaggucggcaacucccaggccgucugccccggcacccucaacggccucuccgucaccggcgacgccgagaaccaguaccagacccucuacaagcucuacgagcgcugcgaggucgucaugggcaaccucgagaucguccucaccggccacaacgccgaccucuccuuccuccaguggauccgcgaggucaccggcuacguccucgucgccaugaacgaguucuccacccucccccuccccaaccuccgcgucguccgcggcacccaggucuacgacggcaaguucgccaucuucgucaugcucaacuacaacaccaacuccucccacgcccuccgccagcuccgccucacccagcucaccgagauccucuccggcggcgucuacaucgagaagaacgacaagcucugccacauggacaccaucgacuggcgcgacaucguccgcgaccgcgacgccgagaucgucgucaaggacaacggccgcuccugcccccccugccacgaggucugcaagggccgcugcuggggccccggcuccgaggacugccagacccucaccaagaccaucugcgccccccagugcaacggccacugcuucggccccaaccccaaccagugcugccacgacgagugcgccggcggcugcuccggcccccaggacaccgacugcuucgccugccgccacuucaacgacuccggcgccugcgucccccgcugcccccagccccucgucuacaacaagcucaccuuccagcucgagcccaacccccacaccaaguaccaguacggcggcgucugcgucgccuccugcccccacaacuucgucgucgaccagaccuccugcguccgcgccugcccccccgacaagauggaggucgacaagaacggccucaagaugugcgagcccugcggcggccucugccccaaggccugcgagggcaccggcuccggcucccgcuuccagaccgucgacuccuccaacaucgacggcuucgucaacugcaccaagauccucggcaaccucgacuuccucaucaccggccucaacggcgaccccuggcacaagauccccgcccucgaccccgagaagcucaacgucuuccgcaccguccgcgagaucaccggcuaccucaacauccaguccuggcccccccacaugcacaacuucuccgucuucuccaaccucaccaccaucggcggccgcucccucuacaaccgcggcuucucccuccucaucaugaagaaccucaacgucaccucccucggcuuccgcucccucaaggagaucuccgccggccgcaucuacaucuccgccaaccgccagcucugcuaccaccacucccucaacuggaccaagguccuccgcggccccaccgaggagcgccucgacaucaagcacaaccgcccccgccgcgacugcgucgccgagggcaaggucugcgacccccucugcuccuccggcggcugcuggggccccggccccggccagugccucuccugccgcaacuacucccgcggcggcgucugcgucacccacugcaacuuccucaacggcgagccccgcgaguucgcccacgaggccgagugcuucuccugccaccccgagugccagcccauggagggcaccgccaccugcaacggcuccggcuccgacaccugcgcccagugcgcccacuuccgcgacggcccccacugcgucuccuccugcccccacggcguccucggcgccaagggccccaucuacaaguaccccgacguccagaacgagugccgccccugccacgagaacugcacccagggcugcaagggccccgagcuccaggacugccucggccagacccucguccucaucggcaagacccaccucaccauggcccucaccgucaucgccggccucgucgucaucuucaugaugcucggcggcaccuuccucuacuggcgcggccgccgcauccagaacaagcgcgccaugcgccgcuaccucgagcgcggcgaguccaucgagccccucgaccccuccgagaaggccaacaagguccucgcccgcaucuucaaggagaccgagcuccgcaagcucaagguccucggcuccggcgucuucggcaccguccacaagggcgucuggauccccgagggcgaguccaucaagauccccgucugcaucaaggucaucgaggacaaguccggccgccaguccuuccaggccgucaccgaccacaugcucgccaucggcucccucgaccacgcccacaucguccgccuccucggccucugccccggcuccucccuccagcucgucacccaguaccucccccucggcucccuccucgaccacguccgccagcaccgcggcgcccucggcccccagcuccuccucaacuggggcguccagaucgccaagggcauguacuaccucgaggagcacggcaugguccaccgcaaccucgccgcccgcaacguccuccucaagucccccucccagguccaggucgccgacuucggcgucgccgaccuccucccccccgacgacaagcagcuccucuacuccgaggccaagacccccaucaaguggauggcccucgaguccauccacuucggcaaguacacccaccaguccgacgucugguccuacggccagugcaucuggaugcccucccuccccucccucgcccccgucuccaaccuccccuucgagacccccuccuga

SEQ ID NO: 1459 - RNA, 2766 nt, Artificial Sequence
  derived and/or modified sequence opt3 from ErbB3__Homo_sapiens__BAG57868
augagagccaacgacgcucuccaggugcugggccuucuguucagcuuggcaaggggguccgaggucggaaauucucaagccguuugccccgguaccuuaaacggccugucagugacaggggaugcggaaaaucaguaccagacucuauauaagcucuacgagcggugugaaguagugaugggaaaccuggagaucguccuuacgggccacaaugcugaccugucguuuuugcaguggauucgcgaagugaccgguuauguucucguggccaugaacgaguucagcacacugccucugccaaaucuccgagucgugcgugggacucaaguauacgauggaaaauuugcaauauucguuauguuaaacuauaauaccaacuccucucaugcccugagacagcuuagguugacacagcugaccgagauccuaucgggcggcguguacauugaaaagaaugacaaacucugccacauggauacuaucgacuggcgggauauuguccgcgacagagaugcugagaucguggugaaggacaacgggaggucauguccgcccugccaugaagucuguaaaggacggugcugggguccuggcagcgaggauugucagacacugaccaagacgauaugcgcaccacaauguaaugggcacugcuuuggacccaacccuaaucaguguugccaugacgagugcgccggcgguuguagugggccacaggauacugacugcuucgcuugucgccacuuuaacgacuccggagccugcguuccccgauguccucagccacuuguguauaacaagcugaccuuccaauuggaaccgaauccccacacaaaauaccaguacggcggcguaugcguggcgucuuguccucauaacuuugucguggaucagacuagcugcguuagagcauguccacccgacaagauggagguggauaaaaaugggcucaagaugugcgaaccuuguggaggucugugcccaaaagccugcgagggcaccggguccggaucaagguuccaaacagucgacaguagcaacaucgauggcuuugugaauuguaccaagauuuuagguaaccuggacuuccucaucacggggcuuaauggcgaucccuggcacaagauuccggcucuggacccugaaaaauugaacguauuucggacuguucgugagaucacaggauaucuaaauauacagucuuggcccccacauaugcacaacuucuccguguucucaaaucugaccacuauuggcgggcgcagccucuacaacagaggauuuagucugcuuaucaugaagaaucugaacgucacaucuuuggguuucaggucccucaaagagauuagcgccggccggaucuauaucucggcaaaucgacagcugugcuaccaccauucuuuaaacuggaccaaggugcugcgcgggccuacggaagagagacuagauauuaaacacaacaggccccggcgcgacugugucgcugaaggaaaggugugcgauccacucuguuccucaggcgguugcugggggcccggcccuggacagugucugaguugcagaaauuauagcaggggcgggguuugugugacccauugcaacuuucuuaauggagagccacgugaguucgcccacgaggcggaguguuuuuccugccauccggaaugccaacccauggaggguacagccacuuguaacggcucugggagcgauaccugcgcacagugugcucacuuccgggacggaccucacugcguaucaaguuguccacauggcgucuugggugccaaagggcccauauacaaguauccugacgugcagaaugaaugccgaccaugucacgagaacugcacacagggcuguaagggacccgaacugcaagacugccucggccagacucugguucuuaucgggaaaacccaucugacaauggcuuugaccgugauugccggacucgucgugaucuuuaugaugcugggcgguacuuucuuauacuggagagggaggcgcauacagaauaagcgggcaaugagaagguaccuggagcgcggagaguccauugaaccgcuagauccuagcgagaaagccaacaagguacucgcucgaaucuuuaaagaaacggagcugcggaaacuuaagguguugggcucugguguuuucggcacaguccacaaggggguguggaucccagagggagaaucaauuaagauccccguguguauuaaagucauagaggacaagaguggccgucagagcuuucaagcgguuaccgaucacaugcuggcaaucgggucccucgaccaugcccacauugugagacuguuaggacugugcccuggcucuagucuucaguuggugacucaguaucucccccuggguagccuacuggaucauguaaggcagcaccgcggggcucucggaccacaacugcuuuugaauuggggcguccagaucgccaaagguauguacuaucuggaagaacauggcauggugcaccggaacuuagcagccagaaauguucuccugaaguccccuucacaggugcaagucgcugacuucgggguggccgaucuucugcccccagacgauaagcaguugcucuacagugaagcaaaaaccccgaucaaguggauggcgcuggagucuauucacuuuggaaaauauacacaucagagcgacguuugguccuacggccagugcauauggaugccuucacuacccagccuggcuccagugucuaaccuccccuucgagaccccuuccuga

SEQ ID NO: 1460 - RNA, 2766 nt, Artificial Sequence
  derived and/or modified sequence opt4 from ErbB3__Homo_sapiens__BAG57868
augagagccaacgacgcccugcaggugcugggccugcuguucagccuggccagaggcagcgaggugggcaacagccaggccgugugccccggcacccugaacggccugagcgugaccggcgacgccgagaaccaguaccagacccuguacaagcuguacgagagaugcgagguggugaugggcaaccuggagaucgugcugaccggccacaacgccgaccugagcuuccugcaguggaucagagaggugaccggcuacgugcugguggccaugaacgaguucagcacccugccccugcccaaccugagaguggugagaggcacccagguguacgacggcaaguucgccaucuucgugaugcugaacuacaacaccaacagcagccacgcccugagacagcugagacugacccagcugaccgagauccugagcggcggcguguacaucgagaagaacgacaagcugugccacauggacaccaucgacuggagagacaucgugagagacagagacgccgagaucguggugaaggacaacggcagaagcugcccccccugccacgaggugugcaagggcagaugcuggggccccggcagcgaggacugccagacccugaccaagaccaucugcgccccccagugcaacggccacugcuucggccccaaccccaaccagugcugccacgacgagugcgccggcggcugcagcggcccccaggacaccgacugcuucgccugcagacacuucaacgacagcggcgccugcgugcccagaugcccccagccccugguguacaacaagcugaccuuccagcuggagcccaacccccacaccaaguaccaguacggcggcgugugcguggccagcugcccccacaacuucgugguggaccagaccagcugcgugagagccugcccccccgacaagauggagguggacaagaacggccugaagaugugcgagcccugcggcggccugugccccaaggccugcgagggcaccggcagcggcagcagauuccagaccguggacagcagcaacaucgacggcuucgugaacugcaccaagauccugggcaaccuggacuuccugaucaccggccugaacggcgaccccuggcacaagauccccgcccuggaccccgagaagcugaacguguucagaaccgugagagagaucaccggcuaccugaacauccagagcuggcccccccacaugcacaacuucagcguguucagcaaccugaccaccaucggcggcagaagccuguacaacagaggcuucagccugcugaucaugaagaaccugaacgugaccagccugggcuucagaagccugaaggagaucagcgccggcagaaucuacaucagcgccaacagacagcugugcuaccaccacagccugaacuggaccaaggugcugagaggccccaccgaggagagacuggacaucaagcacaacagacccagaagagacugcguggccgagggcaaggugugcgacccccugugcagcagcggcggcugcuggggccccggccccggccagugccugagcugcagaaacuacagcagaggcggcgugugcgugacccacugcaacuuccugaacggcgagcccagagaguucgcccacgaggccgagugcuucagcugccaccccgagugccagcccauggagggcaccgccaccugcaacggcagcggcagcgacaccugcgcccagugcgcccacuucagagacggcccccacugcgugagcagcugcccccacggcgugcugggcgccaagggccccaucuacaaguaccccgacgugcagaacgagugcagacccugccacgagaacugcacccagggcugcaagggccccgagcugcaggacugccugggccagacccuggugcugaucggcaagacccaccugaccauggcccugaccgugaucgccggccugguggugaucuucaugaugcugggcggcaccuuccuguacuggagaggcagaagaauccagaacaagagagccaugagaagauaccuggagagaggcgagagcaucgagccccuggaccccagcgagaaggccaacaaggugcuggccagaaucuucaaggagaccgagcugagaaagcugaaggugcugggcagcggcguguucggcaccgugcacaagggcguguggauccccgagggcgagagcaucaagauccccgugugcaucaaggugaucgaggacaagagcggcagacagagcuuccaggccgugaccgaccacaugcuggccaucggcagccuggaccacgcccacaucgugagacugcugggccugugccccggcagcagccugcagcuggugacccaguaccugccccugggcagccugcuggaccacgugagacagcacagaggcgcccugggcccccagcugcugcugaacuggggcgugcagaucgccaagggcauguacuaccuggaggagcacggcauggugcacagaaaccuggccgccagaaacgugcugcugaagagccccagccaggugcagguggccgacuucggcguggccgaccugcugccccccgacgacaagcagcugcuguacagcgaggccaagacccccaucaaguggauggcccuggagagcauccacuucggcaaguacacccaccagagcgacguguggagcuacggccagugcaucuggaugcccagccugcccagccuggcccccgugagcaaccugcccuucgagacccccagcuga

SEQ ID NO: 1461 - RNA, 2766 nt, Artificial Sequence
  derived and/or modified sequence opt5 from ErbB3__Homo_sapiens__BAG57868
augagagccaacgacgcucuccaggugcugggccugcuuuucagccuggcccggggguccgaggucggaaauucucaagcgguuugccccggcacccucaacgggcugagcgugacaggagaugcugaaaaucaguaccagacgcuuuauaagcuguacgagcgcugugaaguggucaugggcaaccucgagaucgugcugaccgggcacaaugccgaccuguccuuucuccaguggauuagagaaguuacaggauaugugcuggucgccaugaacgaguucucuacccuuccucugccgaaucuccgggugguucgcggcacacaaguguacgauggcaaauuugcuaucuucgucaugcugaacuauaauaccaacagcucccaugcccuuagacagcugcggcucacacagcugaccgagauucugucugggggaguguacaucgaaaagaaugacaaacucugccacauggauacgauugacuggcgcgauaucgugagagaccgggaugcugagaucgucguuaaggacaacggccgcagcugucccccuugccaugaaguguguaaagggagaugcuggggacccggcuccgaggauugucagacccugacaaagaccauuugcgccccucaauguaaugggcacugcuuuggacccaacccuaaucaguguugccaugacgagugcgcgggcggcuguagcgggccgcaggauacagacugcuucgccugucggcacuuuaacgacucuggagcuugcgugccccgcuguccucagccccuugucuauaacaagcugaccuuccaacucgaaccuaauccccacacgaaauaccaguacggcggggugugcguugccuccuguccgcauaacuuuguggucgaucagacaagcugcgugagagcuuguccucccgacaagauggagguugauaaaaauggacugaagaugugcgaaccuuguggcgggcuuugccccaaagccugcgagggaaccggcucuggcucccgguuccaaacaguggacagcucuaacaucgauggguuugucaauuguaccaagauucugggaaaccucgacuuccugaucaccggccugaauggggaucccuggcacaagauuccugcgcucgacccggaaaaacugaacguguuucgcacagucagagagaucacgggauaucuuaauauucaguccuggcccccucauaugcacaacuucagcguguucuccaaucugaccacaaucggcgggcggucucucuacaacagaggcuuuagccugcuuaucaugaagaaucugaacguuaccucccucggauuccgcagccugaaagagauuucugccggccggaucuauauuuccgcuaauagacagcugugcuaccaccauagccucaacuggacaaaggugcugcgcgggcccaccgaagaacggcuugauaucaaacacaacagaccucgccgggacugugucgccgaaggaaaggugugcgauccccuguguucuagcggcgggugcuggggaccgggcccugggcagugucucuccugcagaaauuauucucgcggcggaguuugugugacgcauugcaacuuucugaauggcgagccccgggaguucgcucacgaggccgaguguuuuagcugccauccugaaugccaacccauggaggggacagccaccuguaacggauccggcagcgauaccugcgcucagugugcgcacuucagagacgggccucacugcgucucuuccuguccccauggagugcugggcgccaaagggccgauuuacaaguauccugacgugcagaaugaaugccgccccugucacgagaacugcacacagggcuguaagggacccgaacuucaagacugccucggccagacccugguucugaucgggaaaacacaucucacgauggcucugaccgucaucgccggacuuguggugauuuuuaugaugcugggcgggacauuccucuacuggcggggaagacggauccagaauaagcgcgccaugagacgguaccuggagagaggcgagagcauugaaccucuggauccgucugagaaagcuaacaagguccuugcccgcaucuuuaaagaaaccgagcuccggaagcugaaggugcugggguccggcguuuucggaacagugcacaaaggcgucuggauucccgagggggaaagcaucaagaucccuguguguauuaaaguuaucgaggacaaguccggaagacagucuuuucaagcggugaccgaucacaugcucgcuauuggcagccuggaccaugcccacaucguccgccuucuggggcucugccccggauccucucugcagcuggugacgcaguaucuuccucucggcagccugcuggaucauguuagacagcaccggggcgcccucgggccccaacugcuucugaauuggggagugcagauugcuaaaggcauguacuaucucgaggaacaugggaugguccaccgcaaccuggccgcuagaaaugugcugcuuaaguccccuagccaggugcaagucgccgacuucggaguugcggaucuccugcccccggacgauaagcagcugcucuacucugaagccaaaaccccuaucaaguggauggcucuggaguccauucacuuuggcaaauauacacaucagagcgacguguggucuuacgggcagugcaucuggaugcccucccuuccuagccuggcccccgugucuaaccucccguucgagaccccuagcuga

SEQ ID NO: 1462 - protein, 1308 aa, Artificial Sequence
  ERBB4__Homo_sapiens__Q15303
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 1463 - RNA, 3927 nt, Artificial Sequence
  ERBB4__Homo_sapiens__AAB59446
augaagccggcgacaggacuuugggucugggugagccuucucguggcggcggggaccguccagcccagcgauucucagucagugugugcaggaacggagaauaaacugagcucucucucugaccuggaacagcaguaccgagccuugcgcaaguacuaugaaaacugugagguugucaugggcaaccuggagauaaccagcauugagcacaaccgggaccucuccuuccugcggucuguucgagaagucacaggcuacguguuaguggcucuuaaucaguuucguuaccugccucuggagaauuuacgcauuauucgugggacaaaacuuuaugaggaucgauaugccuuggcaauauuuuuaaacuacagaaaagauggaaacuuuggacuucaagaacuuggauuaaagaacuugacagaaauccuaaaugguggagucuauguagaccagaacaaauuccuuuguuaugcagacaccauucauuggcaagauauuguucggaacccauggccuuccaacuugacucuugugucaacaaaugguaguucaggauguggacguugccauaaguccuguacuggccguugcuggggacccacagaaaaucauugccagacuuugacaaggacggugugugcagaacaaugugacggcagaugcuacggaccuuacgucagugacugcugccaucgagaaugugcuggaggcugcucaggaccuaaggacacagacugcuuugccugcaugaauuucaaugacaguggagcauguguuacucaguguccccaaaccuuugucuacaauccaaccaccuuucaacuggagcacaauuucaaugcaaaguacacauauggagcauucugugucaagaaauguccacauaacuuugugguagauuccaguucuugugugcgugccugcccuaguuccaagauggaaguagaagaaaaugggauuaaaauguguaaaccuugcacugacauuugcccaaaagcuugugauggcauuggcacaggaucauugaugucagcucagacuguggauuccaguaacauugacaaauucauaaacuguaccaagaucaaugggaauuugaucuuucuagucacugguauucauggggacccuuacaaugcaauugaagccauagacccagagaaacugaacgucuuucggacagucagagagauaacagguuuccugaacauacagucauggccaccaaacaugacugacuucaguguuuuuucuaaccuggugaccauugguggaagaguacucuauaguggccuguccuugcuuauccucaagcaacagggcaucaccucucuacaguuccagucccugaaggaaaucagcgcaggaaacaucuauauuacugacaacagcaaccuguguuauuaucauaccauuaacuggacaacacucuucagcacaaucaaccagagaauaguaauccgggacaacagaaaagcugaaaauuguacugcugaaggaauggugugcaaccaucuguguuccagugauggcuguuggggaccugggccagaccaaugucugucgugucgccgcuucaguagaggaaggaucugcauagagucuuguaaccucuaugauggugaauuucgggaguuugagaauggcuccaucuguguggagugugacccccagugugagaagauggaagauggccuccucacaugccauggaccggguccugacaacuguacaaagugcucucauuuuaaagauggcccaaacuguguggaaaaauguccagauggcuuacagggggcaaacaguuucauuuucaaguaugcugauccagaucgggagugccacccaugccauccaaacugcacccaaggguguaacggucccacuagucaugacugcauuuacuacccauggacgggccauuccacuuuaccacaacaugcuagaacuccccugauugcagcuggaguaauuggugggcucuucauucuggucauugugggucugacauuugcuguuuauguuagaaggaagagcaucaaaaagaaaagagccuugagaagauucuuggaaacagaguugguggaaccauuaacucccaguggcacagcacccaaucaagcucaacuucguauuuugaaagaaacugagcugaagaggguaaaaguccuuggcucaggugcuuuuggaacgguuuauaaagguauuuggguaccugaaggagaaacugugaagauuccuguggcuauuaagauucuuaaugagacaacuggucccaaggcaaauguggaguucauggaugaagcucugaucauggcaaguauggaucauccacaccuaguccgguugcugggugugugucugagcccaaccauccagcugguuacucaacuuaugccccauggcugccuguuggaguauguccacgagcacaaggauaacauuggaucacaacugcugcuuaacugguguguccagauagcuaagggaaugauguaccuggaagaaagacgacucguucaucgggauuuggcagcccguaaugucuuagugaaaucuccaaaccaugugaaaaucacagauuuugggcuagccagacucuuggaaggagaugaaaaagaguacaaugcugauggaggaaagaugccaauuaaauggauggcucuggaguguauacauuacaggaaauucacccaucagagugacguuuggagcuauggaguuacuauaugggaacugaugaccuuuggaggaaaacccuaugauggaauuccaacgcgagaaaucccugauuuauuagagaaaggagaacguuugccucagccucccaucugcacuauugacguuuacauggucauggucaaauguuggaugauugaugcugacaguagaccuaaauuuaaggaacuggcugcugaguuuucaaggauggcucgagacccucaaagauaccuaguuauucagggugaugaucguaugaagcuucccaguccaaaugacagcaaguucuuucagaaucucuuggaugaagaggauuuggaagauaugauggaugcugaggaguacuuggucccucaggcuuucaacaucccaccucccaucuauacuuccagagcaagaauugacucgaauaggagugaaauuggacacagcccuccuccugccuacacccccaugucaggaaaccaguuuguauaccgagauggagguuuugcugcugaacaaggagugucugugcccuacagagccccaacuagcacaauuccagaagcuccuguggcacagggugcuacugcugagauuuuugaugacuccugcuguaauggcacccuacgcaagccaguggcaccccauguccaagaggacaguagcacccagagguacagugcugaccccaccguguuugccccagaacggagcccacgaggagagcuggaugaggaagguuacaugacuccuaugcgagacaaacccaaacaagaauaccugaauccaguggaggagaacccuuuuguuucucggagaaaaaauggagaccuucaagcauuggauaaucccgaauaucacaaugcauccaaugguccacccaaggccgaggaugaguaugugaaugagccacuguaccucaacaccuuugccaacaccuugggaaaagcugaguaccugaagaacaacauacugucaaugccagagaaggccaagaaagcguuugacaacccugacuacuggaaccacagccugccaccucggagcacccuucagcacccagacuaccugcaggaguacagcacaaaauauuuuuauaaacagaaugggcggauccggccuauuguggcagagaauccugaauaccucucugaguucucccugaagccaggcacugugcugccgccuccaccuuacagacaccggaauacugugguguaa

SEQ ID NO: 1464 - RNA, 3927 nt, Artificial Sequence
  derived and/or modified sequence opt1 from ERBB4__Homo_sapiens__AAB59446
augaagcccgccaccggccugugggugugggucagccuccugguggccgcggggaccgugcagcccuccgacagccaguccgucugcgccggcacggagaacaagcugagcucccucagcgaccuggagcagcaguaccgcgcccugcggaaguacuacgagaacugcgagguggugauggggaaccucgagaucaccuccaucgagcacaaccgcgaccugagcuuccugcgguccguccgcgaggugaccggcuacgugcucgucgcccugaaccaguuccgguaccugccccucgagaaccugcgcaucauccgggggaccaagcuguacgaggaccgcuacgcccucgcgaucuuccugaacuaccggaaggacggcaacuucggccugcaggagcucgggcugaagaaccugacggagauccucaacggcgggguguacguggaccagaacaaguuccugugcuacgccgacaccauccacuggcaggacaucguccgcaaccccuggcccagcaaccugacccucguguccaccaacggcagcuccgggugcggccggugccacaagagcugcacgggccgcugcugggggccgaccgagaaccacugccagacccugacccggacggugugcgccgagcagugcgacggccgcugcuacgggcccuacgucuccgacugcugccaccgggagugcgccggcggcugcagcgggcccaaggacaccgacugcuucgcgugcaugaacuucaacgacuccggcgccugcgugacccagugcccccagaccuucguguacaacccgacgaccuuccagcuggagcacaacuucaacgccaaguacaccuacggggccuucugcgucaagaagugcccccacaacuucgugguggacagcuccagcugcguccgcgccugccccagcuccaagauggagguggaggagaacggcaucaagaugugcaagcccugcaccgacaucugcccgaaggcgugcgacgggaucggcacgggcagccucauguccgcccagaccguggacagcuccaacaucgacaaguucaucaacugcaccaagaucaacgggaaccugaucuuccuggucaccggcauccacggggaccccuacaacgccaucgaggccaucgaccccgagaagcucaacguguuccggacgguccgcgagaucaccggcuuccugaacauccagagcuggcccccgaacaugaccgacuucuccguguucagcaaccuggugaccaucgggggccggguccucuacuccggccugagccugcucauccugaagcagcaggggaucacgucccugcaguuccagagccucaaggagaucuccgccggcaacaucuacaucaccgacaacagcaaccugugcuacuaccacaccaucaacuggaccacgcuguucuccaccaucaaccagcgcaucgugauccgggacaaccgcaaggcggagaacugcaccgccgaggggauggugugcaaccaccucugcagcuccgacggcugcugggggcccggccccgaccagugccugagcugccgccgguucucccgcggccggaucugcaucgagagcugcaaccuguacgacggggaguuccgcgaguucgagaacggcagcaucugcgucgagugcgacccccagugcgagaagauggaggacgggcuccugaccugccacggcccgggccccgacaacugcacgaagugcucccacuucaaggacgggcccaacugcguggagaagugccccgacggccugcagggggccaacagcuucaucuucaaguacgccgacccggaccgggagugccaccccugccaccccaacugcacccagggcugcaacgggcccaccucccacgacugcaucuacuacccguggaccggccacagcacccucccccagcacgcccgcacgccccugaucgcggccggcgugaucgggggccuguucauccuggucaucguggggcucaccuucgccguguacguccggcgcaaguccaucaagaagaagcgggcccugcgccgguuccuggagaccgagcucguggagccgcugacccccagcggcacggcccccaaccaggcgcagcugcgcauccucaaggagaccgagcugaagcgggugaagguccugggguccggcgccuucggcaccguguacaaggggaucugggugcccgagggcgagaccgucaagaucccgguggccaucaagauccucaacgagacgaccgggcccaaggccaacguggaguucauggacgaggcgcugaucauggccagcauggaccacccccaccugguccgccuccugggcgugugccugucccccaccauccagcucgugacccagcugaugccgcacgggugccugcucgaguacguccacgagcacaaggacaacaucggcagccagcugcugcucaacuggugcgugcagaucgccaagggcaugauguaccuggaggagcggcgccuggugcaccgggaccucgccgcccgcaacguccuggugaagucccccaaccacgugaagaucacggacuucgggcuggcgcggcuccuggagggcgacgagaaggaguacaacgccgacgggggcaagaugcccaucaaguggauggcccuggagugcauccacuaccgcaaguucacccaccagagcgacgucugguccuacggggugaccaucugggagcucaugaccuucggcggcaagcccuacgacgggaucccgacgcgcgagauccccgaccugcuggagaagggcgagcggcucccccagcccccgaucugcaccaucgacguguacauggucauggugaagugcuggaugaucgacgccgacagccgccccaaguucaaggagcuggccgcggaguucucccggauggcccgcgacccccagcgguaccuggugauccagggggacgaccgcaugaagcuccccagcccgaacgacuccaaguucuuccagaaccugcuggacgaggaggaccucgaggacaugauggacgccgaggaguaccuggucccccaggccuucaacaucccgcccccgaucuacaccagccgggcccgcaucgacagcaaccgguccgagaucggccacagcccgccgcccgcguacacccccauguccggcaaccaguucguguaccgcgacgggggcuucgccgccgagcagggggugagcguccccuaccgggcccccacguccaccauccccgaggcgcccguggcccagggcgccaccgccgagaucuucgacgacagcugcugcaacgggacccugcgcaagcccguggcgccccacguccaggaggacuccagcacgcagcgguacuccgccgaccccaccguguucgcccccgagcgcagcccccggggcgagcucgacgaggagggcuacaugacccccaugcgcgacaagccgaagcaggaguaccugaaccccguggaggagaaccccuucgucucccggcgcaagaacggggaccugcaggcccucgacaaccccgaguaccacaacgccagcaacggcccgcccaaggccgaggacgaguacgugaacgagccccuguaccugaacaccuucgcgaacacgcucgggaaggccgaguaccugaagaacaacauccuguccaugcccgagaaggccaagaaggccuucgacaacccggacuacuggaaccacagccucccgccccgguccacccugcagcaccccgacuaccugcaggaguacagcaccaaguacuucuacaagcagaacggccgcauccggcccaucguggccgagaaccccgaguaccucuccgaguucagccugaagcccgggaccguccugcccccgccgcccuaccgccaccgcaacacggugguguga

SEQ ID NO: 1465 - RNA, 3927 nt, Artificial Sequence
  derived and/or modified sequence opt2 from ERBB4__Homo_sapiens__AAB59446
augaagcccgccaccggccucugggucugggucucccuccucgucgccgccggcaccguccagcccuccgacucccaguccgucugcgccggcaccgagaacaagcucuccucccucuccgaccucgagcagcaguaccgcgcccuccgcaaguacuacgagaacugcgaggucgucaugggcaaccucgagaucaccuccaucgagcacaaccgcgaccucuccuuccuccgcuccguccgcgaggucaccggcuacguccucgucgcccucaaccaguuccgcuaccucccccucgagaaccuccgcaucauccgcggcaccaagcucuacgaggaccgcuacgcccucgccaucuuccucaacuaccgcaaggacggcaacuucggccuccaggagcucggccucaagaaccucaccgagauccucaacggcggcgucuacgucgaccagaacaaguuccucugcuacgccgacaccauccacuggcaggacaucguccgcaaccccuggcccuccaaccucacccucgucuccaccaacggcuccuccggcugcggccgcugccacaaguccugcaccggccgcugcuggggccccaccgagaaccacugccagacccucacccgcaccgucugcgccgagcagugcgacggccgcugcuacggccccuacgucuccgacugcugccaccgcgagugcgccggcggcugcuccggccccaaggacaccgacugcuucgccugcaugaacuucaacgacuccggcgccugcgucacccagugcccccagaccuucgucuacaaccccaccaccuuccagcucgagcacaacuucaacgccaaguacaccuacggcgccuucugcgucaagaagugcccccacaacuucgucgucgacuccuccuccugcguccgcgccugccccuccuccaagauggaggucgaggagaacggcaucaagaugugcaagcccugcaccgacaucugccccaaggccugcgacggcaucggcaccggcucccucauguccgcccagaccgucgacuccuccaacaucgacaaguucaucaacugcaccaagaucaacggcaaccucaucuuccucgucaccggcauccacggcgaccccuacaacgccaucgaggccaucgaccccgagaagcucaacgucuuccgcaccguccgcgagaucaccggcuuccucaacauccaguccuggccccccaacaugaccgacuucuccgucuucuccaaccucgucaccaucggcggccgcguccucuacuccggccucucccuccucauccucaagcagcagggcaucaccucccuccaguuccagucccucaaggagaucuccgccggcaacaucuacaucaccgacaacuccaaccucugcuacuaccacaccaucaacuggaccacccucuucuccaccaucaaccagcgcaucgucauccgcgacaaccgcaaggccgagaacugcaccgccgagggcauggucugcaaccaccucugcuccuccgacggcugcuggggccccggccccgaccagugccucuccugccgccgcuucucccgcggccgcaucugcaucgaguccugcaaccucuacgacggcgaguuccgcgaguucgagaacggcuccaucugcgucgagugcgacccccagugcgagaagauggaggacggccuccucaccugccacggccccggccccgacaacugcaccaagugcucccacuucaaggacggccccaacugcgucgagaagugccccgacggccuccagggcgccaacuccuucaucuucaaguacgccgaccccgaccgcgagugccaccccugccaccccaacugcacccagggcugcaacggccccaccucccacgacugcaucuacuaccccuggaccggccacuccacccucccccagcacgcccgcaccccccucaucgccgccggcgucaucggcggccucuucauccucgucaucgucggccucaccuucgccgucuacguccgccgcaaguccaucaagaagaagcgcgcccuccgccgcuuccucgagaccgagcucgucgagccccucacccccuccggcaccgcccccaaccaggcccagcuccgcauccucaaggagaccgagcucaagcgcgucaagguccucggcuccggcgccuucggcaccgucuacaagggcaucuggguccccgagggcgagaccgucaagauccccgucgccaucaagauccucaacgagaccaccggccccaaggccaacgucgaguucauggacgaggcccucaucauggccuccauggaccacccccaccucguccgccuccucggcgucugccucucccccaccauccagcucgucacccagcucaugccccacggcugccuccucgaguacguccacgagcacaaggacaacaucggcucccagcuccuccucaacuggugcguccagaucgccaagggcaugauguaccucgaggagcgccgccucguccaccgcgaccucgccgcccgcaacguccucgucaagucccccaaccacgucaagaucaccgacuucggccucgcccgccuccucgagggcgacgagaaggaguacaacgccgacggcggcaagaugcccaucaaguggauggcccucgagugcauccacuaccgcaaguucacccaccaguccgacgucugguccuacggcgucaccaucugggagcucaugaccuucggcggcaagcccuacgacggcauccccacccgcgagauccccgaccuccucgagaagggcgagcgccucccccagccccccaucugcaccaucgacgucuacauggucauggucaagugcuggaugaucgacgccgacucccgccccaaguucaaggagcucgccgccgaguucucccgcauggcccgcgacccccagcgcuaccucgucauccagggcgacgaccgcaugaagcuccccucccccaacgacuccaaguucuuccagaaccuccucgacgaggaggaccucgaggacaugauggacgccgaggaguaccucgucccccaggccuucaacauccccccccccaucuacaccucccgcgcccgcaucgacuccaaccgcuccgagaucggccacucccccccccccgccuacacccccauguccggcaaccaguucgucuaccgcgacggcggcuucgccgccgagcagggcgucuccguccccuaccgcgcccccaccuccaccauccccgaggcccccgucgcccagggcgccaccgccgagaucuucgacgacuccugcugcaacggcacccuccgcaagcccgucgccccccacguccaggaggacuccuccacccagcgcuacuccgccgaccccaccgucuucgcccccgagcgcuccccccgcggcgagcucgacgaggagggcuacaugacccccaugcgcgacaagcccaagcaggaguaccucaaccccgucgaggagaaccccuucgucucccgccgcaagaacggcgaccuccaggcccucgacaaccccgaguaccacaacgccuccaacggcccccccaaggccgaggacgaguacgucaacgagccccucuaccucaacaccuucgccaacacccucggcaaggccgaguaccucaagaacaacauccucuccaugcccgagaaggccaagaaggccuucgacaaccccgacuacuggaaccacucccuccccccccgcuccacccuccagcaccccgacuaccuccaggaguacuccaccaaguacuucuacaagcagaacggccgcauccgccccaucgucgccgagaaccccgaguaccucuccgaguucucccucaagcccggcaccguccucccccccccccccuaccgccaccgcaacaccgucgucuga

SEQ ID NO: 1466 - RNA, 3927 nt, Artificial Sequence
  derived and/or modified sequence opt3 from ERBB4__Homo_sapiens__AAB59446
augaagcccgccaccggccugugggugugggucagccuccuuguugcugcagggacagugcagccuuccgacucucaaucaguaugcgccggaacugaaaacaaacugaguagcuuguccgauuuagaacagcaguacagagcgcugaggaaguauuacgagaauugugaaguggucauggguaaccuagagaucacgucuauugaacacaaucgggaccucucguuccugcgcucagugcgagagguuaccggcuaugugcuugucgcucugaaccaguuucguuacuugccacucgagaaucugagaauaaucagggggacaaaacuguaugaagaucgguacgcccucgcaauuuucuuaaacuaucgcaaggacggaaauuuuggccugcaagagcuugguuugaaaaaccugacugaaauccuaaaugggggaguguacguagaucagaacaaguuccucugcuacgccgacaccauucauuggcaggauaucguuagaaauccguggcccagcaaccugacacuugugaguaccaauggcuccucuggcugugggaggugccacaagagcuguacuggacggugcugggguccuacagagaaccauugucagacccugacgcgcacugucugcgcugagcaaugugacggccgaugcuaugggccauacguguccgauuguugccacagagaaugcgcaggaggcuguucaggucccaaagacaccgauugcuuugccuguaugaauuucaacgacaguggggcuugcgugacacaguguccucagacuuuugucuauaacccaaccacauuccaguuggagcauaauuuuaacgccaaguacaccuauggagcguucugcguuaaaaaguguccccacaauuuugugguagauucuagcuccugcgugagggcauguccuucaagcaaaauggaagucgaggaaaacggcauaaagaugugcaagccauguacggacaucugcccgaaagccugcgacggcauugggacuggaagucucaugucugcucaaacaguggauuccagcaauaucgacaaguucauuaacuguaccaaaaucaaugguaaccugauauuuuuaguuacuggcauucacggggaucccuacaaugccaucgaggcaauugacccugagaagcugaacguguuccggacaguccgugaaaucaccggauuccucaauauccagucguggccacccaacaugacggauuuuucuguguucuccaaucuuguaaccauuggcggucgcguucuguauucaggguugagucuacugauacucaaacagcaaggcaucacaagccugcaguuucagucccuuaaggagauuucugcuggaaacaucuacauaacugacaauagcaaccugugcuacuaucauaccauuaacuggacaacuuuguucucaaccaucaaucagagaaucgugauuagggauaaccggaaagccgaaaauuguacagcggagggcauggucugcaaccaccucuguaguuccgacgggugcuggggaccugguccagaucaaugucugagcugccgacgcuuuucuagaggcaggaucuguauugaaucaugcaauuuauacgacggggaguuccgggaguuugaaaacggaaguauauguguggagugcgauccccagugcgaaaagauggaggacggccugcuaaccugucaugguccggggccugacaauugcacuaaguguagccacuucaaagauggccccaacugcgucgaaaaguguccagacggacuccagggcgccaauuccuuuaucuucaaauaugcagauccugaccgcgagugccaccccugucauccaaacugcacgcagggguguaauggacccacaucucacgauugcauuuacuauccuuggaccggucauucgacucugccacaacacgcuagaaccccgcuuaucgccgcuggcgugaucgggggauuguuuauucugguuauagugggccucacauucgccguauacgucaggcguaagagcaucaaaaagaagcgggcacugcgaagauuucuugagaccgaacugguggagcccuugacuccuuccgguacagccccaaaccaggcucagcucaggauucugaaagaaacggaguuaaagcgcguuaaagugcuggggucaggcgcguucggaaccgucuauaagggcaucugggugcccgagggggaaacuguaaaaauuccuguggcaaucaagauacuaaaugagacaaccggaccaaaggccaacguugaguucauggacgaagcucucaucauggccaguauggaucauccccaccugguccggcuuuugggcgugugucugucuccgacaauucagcucgugacucaacugaugccucacgguugcuuacuggaauacguccaugagcacaaagacaauaucgggagccagcuuuugcucaacuggugcguucagauugcaaagggaaugauguaccuggaggaaagaaggcuagugcaucgcgaucuggccgcucgaaacgugcucguaaaauccccaaaucacgucaagaucaccgacuuuggccuggcccggcuuuuggagggugaugaaaaagaguauaacgcagacggcgggaagaugcccauaaaguggauggcgcuggaauguauucacuaccguaaauucacgcaucagucagauguguggagcuauggaguuaccaucugggaguuaaugacauuuggcgggaagccuuacgacggcauucccacuagagagaucccagaccuccuggaaaaaggagagaggcuuccucaacccccaauaugcaccaucgauguguauauggucauggugaaguguuggaugauugacgcugauucucgcccgaaauucaaggaacuggccgcagaguuuucccggauggccagagacccucagagguacuugguuauccagggugaugaccgaaugaaacuccccaguccaaaugauagcaaguucuuucaaaaccugcuagacgaagaggaucuggaggacaugauggaugcugaagaguaucucgugccccaggccuucaauauuccuccacccaucuacacaucucgcgcacggauagacuccaacagaucagaaauugggcacaguccuccgccagcuuacacucccaugagcggaaaucaguuuguauauagggauggcgguuucgccgcggagcagggcgucucggugccuuaccgugccccaaccuccacgauccccgaggcuccuguggcacaaggggccacagcugaaaucuuugacgacucuugcuguaacggaacccugcgcaagccggucgcaccccauguucaggaggauagcucaacucagcgguauagugccgacccaacaguguucgcgccugaaagaucccccaggggcgagcuugaugaagagggguacaugaccccaaugcgagacaaaccuaagcaggaguauuugaaucccguagaagagaacccauuugugucucggcgcaaaaauggagaucugcaagccuuagacaacccggaauaccacaaugcuagcaacggcccucccaaggccgaggaugaauaugucaaugagccacucuaccugaacacuuucgcaaacacccuugguaaagcugaguaccugaagaauaacauucuauccaugcccgaaaaggccaaaaaggcauucgacaauccugauuauuggaaccauucacucccacccagaagcacacugcagcacccugacuacuugcaggaguauaguacgaaauacuuuuauaagcagaaugggaggauccggccgauuguggccgaaaacccagaguaccugucugaguucuccuuaaaacccggaaccguucucccucccccaccuuaucgacacagaaauacuguggucuga

SEQ ID NO: 1467 - RNA, 3927 nt, Artificial Sequence
  derived and/or modified sequence opt4 from ERBB4__Homo_sapiens__AAB59446
augaagcccgccaccggccugugggugugggugagccugcugguggccgccggcaccgugcagcccagcgacagccagagcgugugcgccggcaccgagaacaagcugagcagccugagcgaccuggagcagcaguacagagcccugagaaaguacuacgagaacugcgagguggugaugggcaaccuggagaucaccagcaucgagcacaacagagaccugagcuuccugagaagcgugagagaggugaccggcuacgugcugguggcccugaaccaguucagauaccugccccuggagaaccugagaaucaucagaggcaccaagcuguacgaggacagauacgcccuggccaucuuccugaacuacagaaaggacggcaacuucggccugcaggagcugggccugaagaaccugaccgagauccugaacggcggcguguacguggaccagaacaaguuccugugcuacgccgacaccauccacuggcaggacaucgugagaaaccccuggcccagcaaccugacccuggugagcaccaacggcagcagcggcugcggcagaugccacaagagcugcaccggcagaugcuggggccccaccgagaaccacugccagacccugaccagaaccgugugcgccgagcagugcgacggcagaugcuacggccccuacgugagcgacugcugccacagagagugcgccggcggcugcagcggccccaaggacaccgacugcuucgccugcaugaacuucaacgacagcggcgccugcgugacccagugcccccagaccuucguguacaaccccaccaccuuccagcuggagcacaacuucaacgccaaguacaccuacggcgccuucugcgugaagaagugcccccacaacuucgugguggacagcagcagcugcgugagagccugccccagcagcaagauggagguggaggagaacggcaucaagaugugcaagcccugcaccgacaucugccccaaggccugcgacggcaucggcaccggcagccugaugagcgcccagaccguggacagcagcaacaucgacaaguucaucaacugcaccaagaucaacggcaaccugaucuuccuggugaccggcauccacggcgaccccuacaacgccaucgaggccaucgaccccgagaagcugaacguguucagaaccgugagagagaucaccggcuuccugaacauccagagcuggccccccaacaugaccgacuucagcguguucagcaaccuggugaccaucggcggcagagugcuguacagcggccugagccugcugauccugaagcagcagggcaucaccagccugcaguuccagagccugaaggagaucagcgccggcaacaucuacaucaccgacaacagcaaccugugcuacuaccacaccaucaacuggaccacccuguucagcaccaucaaccagagaaucgugaucagagacaacagaaaggccgagaacugcaccgccgagggcauggugugcaaccaccugugcagcagcgacggcugcuggggccccggccccgaccagugccugagcugcagaagauucagcagaggcagaaucugcaucgagagcugcaaccuguacgacggcgaguucagagaguucgagaacggcagcaucugcguggagugcgacccccagugcgagaagauggaggacggccugcugaccugccacggccccggccccgacaacugcaccaagugcagccacuucaaggacggccccaacugcguggagaagugccccgacggccugcagggcgccaacagcuucaucuucaaguacgccgaccccgacagagagugccaccccugccaccccaacugcacccagggcugcaacggccccaccagccacgacugcaucuacuaccccuggaccggccacagcacccugccccagcacgccagaaccccccugaucgccgccggcgugaucggcggccuguucauccuggugaucgugggccugaccuucgccguguacgugagaagaaagagcaucaagaagaagagagcccugagaagauuccuggagaccgagcugguggagccccugacccccagcggcaccgcccccaaccaggcccagcugagaauccugaaggagaccgagcugaagagagugaaggugcugggcagcggcgccuucggcaccguguacaagggcaucugggugcccgagggcgagaccgugaagauccccguggccaucaagauccugaacgagaccaccggccccaaggccaacguggaguucauggacgaggcccugaucauggccagcauggaccacccccaccuggugagacugcugggcgugugccugagccccaccauccagcuggugacccagcugaugccccacggcugccugcuggaguacgugcacgagcacaaggacaacaucggcagccagcugcugcugaacuggugcgugcagaucgccaagggcaugauguaccuggaggagagaagacuggugcacagagaccuggccgccagaaacgugcuggugaagagccccaaccacgugaagaucaccgacuucggccuggccagacugcuggagggcgacgagaaggaguacaacgccgacggcggcaagaugcccaucaaguggauggcccuggagugcauccacuacagaaaguucacccaccagagcgacguguggagcuacggcgugaccaucugggagcugaugaccuucggcggcaagcccuacgacggcauccccaccagagagauccccgaccugcuggagaagggcgagagacugccccagccccccaucugcaccaucgacguguacauggugauggugaagugcuggaugaucgacgccgacagcagacccaaguucaaggagcuggccgccgaguucagcagaauggccagagacccccagagauaccuggugauccagggcgacgacagaaugaagcugcccagccccaacgacagcaaguucuuccagaaccugcuggacgaggaggaccuggaggacaugauggacgccgaggaguaccuggugccccaggccuucaacauccccccccccaucuacaccagcagagccagaaucgacagcaacagaagcgagaucggccacagccccccccccgccuacacccccaugagcggcaaccaguucguguacagagacggcggcuucgccgccgagcagggcgugagcgugcccuacagagcccccaccagcaccauccccgaggcccccguggcccagggcgccaccgccgagaucuucgacgacagcugcugcaacggcacccugagaaagcccguggccccccacgugcaggaggacagcagcacccagagauacagcgccgaccccaccguguucgcccccgagagaagccccagaggcgagcuggacgaggagggcuacaugacccccaugagagacaagcccaagcaggaguaccugaaccccguggaggagaaccccuucgugagcagaagaaagaacggcgaccugcaggcccuggacaaccccgaguaccacaacgccagcaacggcccccccaaggccgaggacgaguacgugaacgagccccuguaccugaacaccuucgccaacacccugggcaaggccgaguaccugaagaacaacauccugagcaugcccgagaaggccaagaaggccuucgacaaccccgacuacuggaaccacagccugccccccagaagcacccugcagcaccccgacuaccugcaggaguacagcaccaaguacuucuacaagcagaacggcagaaucagacccaucguggccgagaaccccgaguaccugagcgaguucagccugaagcccggcaccgugcugccccccccccccuacagacacagaaacaccgugguguga

SEQ ID NO: 1468 - RNA, 3927 nt, Artificial Sequence
  derived and/or modified sequence opt5 from ERBB4__Homo_sapiens__AAB59446
augaagcccgccaccggccugugggugugggucagccuccugguugcugccgggacagugcagccuuccgacucucaaagcgugugcgcgggaacggaaaacaaacuuuccucucugagcgaucucgaacagcaguacagagcucugcggaaguauuacgagaauugugaagucgugaugggcaaccuugagaucaccuccauugaacacaaucgcgaccugucuuuccucagaagcguucgggaggugacaggguauguccugguggcccugaaccaguuucgcuaccucccgcuggagaaucuuagaaucauucggggaaccaaacuguaugaagaucgcuacgcccucgcuaucuuccugaacuauagaaaggacggcaauuuugggcuucaagagcugggacucaaaaaccugacagaaauucugaauggcggcguuuacguggaucagaacaaguuccucugcuacgccgacaccauccauuggcaggauaucguccggaaucccuggccuuccaaccugacacuugugagcaccaaugggucuuccggauguggccgcugccacaagagcuguacggggagaugcuggggacccaccgagaaccauugucagacacugacccggacagugugcgcugagcaaugugacggccgcugcuaugggccuuacgucucugauuguugccacagagaaugcgccggaggcuguuccggccccaaagacaccgauugcuuugcguguaugaauuucaacgacagcggggccugcguuacgcaguguccucagacauuuguguauaacccgaccacauuccagcucgagcauaauuuuaacgcuaaguacaccuauggagccuucugcgugaaaaaguguccccacaauuuugucguggauucuuccagcugcguucgggcuuguccuuccucuaaaauggaaguggaggaaaacggcauuaagaugugcaagcccuguaccgacaucugcccuaaagccugcgacgggauuggaacaggcagccugauguccgcgcaaacggucgauagcucuaauaucgacaaguucauuaacuguaccaaaaucaaugggaaccuuauuuuucuggugacaggaauccacggcgaucccuacaaugccaucgaggcuauugacccggagaagcucaacguuuuccgcaccgugagagaaaucacaggcuuccugaauauucaguccuggccucccaacaugaccgauuuuagcgucuucucuaaucuggugacgaucgggggacggguccucuauagcggccugucccuucugauucucaaacagcaagggaucacaucucugcaguuucagagccuuaaggagaucuccgccggaaacauuuacaucaccgacaauagcaaccugugcuacuaucauaccauuaacuggacaacccucuucucuacaaucaaucagagaauugugauccgcgauaaccggaaagcugaaaauuguacggccgagggcaugguuugcaaccaccuguguuccagcgacgggugcuggggcccuggacccgaucaaugucugucuugcagacgcuuuucccggggcagaaucuguauugaaagcugcaaucucuacgacggggaguuccgcgaguuugaaaacggauccaucuguguggagugcgauccccagugcgaaaagauggaggacggccugcuuaccugucaugggccuggaccggacaauugcacaaaguguucucacuucaaagauggccccaacugcgucgaaaaguguccugacgggcugcagggcgccaauagcuuuauuuucaaauaugcugaucccgaccgggagugccacccuugucaucccaacugcacccagggauguaauggcccgacaucccacgauugcaucuacuauccuuggaccgggcauucuacgcucccccaacacgcgagaaccccucugauugccgcuggagugaucggcgggcuguuuauucuuguuaucgugggacucacauucgccgucuacgugcgcagaaagagcaucaaaaagaagagagcccugcgccgguuucuggagaccgaacucguggagccccugacaccuuccggcaccgcucccaaccaggcccagcuucggauucugaaagaaacggagcucaagcggguuaaaguccuggggagcggcgcguucggaacaguguauaagggcaucugggugccggagggggaaaccgucaaaauuccuguggcuaucaagauucugaaugagacaaccggacccaaggccaacguugaguucauggacgaagcccuuaucauggcuucuauggaucauccccaccucgugcgccugcugggcgucugucucuccccuaccauccagcuggugacacaacuuaugccgcacgggugccugcucgaauacguucaugagcacaaagacaauauuggaagccagcugcugcuuaacuggugcgugcagaucgccaagggcaugauguaccucgaggaaagacggcugguccauagagaucuggcugcccgcaacgugcucguuaaaucucccaaucacgugaagauuacggacuuugggcuggcgcggcuucuggagggcgaugaaaaagaguauaacgccgacggaggcaagaugccuaucaaguggauggcucucgaauguauucacuacagaaaauucacccaucaguccgaugucuggagcuauggggugacaaucugggagcugaugaccuuuggaggcaagcccuacgacgggaucccuacacgcgagauucccgaccugcuugaaaaaggagagagacucccucaacccccgaucugcaccauugauguguauauggucaugguuaaguguuggaugaucgacgccgauucucggccuaaauucaaggaacuggcugccgaguuuagccgcauggcgagagacccccagcgguaccuggugauucagggcgaugaccgcaugaaacucccuucccccaaugauagcaaguucuuucaaaaccugcuugacgaagaggaucuggaggacaugauggaugccgaagaguaucucgugccgcaggcuuucaauaucccucccccuaucuacacgucuagagcccggauugacuccaaccgcagcgaaaucggccacuccccuccgcccgcuuacacacccaugucugggaaucaguuugucuauagagauggaggcuucgccgccgagcagggggugagcguucccuaccgggcuccuaccuccaccauucccgaggcgccuguggcccaaggagcuacagccgaaaucuuugacgacucuugcuguaacggcacccugcgcaagcccgucgccccucaugugcaggaggauagcuccacacagagauauucugcugacccgacgguuuucgcccccgaacggagcccuagaggggagcuggaugaagagggauacaugacccccaugcgcgacaaaccuaagcaggaguaucuuaaucccguggaagagaacccguuugucucccggcgcaaaaauggcgaucugcaagcgcucgacaacccugaauaccacaaugcuagcaacggcccucccaaggccgaggaugaauaugugaaugagccccuguaccucaacacauucgccaacacccuggggaaagcugaguaccuuaagaauaacauucugucuaugcccgaaaaggccaaaaaggcguucgacaauccugauuauuggaaccauucccucccgcccagaagcacacugcagcacccugacuaccugcaggaguauucuaccaaauacuuuuauaagcagaauggacggaucagacccauuguugcugaaaacccugaguaccuuuccgaguucagccugaaacccggcacggugcucccgccucccccuuaucgccaccggaauaccgucguguga

SEQ ID NO: 1469 - protein, 486 aa, Artificial Sequence
  ERG__Homo_sapiens__P11308
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 1470 - RNA, 1461 nt, Artificial Sequence
  ERG__Homo_sapiens__CCDS46648.1
augauucagacugucccggacccagcagcucauaucaaggaagccuuaucaguugugagugaggaccagucguuguuugagugugccuacggaacgccacaccuggcuaagacagagaugaccgcguccuccuccagcgacuauggacagacuuccaagaugagcccacgcgucccucagcaggauuggcugucucaacccccagccagggucaccaucaaaauggaauguaacccuagccaggugaauggcucaaggaacucuccugaugaaugcaguguggccaaaggcgggaagauggugggcagcccagacaccguugggaugaacuacggcagcuacauggaggagaagcacaugccacccccaaacaugaccacgaacgagcgcagaguuaucgugccagcagauccuacgcuauggaguacagaccaugugcggcaguggcuggagugggcggugaaagaauauggccuuccagacgucaacaucuuguuauuccagaacaucgaugggaaggaacugugcaagaugaccaaggacgacuuccagaggcucacccccagcuacaacgccgacauccuucucucacaucuccacuaccucagagagacuccucuuccacauuugacuucagaugauguugauaaagccuuacaaaacucuccacgguuaaugcaugcuagaaacacagggggugcagcuuuuauuuucccaaauacuucaguauauccugaagcuacgcaaagaauuacaacuaggccagauuuaccauaugagccccccaggagaucagccuggaccggucacggccaccccacgccccagucgaaagcugcucaaccaucuccuuccacagugcccaaaacugaagaccagcguccucaguuagauccuuaucagauucuuggaccaacaaguagccgccuugcaaauccaggcaguggccagauccagcuuuggcaguuccuccuggagcuccugucggacagcuccaacuccagcugcaucaccugggaaggcaccaacggggaguucaagaugacggaucccgacgagguggcccggcgcuggggagagcggaagagcaaacccaacaugaacuacgauaagcucagccgcgcccuccguuacuacuaugacaagaacaucaugaccaagguccaugggaagcgcuacgccuacaaguucgacuuccacgggaucgcccaggcccuccagccccaccccccggagucaucucuguacaaguaccccucagaccucccguacaugggcuccuaucacgcccacccacagaagaugaacuuuguggcgccccacccuccagcccuccccgugacaucuuccaguuuuuuugcugccccaaacccauacuggaauucaccaacuggggguauauaccccaacacuaggcuccccaccagccauaugccuucucaucugggcacuuacuacuaa

SEQ ID NO: 1471 - RNA, 1461 nt, Artificial Sequence
  derived and/or modified sequence opt1 from ERG__Homo_sapiens__CCDS46648.1
augauccagaccgugcccgacccggccgcccacaucaaggaggcgcugagcgucguguccgaggaccagagccucuucgagugcgccuacggcacgccccaccuggccaagaccgagaugaccgccuccagcuccagcgacuacgggcagaccuccaagaugagcccccgcgugccccagcaggacuggcugucccagccgcccgcccgggucaccaucaagauggagugcaaccccagccaggugaacggcucccgcaacagccccgacgagugcuccguggcgaagggcgggaagauggucgggagcccggacacggugggcaugaacuacggcuccuacauggaggagaagcacaugcccccgcccaacaugaccaccaacgagcggcgcgugaucguccccgccgaccccacccucuggagcacggaccacgugcggcaguggcuggagugggccgugaaggaguacgggcugcccgacgucaacauccuccuguuccagaacaucgacggcaaggagcugugcaagaugaccaaggacgacuuccagcgccucacccccuccuacaacgccgacauccugcugagccaccuccacuaccugcgggagaccccgcugccccaccucacguccgacgacguggacaaggcgcugcagaacagcccccgccugaugcacgcccggaacaccgggggcgccgccuucaucuuccccaacaccagcguguacccggaggccacccagcgcaucacgacccggcccgaccuccccuacgagcccccgcgccgguccgcguggaccgggcacggccaccccacgccccagagcaaggccgcccagcccuccccgagcaccguccccaagaccgaggaccagcgcccccagcuggacccguaccagauccugggccccaccuccagccggcucgccaaccccggguccggccagauccagcuguggcaguuccugcucgagcugcugagcgacuccagcaacuccagcugcaucaccugggaggggacgaacggcgaguucaagaugaccgaccccgacgagguggcccgccgguggggcgagcgcaaguccaagccgaacaugaacuacgacaagcucagccgggcgcugcgcuacuacuacgacaagaacaucaugaccaaggugcacgggaagcgguacgccuacaaguucgacuuccacggcaucgcccaggcccugcagccccacccgcccgaguccagccucuacaaguaccccuccgaccugcccuacauggggagcuaccacgcccacccccagaagaugaacuucgucgcgccccacccgcccgcccugcccgugaccuccagcagcuucuucgccgcccccaacccguacuggaacucccccacgggcgggaucuaccccaacacccgccuccccaccagccacaugccgucccaccugggcaccuacuacuga

SEQ ID NO: 1472 - RNA, 1461 nt, Artificial Sequence
  derived and/or modified sequence opt2 from ERG__Homo_sapiens__CCDS46648.1
augauccagaccguccccgaccccgccgcccacaucaaggaggcccucuccgucgucuccgaggaccagucccucuucgagugcgccuacggcaccccccaccucgccaagaccgagaugaccgccuccuccuccuccgacuacggccagaccuccaagauguccccccgcgucccccagcaggacuggcucucccagccccccgcccgcgucaccaucaagauggagugcaaccccucccaggucaacggcucccgcaacucccccgacgagugcuccgucgccaagggcggcaagauggucggcucccccgacaccgucggcaugaacuacggcuccuacauggaggagaagcacaugcccccccccaacaugaccaccaacgagcgccgcgucaucguccccgccgaccccacccucugguccaccgaccacguccgccaguggcucgagugggccgucaaggaguacggccuccccgacgucaacauccuccucuuccagaacaucgacggcaaggagcucugcaagaugaccaaggacgacuuccagcgccucacccccuccuacaacgccgacauccuccucucccaccuccacuaccuccgcgagaccccccucccccaccucaccuccgacgacgucgacaaggcccuccagaacuccccccgccucaugcacgcccgcaacaccggcggcgccgccuucaucuuccccaacaccuccgucuaccccgaggccacccagcgcaucaccacccgccccgaccuccccuacgagcccccccgccgcuccgccuggaccggccacggccaccccaccccccaguccaaggccgcccagcccucccccuccaccguccccaagaccgaggaccagcgcccccagcucgaccccuaccagauccucggccccaccuccucccgccucgccaaccccggcuccggccagauccagcucuggcaguuccuccucgagcuccucuccgacuccuccaacuccuccugcaucaccugggagggcaccaacggcgaguucaagaugaccgaccccgacgaggucgcccgccgcuggggcgagcgcaaguccaagcccaacaugaacuacgacaagcucucccgcgcccuccgcuacuacuacgacaagaacaucaugaccaagguccacggcaagcgcuacgccuacaaguucgacuuccacggcaucgcccaggcccuccagccccacccccccgaguccucccucuacaaguaccccuccgaccuccccuacaugggcuccuaccacgcccacccccagaagaugaacuucgucgccccccacccccccgcccuccccgucaccuccuccuccuucuucgccgcccccaaccccuacuggaacucccccaccggcggcaucuaccccaacacccgccuccccaccucccacaugcccucccaccucggcaccuacuacuga

SEQ ID NO: 1473 - RNA, 1461 nt, Artificial Sequence
  derived and/or modified sequence opt3 from ERG__Homo_sapiens__CCDS46648.1
augauccagaccgugcccgacccugccgcucacauuaaggaggcacugagcgucguuuccgaagaucaaucucucuucgagugcgccuacggcacaccacaucuugcgaaaacugaaaugacggcuucaaguagcuccgacuaugggcagaccucuaagaugucgccgagagugccccagcaggauuggcugucacaaccuccagccaggguaacaauaaaaauggaguguaaccccagccaggugaauggaagucggaacuccccugacgaaugcucugucgcaaaggguggcaaaaugguggggagcccagauacuguuggaaugaauuacggcuccuauauggaggagaagcacaugcccccuccaaacaugaccacaaaugaacgccgagugaucgucccggccgaccccaccuuguggucaacugaucaugugcgucagugguuagagugggcuguaaaggaauacggucugccugacguuaacauucuacucuuucagaauaucgaugggaaagagcuguguaagaugacaaaagacgauuuccaaagacuuaccccaaguuauaacgcagacauucuguugagccaccuccauuaccugagggagacgccccugccucaccucacuucugaugacguggacaaggccuuacaaaauuccccacggcugaugcacgcucgcaacaccggaggcgccgcguuuaucuuccccaauacaucagucuauccggaagcaacucagagaauaaccacaaggccugaucuucccuacgagccaccucggcgcagcgccuggaccggccaugggcaccccacgccacagaguaaagcugcccagcccucuccuuccacugugccaaagacagaagaccagcgaccgcaguuggaucccuaccaaauccugggaccuaccagcucgagacuagcaaacccagguucuggccagauucagcucuggcaguuucugcuugagcuguuguccgacucaaguaauagcuccugcaucacuugggaagggacaaacggagaguucaagaugaccgaucccgacgagguggcuaggcgguggggcgaacguaaaucuaagccuaauaugaacuaugauaaacucagccgcgcccugagauacuauuacgacaagaacauuaugacgaaaguccaugguaagagguaugcguacaaauuugauuuccacgggaucgcccaagcauuacagccacaucccccggagucaagucuguauaaguacccuuccgaccucccauacaugggaagcuaucacgcucacccccagaagaugaauuuuguugccccucaucccccagcccuuccugugaccucuucaaguuucuuugcugcacccaacccauacuggaauagcccgacaggcggcauauauccuaacacucggcugcccaccucccacaugccaucucauuuggggacauacuauuga

SEQ ID NO: 1474 - RNA, 1461 nt, Artificial Sequence
  derived and/or modified sequence opt4 from ERG__Homo_sapiens__CCDS46648.1
augauccagaccgugcccgaccccgccgcccacaucaaggaggcccugagcguggugagcgaggaccagagccuguucgagugcgccuacggcaccccccaccuggccaagaccgagaugaccgccagcagcagcagcgacuacggccagaccagcaagaugagccccagagugccccagcaggacuggcugagccagccccccgccagagugaccaucaagauggagugcaaccccagccaggugaacggcagcagaaacagccccgacgagugcagcguggccaagggcggcaagauggugggcagccccgacaccgugggcaugaacuacggcagcuacauggaggagaagcacaugcccccccccaacaugaccaccaacgagagaagagugaucgugcccgccgaccccacccuguggagcaccgaccacgugagacaguggcuggagugggccgugaaggaguacggccugcccgacgugaacauccugcuguuccagaacaucgacggcaaggagcugugcaagaugaccaaggacgacuuccagagacugacccccagcuacaacgccgacauccugcugagccaccugcacuaccugagagagaccccccugccccaccugaccagcgacgacguggacaaggcccugcagaacagccccagacugaugcacgccagaaacaccggcggcgccgccuucaucuuccccaacaccagcguguaccccgaggccacccagagaaucaccaccagacccgaccugcccuacgagccccccagaagaagcgccuggaccggccacggccaccccaccccccagagcaaggccgcccagcccagccccagcaccgugcccaagaccgaggaccagagaccccagcuggaccccuaccagauccugggccccaccagcagcagacuggccaaccccggcagcggccagauccagcuguggcaguuccugcuggagcugcugagcgacagcagcaacagcagcugcaucaccugggagggcaccaacggcgaguucaagaugaccgaccccgacgagguggccagaagauggggcgagagaaagagcaagcccaacaugaacuacgacaagcugagcagagcccugagauacuacuacgacaagaacaucaugaccaaggugcacggcaagagauacgccuacaaguucgacuuccacggcaucgcccaggcccugcagccccacccccccgagagcagccuguacaaguaccccagcgaccugcccuacaugggcagcuaccacgcccacccccagaagaugaacuucguggccccccacccccccgcccugcccgugaccagcagcagcuucuucgccgcccccaaccccuacuggaacagccccaccggcggcaucuaccccaacaccagacugcccaccagccacaugcccagccaccugggcaccuacuacuga

SEQ ID NO: 1475 - RNA, 1461 nt, Artificial Sequence
  derived and/or modified sequence opt5 from ERG__Homo_sapiens__CCDS46648.1
augauccagaccgugcccgacccugccgcucacauuaaggaggcccugagcgucguuuccgaagaucaaucucucuucgagugcgcguacggcacaccgcaucuggcuaaaacggaaaugaccgccagcuccucuagcgacuaugggcagacauccaagaugucucccagagugccucagcaggauuggcuuagccaacccccugcccgggugaccaucaaaauggaguguaaccccucccaggucaauggaagccgcaacucuccugacgaaugcuccguggcuaagggcgggaaaaugguuggaagcccggauacagugggcaugaauuacgggucuuauauggaggagaagcacaugcccccucccaacaugaccacaaaugaaagacgggucauugugccugccgaccccacccugugguccacggaucauguucgccaguggcucgagugggcugugaaggaauacggacugccggacgucaacauccuucuguuucagaauauugauggcaaagagcucuguaagaugaccaaagacgauuuccaaagacugacaccuagcuauaacgccgacauccugcucucucaucugcacuaccuucgggagacaccccugccucaccucaccuccgaugacguggacaaggcgcugcagaauagcccccgccuuaugcacgccagaaacaccggcggggcugccuuuaucuuccccaauacguccguguauccugaagcuacacagcggauuaccacacgcccggaucugcccuacgagccucccagacggucugccuggaccggacauggccacccuacaccccagagcaaagcggcccaaccguccccuagcaccguccccaagacggaagaccagcgcccucagcucgaucccuaccaaauccuggggccuaccucuuccagacuggcuaaccccggaagcggccagauucagcucuggcaguuucugcuugagcugcucucugacagcuccaauucuagcugcaucacaugggaagggaccaacggagaguucaagaugacagauccggacgagguugcccggcgcuggggcgaaagaaaauccaagccuaauaugaacuaugauaaacugagccgggcucuuagauacuauuacgacaagaacauuaugaccaaagugcauggcaagcgcuaugccuacaaauuugauuuccacgggaucgcccaagcucugcagccccaucccccugagucuucccucuauaaguacccgagcgaccugcccuacaugggaucuuaucacgcgcacccucagaagaugaauuuuguggcuccccauccucccgcccugccugucacguccagcuccuucuuugccgcccccaacccguacuggaacucuccuacaggcgggauuuaucccaauacccggcucccuaccagccacaugcccucccaucugggaacauacuauuga

SEQ ID NO: 1476 - protein, 452 aa, Artificial Sequence
  ETV6__Homo_sapiens__P41212
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 1477 - RNA, 1359 nt, Artificial Sequence
  ETV6__Homo_sapiens__AAA19786
augucugagacuccugcucaguguagcauuaagcaggaacgaauuucauauacaccuccagagagcccagugccgaguuacgcuuccucgacgccacuucauguuccagugccucgagcgcucaggauggaggaagacucgauccgccugccugcgcaccugcgcuugcagccaauuuacuggagcagggaugacguagcccaguggcucaagugggcugaaaaugaguuuucuuuaaggccaauugacagcaacacguuugaaaugaauggcaaagcucuccugcugcugaccaaagaggacuuucgcuaucgaucuccucauucaggugaugugcucuaugaacuccuucagcauauucugaagcagaggaaaccucggauucuuuuuucaccauucuuccacccuggaaacucuauacacacacagccggaggucauacugcaucagaaccaugaagaagauaacuguguccagaggacccccaggccauccguggauaaugugcaccauaacccucccaccauugaacuguugcaccgcuccaggucaccuaucacgacaaaucaccggccuucuccugaccccgagcagcggccccuccgguccccccuggacaacaugauccgccgccucuccccggcugagagagcucagggacccaggccgcaccaggagaacaaccaccaggaguccuacccucugucagugucucccauggagaauaaucacugcccagcguccuccgagucccacccgaagccauccagcccccggcaggagagcacacgcgugauccagcugaugcccagccccaucaugcacccucugauccugaacccccggcacuccguggauuucaaacaguccaggcucuccgaggacgggcugcauagggaagggaagcccaucaaccucucucaucgggaagaccuggcuuacaugaaccacaucauggucucugucuccccgccugaagagcacgccaugcccauugggagaauagcagacuguagacugcuuugggauuacgucuaucaguugcuuucugacagccgguacgaaaacuucauccgaugggaggacaaagaauccaaaauauuccggauaguggaucccaacggacuggcucgacuguggggaaaccauaagaacagaacaaacaugaccuaugagaaaauguccagagcccugcgccacuacuacaaacuaaacauuaucaggaaggagccaggacaaaggcuuuuguucagguuuaugaaaaccccagaugaaaucaugaguggccgaacagaccgucuggagcaccuagagucccaggagcuggaugaacaaauauaccaagaagaugaaugcuga

SEQ ID NO: 1478 - RNA, 1359 nt, Artificial Sequence
  derived and/or modified sequence opt1 from ETV6__Homo_sapiens__AAA19786
augagcgagacccccgcccagugcuccaucaagcaggagcgcaucagcuacaccccgcccgagucccccgugcccagcuacgccuccagcacgccgcugcacguccccgugccccgggcgcuccgcauggaggaggacuccauccggcugcccgcccaccuccgccugcagccgaucuacuggagccgggacgacguggcccaguggcugaagugggccgagaacgaguucucccugcgccccaucgacagcaacaccuucgagaugaacggcaaggcccuccugcugcucaccaaggaggacuuccgguaccgcagcccccacuccggggacguccuguacgagcugcuccagcacauccugaagcagcggaagccccgcauccuguucuccccguucuuccaccccggcaacagcauccacacccagcccgaggugauccuccaccagaaccacgaggaggacaacugcgugcagcggacgccccgcccguccgucgacaacgugcaccacaacccgcccaccaucgagcugcugcaccggagccgcucccccaucaccaccaaccaccggcccagccccgaccccgagcagcgcccccuccgguccccgcuggacaacaugauccgccggcugagccccgcggagcgcgcccaggggccccggccccaccaggagaacaaccaccaggagagcuacccgcucuccgugagccccauggagaacaaccacugccccgccuccagcgagucccacccgaagcccagcagcccccgccaggaguccacgcgcgucauccagcugaugcccuccccgaucaugcacccccugauccucaacccccggcacagcguggacuucaagcagucccgccugagcgaggacggccugcaccgggaggggaagcccaucaaccucucccaccgcgaggaccuggccuacaugaaccacaucauggugagcgucuccccgcccgaggagcacgcgaugcccaucggccggaucgccgacugccgccugcucugggacuacguguaccagcugcugagcgacucccgguacgagaacuucauccgcugggaggacaaggagagcaagaucuuccggaucguggaccccaacggccucgcccgccugugggggaaccacaagaaccggaccaacaugaccuacgagaagaugucccgcgcccugcggcacuacuacaagcucaacaucauccgcaaggagccgggccagcggcugcuguuccgcuucaugaagacccccgacgagaucaugagcgggcggacggaccgccucgagcaccuggagagccaggagcuggacgagcagaucuaccaggaggacgagugcuga

SEQ ID NO: 1479 - RNA, 1359 nt, Artificial Sequence
  derived and/or modified sequence opt2 from ETV6__Homo_sapiens__AAA19786
auguccgagacccccgcccagugcuccaucaagcaggagcgcaucuccuacaccccccccgagucccccguccccuccuacgccuccuccaccccccuccacguccccgucccccgcgcccuccgcauggaggaggacuccauccgccuccccgcccaccuccgccuccagcccaucuacuggucccgcgacgacgucgcccaguggcucaagugggccgagaacgaguucucccuccgccccaucgacuccaacaccuucgagaugaacggcaaggcccuccuccuccucaccaaggaggacuuccgcuaccgcuccccccacuccggcgacguccucuacgagcuccuccagcacauccucaagcagcgcaagccccgcauccucuucucccccuucuuccaccccggcaacuccauccacacccagcccgaggucauccuccaccagaaccacgaggaggacaacugcguccagcgcaccccccgccccuccgucgacaacguccaccacaacccccccaccaucgagcuccuccaccgcucccgcucccccaucaccaccaaccaccgccccucccccgaccccgagcagcgcccccuccgcuccccccucgacaacaugauccgccgccucucccccgccgagcgcgcccagggcccccgcccccaccaggagaacaaccaccaggaguccuacccccucuccgucucccccauggagaacaaccacugccccgccuccuccgagucccaccccaagcccuccuccccccgccaggaguccacccgcgucauccagcucaugcccucccccaucaugcacccccucauccucaacccccgccacuccgucgacuucaagcagucccgccucuccgaggacggccuccaccgcgagggcaagcccaucaaccucucccaccgcgaggaccucgccuacaugaaccacaucauggucuccgucuccccccccgaggagcacgccaugcccaucggccgcaucgccgacugccgccuccucugggacuacgucuaccagcuccucuccgacucccgcuacgagaacuucauccgcugggaggacaaggaguccaagaucuuccgcaucgucgaccccaacggccucgcccgccucuggggcaaccacaagaaccgcaccaacaugaccuacgagaagaugucccgcgcccuccgccacuacuacaagcucaacaucauccgcaaggagcccggccagcgccuccucuuccgcuucaugaagacccccgacgagaucauguccggccgcaccgaccgccucgagcaccucgagucccaggagcucgacgagcagaucuaccaggaggacgagugcuga

SEQ ID NO: 1480 - RNA, 1359 nt, Artificial Sequence
  derived and/or modified sequence opt3 from ETV6__Homo_sapiens__AAA19786
augagcgagacccccgcccagugcuccaucaagcaagaaagaauuucuuacacaccuccagagucaccggugcccaguuaugcuagcuccacuccucugcacgucccaguucccagggcacuccggauggaagaggacucuauacgccuuccugcccaucugcgauugcagccaaucuacuggucgcgugaugacguggcgcagugguuaaaaugggcugaaaacgaguucucacugagacccauugauagcaauacguuugagaugaacggcaaggcccuacuccugcuuaccaaagaagacuucagguaucggaguccucacuccggggauguacuguacgaguugcuccagcauauccugaagcaacgcaaaccaaggauucuguuuucuccguucuuucaccccggaaauagcauccauacacagccugaagugauacuccaccagaaccacgaggaggacaauuguguccagagaacuccacggcccuccguggauaacguucaucacaauccuccaaccaucgaauuacugcaucgcucacgaagucccauuacaaccaaccacagaccgagcccugaccccgagcaaaggccacuucggucuccuuuggauaauaugauccgucgccugucccccgcagaaagagcccaggguccaaggccccaccaggagaacaaucaucaggaaucauauccucuaagcgugaguccaauggagaacaaucacugcccggcuucuuccgagagccaucccaagccuucgucuccacggcaagaauccacucgagucauucagcucaugcccucaccuaucaugcacccacugauacuuaacccccgccauaguguggacuucaagcagagcagacuguccgaggauggcuugcacagggaagggaaaccgauuaaucucucucaccgggaggaccuggcauacaugaaccauaucaugguaagcguuucaccuccagaagaacacgccaugcccauuggacgcaucgcugauuguagauuacugugggacuauguguaccaacuccuuagugacuccagguacgagaacuuuauccguugggaagauaaggagagcaaaauuuuccggauagucgacccuaauggccuggcccgauugugggguaaccauaagaauagaacaaacaugaccuaugagaaaaugucuagggcgcuacgccacuacuauaagcugaauaucauucggaaggagcccgggcagagacuccuguuuagguucaugaaaacgccagaugaaaucaugucaggacgcacugaccgacuugagcaccuggagagucaggaauuggaugagcagauauaccaagaagacgagugcuga

SEQ ID NO: 1481 - RNA, 1359 nt, Artificial Sequence
  derived and/or modified sequence opt4 from ETV6__Homo_sapiens__AAA19786
augagcgagacccccgcccagugcagcaucaagcaggagagaaucagcuacaccccccccgagagccccgugcccagcuacgccagcagcaccccccugcacgugcccgugcccagagcccugagaauggaggaggacagcaucagacugcccgcccaccugagacugcagcccaucuacuggagcagagacgacguggcccaguggcugaagugggccgagaacgaguucagccugagacccaucgacagcaacaccuucgagaugaacggcaaggcccugcugcugcugaccaaggaggacuucagauacagaagcccccacagcggcgacgugcuguacgagcugcugcagcacauccugaagcagagaaagcccagaauccuguucagccccuucuuccaccccggcaacagcauccacacccagcccgaggugauccugcaccagaaccacgaggaggacaacugcgugcagagaacccccagacccagcguggacaacgugcaccacaacccccccaccaucgagcugcugcacagaagcagaagccccaucaccaccaaccacagacccagccccgaccccgagcagagaccccugagaagcccccuggacaacaugaucagaagacugagccccgccgagagagcccagggccccagaccccaccaggagaacaaccaccaggagagcuacccccugagcgugagccccauggagaacaaccacugccccgccagcagcgagagccaccccaagcccagcagccccagacaggagagcaccagagugauccagcugaugcccagccccaucaugcacccccugauccugaaccccagacacagcguggacuucaagcagagcagacugagcgaggacggccugcacagagagggcaagcccaucaaccugagccacagagaggaccuggccuacaugaaccacaucauggugagcgugagcccccccgaggagcacgccaugcccaucggcagaaucgccgacugcagacugcugugggacuacguguaccagcugcugagcgacagcagauacgagaacuucaucagaugggaggacaaggagagcaagaucuucagaaucguggaccccaacggccuggccagacuguggggcaaccacaagaacagaaccaacaugaccuacgagaagaugagcagagcccugagacacuacuacaagcugaacaucaucagaaaggagcccggccagagacugcuguucagauucaugaagacccccgacgagaucaugagcggcagaaccgacagacuggagcaccuggagagccaggagcuggacgagcagaucuaccaggaggacgagugcuga

SEQ ID NO: 1482 - RNA, 1359 nt, Artificial Sequence
  derived and/or modified sequence opt5 from ETV6__Homo_sapiens__AAA19786
augagcgagacccccgcccagugcuccaucaagcaagaaagaauuucuuacacaccuccggagagccccgugccuuccuaugcuucuagcacgccccugcacgucccuguuccccgggcccuccgcauggaagaggacuccaucagacugccugcgcaucuucggcugcagccgauuuacuggucucgcgaugacguggcucaguggcucaaaugggccgaaaacgaguucagccugagacccaucgauuccaauaccuuugagaugaacggcaaggcccuucugcuccugacaaaagaagacuuccgguaucgcagcccucacucuggggaugugcuguacgagcuccugcagcauauucuuaagcaaagaaaaccccggauccuguuuuccccuuucuuucaccccggaaauagcauccauacccagccggaagucauucuccaccagaaccacgaggaggacaauugugugcagcgcacaccuagacccucuguugauaacgugcaucacaauccucccaccaucgaacugcuucaucggucccgcagccccauuacaaccaaccacagaccuucuccggaccccgagcaacggccucugcgcagcccccucgauaauaugaucagacggcuguccccugcugaaagagcccagggcccccgcccgcaccaggagaacaaucaucaggaauccuauccucugucugucagccccauggagaacaaucacugcccugcuuccagcgagucucaucccaagccuuccagcccccggcaagaaucuacgagagugauucagcucaugccgagcccuaucaugcacccccugauucuuaacccccgccauuccguugacuucaagcagucucggcugagcgaggaugggcuccacagagaaggaaaaccuaucaaucugucccaccgcgaggaccuugccuacaugaaccauaucauggugagcgucucuccgcccgaagaacacgcgaugccuauuggccggaucgccgauuguagacugcucugggacuauguguaccaacugcuguccgacagccgcuacgagaacuuuauucggugggaagauaaggagucuaaaaucuucagaauuguggaccccaaugggcucgcucgccuguggggaaaccauaagaaucggaccaacaugacauaugagaaaauguccagagcccuucggcacuacuauaagcugaauaucauccgcaaggagccuggccagagacuccuguuucgguucaugaaaacccccgaugaaauuaugagcggcagaacagaccgccuugagcaccuggagucccaggaacucgaugagcagaucuaccaagaagacgagugcuga

SEQ ID NO: 1483 - protein, 656 aa, Artificial Sequence
  EWS__Homo_sapiens__Q01844
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 1484 - RNA, 1971 nt, Artificial Sequence
  EWS__Homo_sapiens__AAH04817
auggcguccacggauuacaguaccuauagccaagcugcagcgcagcagggcuacagugcuuacaccgcccagcccacucaaggauaugcacagaccacccaggcauaugggcaacaaagcuauggaaccuauggacagcccacugaugucagcuauacccaggcucagaccacugcaaccuaugggcagaccgccuaugcaacuucuuauggacagccucccacugguuauacuacuccaacugccccccaggcauacagccagccuguccagggguauggcacuggugcuuaugauaccaccacugcuacagucaccaccacccaggccuccuaugcagcucagucugcauauggcacucagccugcuuauccagccuaugggcagcagccagcagccacugcaccuacaagaccgcaggauggaaacaagcccacugagacuagucaaccucaaucuagcacaggggguuacaaccagcccagccuaggauauggacagaguaacuacaguuauccccagguaccugggagcuaccccaugcagccagucacugcaccuccauccuacccuccuaccagcuauuccucuacacagccgacuaguuaugaucagagcaguuacucucagcagaacaccuaugggcaaccgagcagcuauggacagcagaguagcuauggucaacaaagcagcuaugggcagcagccucccacuaguuacccaccccaaacuggauccuacagccaagcuccaagucaauauagccaacagagcagcagcuacgggcagcagaguucauuccgacaggaccaccccaguagcauggguguuuaugggcaggagucuggaggauuuuccggaccaggagagaaccggagcaugaguggcccugauaaccggggcaggggaagagggggauuugaucguggaggcaugagcagaggugggcggggaggaggacgcgguggaaugggcagcgcuggagagcgagguggcuucaauaagccugguggacccauggaugaaggaccagaucuugaucuaggcccaccuguagauccagaugaagacucugacaacagugcaauuuauguacaaggauuaaaugacagugugacucuagaugaucuggcagacuucuuuaagcagugugggguuguuaagaugaacaagagaacugggcaacccaugauccacaucuaccuggacaaggaaacaggaaagcccaaaggcgaugccacaguguccuaugaagacccacccacugccaaggcugccguggaaugguuugaugggaaagauuuucaagggagcaaacuuaaagucucccuugcucggaagaagccuccaaugaacaguaugcgggguggucugccaccccgugagggcagaggcaugccaccaccacuccguggagguccaggaggcccaggagguccugggggacccaugggucgcaugggaggccguggaggagauagaggaggcuucccuccaagaggaccccgggguucccgagggaaccccucuggaggaggaaacguccagcaccgagcuggagacuggcagugucccaauccggguuguggaaaccagaacuucgccuggagaacagagugcaaccaguguaaggccccaaagccugaaggcuuccucccgccacccuuuccgcccccggguggugaucguggcagagguggcccugguggcaugcggggaggaagagguggccucauggaucgugguggucccgguggaauguucagagguggccgugguggagacagagguggcuuccgugguggccggggcauggaccgagguggcuuugguggaggaagacgagguggcccuggggggcccccuggaccuuugauggaacagaugggaggaagaagaggaggacguggaggaccuggaaaaauggauaaaggcgagcaccgucaggagcgcagagaucggcccuacuag

SEQ ID NO: 1485 - RNA, 1971 nt, Artificial Sequence
  derived and/or modified sequence opt1 from EWS__Homo_sapiens__AAH04817
auggccagcaccgacuacuccaccuacagccaggccgcggcccagcagggcuacuccgccuacacggcccagcccacccagggguacgcccagaccacccaggcguacggccagcagagcuacgggacguacggccagccgaccgacguguccuacacccaggcccagaccacggccaccuacgggcagaccgccuacgcgaccagcuacggccagccccccacgggcuacaccacccccaccgccccgcaggccuacucccagcccguccagggguacggcacgggggccuacgacaccaccaccgccacggugaccaccacccaggcgagcuacgccgcccaguccgccuacggcacgcagcccgccuaccccgcguacgggcagcagccggccgccaccgcccccacccgcccccaggacggcaacaagcccaccgagacgagccagccgcaguccagcaccggcggguacaaccagcccucccugggcuacgggcagagcaacuacuccuacccccaggugcccggcagcuacccgaugcagcccgucaccgccccccccuccuacccgcccaccagcuacuccagcacgcagcccaccagcuacgaccaguccagcuacucccagcagaacaccuacggccagcccagcuccuacgggcagcagagcuccuacggccagcagagcuccuacgggcagcagccgcccaccagcuaccccccccagacgggcuccuacagccaggcgccgucccaguacagccagcaguccagcuccuacgggcagcagagcuccuuccggcaggaccaccccagcagcaugggcguguacggccaggaguccgggggcuucagcgggcccggcgagaaccgcuccaugagcgggccggacaaccggggccgcggccgggggggcuucgaccgcgggggcaugucccgggggggccgcggcgggggccgggggggcaugggcagcgccggggagcgcggcggguucaacaagcccggcgggcccauggacgagggccccgaccucgaccugggcccgcccguggaccccgacgaggacuccgacaacagcgccaucuacguccaggggcugaacgacuccgugacccucgacgaccuggccgacuucuucaagcagugcggcguggucaagaugaacaagcggaccgggcagcccaugauccacaucuaccuggacaaggagaccggcaagccgaagggggacgccaccgugagcuacgaggacccccccacggcgaaggccgccguggagugguucgacggcaaggacuuccagggcuccaagcucaaggucagccuggcccgcaagaagcccccgaugaacuccaugcgggggggccugcccccccgcgaggggcggggcaugcccccgccccuccgcgggggccccggcgggcccggcgggccgggcgggcccaugggccggaugggcgggcgcggcggggaccggggcggcuuccccccccgcgggccgcggggcagccgcgggaaccccuccggcgggggcaacgugcagcaccgcgcgggcgacuggcagugccccaacccggggugcggcaaccagaacuucgccuggcggaccgagugcaaccagugcaaggcccccaagcccgagggguuccugcccccgcccuucccccccccgggcggggaccgcggccggggcgggcccggcgggaugcgcggcgggcggggcggccugauggaccgcgggggccccgggggcauguuccggggcgggcgcggcggggaccggggcggguuccgcggcggccgggggauggaccgcggcggguucggcgggggccggcgcggcgggcccggcgggccgcccggcccccucauggagcagauggggggccggcgcggcgggcggggcgggcccggcaagauggacaagggggagcaccgccaggagcggcgcgaccgcccguacuga

SEQ ID NO: 1486 - RNA, 1971 nt, Artificial Sequence
  derived and/or modified sequence opt2 from EWS__Homo_sapiens__AAH04817
auggccuccaccgacuacuccaccuacucccaggccgccgcccagcagggcuacuccgccuacaccgcccagcccacccagggcuacgcccagaccacccaggccuacggccagcaguccuacggcaccuacggccagcccaccgacgucuccuacacccaggcccagaccaccgccaccuacggccagaccgccuacgccaccuccuacggccagccccccaccggcuacaccacccccaccgccccccaggccuacucccagcccguccagggcuacggcaccggcgccuacgacaccaccaccgccaccgucaccaccacccaggccuccuacgccgcccaguccgccuacggcacccagcccgccuaccccgccuacggccagcagcccgccgccaccgcccccacccgcccccaggacggcaacaagcccaccgagaccucccagccccaguccuccaccggcggcuacaaccagcccucccucggcuacggccaguccaacuacuccuacccccagguccccggcuccuaccccaugcagcccgucaccgccccccccuccuacccccccaccuccuacuccuccacccagcccaccuccuacgaccaguccuccuacucccagcagaacaccuacggccagcccuccuccuacggccagcaguccuccuacggccagcaguccuccuacggccagcagccccccaccuccuaccccccccagaccggcuccuacucccaggcccccucccaguacucccagcaguccuccuccuacggccagcaguccuccuuccgccaggaccaccccuccuccaugggcgucuacggccaggaguccggcggcuucuccggccccggcgagaaccgcuccauguccggccccgacaaccgcggccgcggccgcggcggcuucgaccgcggcggcaugucccgcggcggccgcggcggcggccgcggcggcaugggcuccgccggcgagcgcggcggcuucaacaagcccggcggccccauggacgagggccccgaccucgaccucggcccccccgucgaccccgacgaggacuccgacaacuccgccaucuacguccagggccucaacgacuccgucacccucgacgaccucgccgacuucuucaagcagugcggcgucgucaagaugaacaagcgcaccggccagcccaugauccacaucuaccucgacaaggagaccggcaagcccaagggcgacgccaccgucuccuacgaggacccccccaccgccaaggccgccgucgagugguucgacggcaaggacuuccagggcuccaagcucaaggucucccucgcccgcaagaagccccccaugaacuccaugcgcggcggccuccccccccgcgagggccgcggcaugccccccccccuccgcggcggccccggcggccccggcggccccggcggccccaugggccgcaugggcggccgcggcggcgaccgcggcggcuuccccccccgcggcccccgcggcucccgcggcaaccccuccggcggcggcaacguccagcaccgcgccggcgacuggcagugccccaaccccggcugcggcaaccagaacuucgccuggcgcaccgagugcaaccagugcaaggcccccaagcccgagggcuuccuccccccccccuuccccccccccggcggcgaccgcggccgcggcggccccggcggcaugcgcggcggccgcggcggccucauggaccgcggcggccccggcggcauguuccgcggcggccgcggcggcgaccgcggcggcuuccgcggcggccgcggcauggaccgcggcggcuucggcggcggccgccgcggcggccccggcggcccccccggcccccucauggagcagaugggcggccgccgcggcggccgcggcggccccggcaagauggacaagggcgagcaccgccaggagcgccgcgaccgccccuacuga

SEQ ID NO: 1487 - RNA, 1971 nt, Artificial Sequence
  derived and/or modified sequence opt3 from EWS__Homo_sapiens__AAH04817
auggccagcaccgacuacuccacauauucucaggcugcagcccaacagggcuacucagcguauacugcucagcccacgcagggguacgcccaaaccacacaggcauauggacagcagaguuacgguacuuauggccaaccuaccgaugugagcuacacacaggcccagaccacugcuacauacgggcagaccgcauaugccacguccuacggacaaccaccgacuggcuauaccacacccacugcuccucaggccuacucucagccaguccaagguuaugggaccggagcguacgacacaaccacggcaacuguuacaaccacucaggccucguaugcugcccagucagcauacggcacacagcccgcuuacccugccuauggccaacagccagcggccaccgcacccacgagaccucaggaugggaacaagccaaccgagacaagccagccgcaaaguuccacuggagguuacaaucagcccucucugggcuaugggcagagcaacuacuccuauccucaggugccaggaucauaccccaugcaaccuguaaccgcuccacccaguuauccgccuacaagcuacucuuccacucagcccaccucauacgaccagagcaguuauucucagcaaaauacauacggccagccauccagcuauggucagcaaucgucuuacgggcagcaguccucauauggacagcaaccucccaccaguuacccaccccagacuggcagcuauucccaggccccuucucaguacagccaacagucaaguuccuacggccagcagagcucuuucaggcaagaucacccaucaaguauggggguguauggacaggaaagcgguggcuuuuccgggccgggagagaaccggucuaugucgggccccgacaaucgcggucgagggcguggcggauucgauagaggcgggaugagcaggggaggucggggcgggggacgcggcgguaugggguccgcuggcgaaagaggaggcuuuaacaaaccugggggaccaauggacgagggucccgaucucgaccuuggcccuccagucgaucccgacgaagauucagacaauagugccaucuacgugcaggggcugaacgacucuguuacguuggaugacuuagcagauuucuuuaagcaaugcggaguggucaaaaugaauaagaggacaggccagccgaugauucauauauaucuggacaaagagaccgguaagccuaagggggaugccacugugagcuacgaggacccacccaccgcuaaagcggcaguagaaugguucgauggcaaggacuuucagggauccaaacuaaagguuucacucgcccggaaaaagccucccaugaacagcaugcgcggcgggcugccaccucgagagggaagaggcaugcccccaccgcuuaggggugggccuggaggccccgguggcccagggggacccaugggccggaugggagggcguggcggugaucgcgggggauucccuccaagaggccccagggguucucggggcaauccuuccgggggaggcaacgugcagcaccgagcuggggacuggcaauguccgaauccaggaugcggcaaccagaauuuugccuggcgcacagaauguaaccagugcaaggcacccaaaccugaggguuuccugccacccccuuuuccgcccccagggggagauagaggcagggguggcccugggggaaugcggggcgggcgcggaggcuugauggacagaggugggcccggaggcauguucaggggcgggcguggaggugaccggggcggguuucgaggaggcagagguauggaucgcgggggauucggcggcgggaggcggggagguccaggcgggccucccggaccacucauggagcagaugggcgguagacgcgggggaaggggcggcccggggaagauggacaaaggagaacaucgacaagagcggcgugauagaccuuauuga

SEQ ID NO: 1488 - RNA, 1971 nt, Artificial Sequence
  derived and/or modified sequence opt4 from EWS__Homo_sapiens__AAH04817
auggccagcaccgacuacagcaccuacagccaggccgccgcccagcagggcuacagcgccuacaccgcccagcccacccagggcuacgcccagaccacccaggccuacggccagcagagcuacggcaccuacggccagcccaccgacgugagcuacacccaggcccagaccaccgccaccuacggccagaccgccuacgccaccagcuacggccagccccccaccggcuacaccacccccaccgccccccaggccuacagccagcccgugcagggcuacggcaccggcgccuacgacaccaccaccgccaccgugaccaccacccaggccagcuacgccgcccagagcgccuacggcacccagcccgccuaccccgccuacggccagcagcccgccgccaccgcccccaccagaccccaggacggcaacaagcccaccgagaccagccagccccagagcagcaccggcggcuacaaccagcccagccugggcuacggccagagcaacuacagcuacccccaggugcccggcagcuaccccaugcagcccgugaccgccccccccagcuacccccccaccagcuacagcagcacccagcccaccagcuacgaccagagcagcuacagccagcagaacaccuacggccagcccagcagcuacggccagcagagcagcuacggccagcagagcagcuacggccagcagccccccaccagcuaccccccccagaccggcagcuacagccaggcccccagccaguacagccagcagagcagcagcuacggccagcagagcagcuucagacaggaccaccccagcagcaugggcguguacggccaggagagcggcggcuucagcggccccggcgagaacagaagcaugagcggccccgacaacagaggcagaggcagaggcggcuucgacagaggcggcaugagcagaggcggcagaggcggcggcagaggcggcaugggcagcgccggcgagagaggcggcuucaacaagcccggcggccccauggacgagggccccgaccuggaccugggcccccccguggaccccgacgaggacagcgacaacagcgccaucuacgugcagggccugaacgacagcgugacccuggacgaccuggccgacuucuucaagcagugcggcguggugaagaugaacaagagaaccggccagcccaugauccacaucuaccuggacaaggagaccggcaagcccaagggcgacgccaccgugagcuacgaggacccccccaccgccaaggccgccguggagugguucgacggcaaggacuuccagggcagcaagcugaaggugagccuggccagaaagaagccccccaugaacagcaugagaggcggccugccccccagagagggcagaggcaugccccccccccugagaggcggccccggcggccccggcggccccggcggccccaugggcagaaugggcggcagaggcggcgacagaggcggcuucccccccagaggccccagaggcagcagaggcaaccccagcggcggcggcaacgugcagcacagagccggcgacuggcagugccccaaccccggcugcggcaaccagaacuucgccuggagaaccgagugcaaccagugcaaggcccccaagcccgagggcuuccugcccccccccuuccccccccccggcggcgacagaggcagaggcggccccggcggcaugagaggcggcagaggcggccugauggacagaggcggccccggcggcauguucagaggcggcagaggcggcgacagaggcggcuucagaggcggcagaggcauggacagaggcggcuucggcggcggcagaagaggcggccccggcggcccccccggcccccugauggagcagaugggcggcagaagaggcggcagaggcggccccggcaagauggacaagggcgagcacagacaggagagaagagacagacccuacuga

SEQ ID NO: 1489 - RNA, 1971 nt, Artificial Sequence
  derived and/or modified sequence opt5 from EWS__Homo_sapiens__AAH04817
auggccagcaccgacuacuccacauauucucaggcugccgcgcaacagggcuacagcgcuuauacggcccagcccacccagggguacgcccaaacaacccaggcuuauggacagcaguccuacggcacauaugggcaaccuaccgaugugucuuacacacaggcccagaccacggcuaccuacggacagacagccuaugcgaccagcuacggccaaccgcccacaggguauaccacgccuacagcuccccaggccuacucccagccuguccaaggauauggcaccggcgccuacgacacaaccaccgcuacaguuacgaccacacaggccucuuaugcggcccagagcgcuuacgggacccagcccgccuacccugcuuauggacaacagccggccgccacagcucccaccagaccucaggauggcaacaagcccacggagacaucccagccucaaagcucuaccgggggauacaaucagcccucccugggcuaugggcagagcaacuacucuuauccccaggugccuggauccuaccccaugcaaccugugaccgcgccgcccagcuauccuccgacaucuuacuccagcacccagcccacauccuacgaccagucuagcuauucccagcaaaauacguacggccagccuagcucuuauggccagcaauccagcuacgggcagcagucuagcuauggacagcaacccccuaccuccuaucccccgcagacaggcucuuacagccaggccccuucccaguacagccaacagucuuccagcuacgggcagcagucuuccuuccggcaagaucaccccagcuccaugggagucuauggccaggaaucugggggauuuagcggcccuggcgagaaccgcuccaugucugggcccgacaauagaggacggggccgcgggggauucgauagaggcgggaugagccggggcggacgcggcgggggaagaggcgggaugggauccgcuggcgaaagagggggcuuuaacaaaccuggaggccccauggacgaggggccggaucucgaccugggaccucccguggaucccgacgaagauagcgacaauucugccaucuacguucagggccuuaacgacuccgugacccuggaugaccucgccgauuucuuuaagcaaugcggggucgugaaaaugaauaagcgcacaggacagccuaugauucauaucuaucuggacaaagagaccggcaagccgaagggggaugcuacgguuagcuacgaggaucccccuaccgccaaagcggcuguggaaugguucgacggcaaggacuuucagggaucuaaacuuaaggucucccuggcccggaaaaagcccccuaugaacagcaugcggggcgggcugcccccucgcgagggaagaggcaugcccccgccucuccgcgggggacccggcgggccuggcggacccggcgggccgaugggacggaugggcgggagaggaggcgaucggggcggguucccucccagaggaccucgcggcucucgggggaaucccagcggaggcgggaacgugcagcacagagccggagacuggcaaugucccaauccuggcugcggcaaccagaauuuugcuuggcgcacagaauguaaccagugcaaggccccgaaacccgagggguuccugccucccccuuuucccccuccgggaggcgaucgggggagaggaggccccgggggaaugcgcggcggcagagggggacucauggaccggggcgggccuggaggcauguuccgcgggggacggggcggcgacagagggggauuucgcggcgggcggggaauggauagaggcggguucggaggcggccggcgcgggggacccggcgggccucccggaccgcugauggagcagaugggcgggagacggggaggcagaggcgggccuggaaagauggacaaaggcgaacaucgccaagagcggagagaucgccccuauuga

SEQ ID NO: 1490 - protein, 665 aa, Artificial Sequence
  EZH2__Homo_sapiens__F2YMM1
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKGQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 1491 - RNA, 1998 nt, Artificial Sequence
  EZH2__Homo_sapiens__AEA07595
augggccagacugggaagaaaucugagaagggaccaguuuguuggcggaagcguguaaaaucagaguacaugcgacugagacagcucaagagguucagacgagcugaugaaguaaagaguauguuuaguuccaaucgucagaaaauuuuggaaagaacggaaaucuuaaaccaagaauggaaacagcgaaggauacagccugugcacauccugacuucugugagcucauugcgcgggacuagggagguggaagaugaaacuguuuuacauaacauuccuuauaugggagaugaaguuuuagaucaggaugguacuuucauugaagaacuaauaaaaaauuaugaugggaaaguacacggggauagagaauguggguuuauaaaugaugaaauuuuuguggaguuggugaaugcccuuggucaauauaaugaugaugacgaugaugaugauggagacgauccugaagaaagagaagaaaagcagaaagaucuggaggaucaccgagaugauaaagaaagccgcccaccucggaaauuuccuucugauaaaauuuuugaagccauuuccucaauguuuccagauaagggcacagcagaagaacuaaaggaaaaauauaaagaacucaccgaacagcagcucccaggcgcacuuccuccugaauguacccccaacauagauggaccaaaugcuaaaucuguucagagagagcaaagcuuacacuccuuucauacgcuuuucuguaggcgauguuuuaaauaugacugcuuccuacauccuuuucaugcaacacccaacacuuauaagcggaagaacacagaaacagcucuagacaacaaaccuuguggaccacaguguuaccagcauuuggagggagcaaaggaguuugcugcugcucucaccgcugagcggauaaagaccccaccaaaacguccaggaggccgcagaagaggacggcuucccaauaacaguagcaggcccagcacccccaccauuaaugugcuggaaucaaaggauacagacagugauagggaagcagggacugaaacggggggagagaacaaugauaaagaagaagaagagaagaaagaugaaacuucgagcuccucugaagcaaauucucggugucaaacaccaauaaagaugaagccaaauauugaaccuccugagaauguggaguggaguggugcugaagccucaauguuuagaguccucauuggcacuuacuaugacaauuucugugccauugcuagguuaauugggaccaaaacauguagacagguguaugaguuuagagucaaagaaucuagcaucauagcuccagcucccgcugaggauguggauacuccuccaaggaaaaagaagaggaaacaccgguugugggcugcacacugcagaaagauacagcugaaaaagggucaaaaccgcuuuccgggaugccgcugcaaagcacagugcaacaccaagcagugcccgugcuaccuggcuguccgagagugugacccugaccucugucuuacuuguggagccgcugaccauugggacaguaaaaauguguccugcaagaacugcaguauucagcggggcuccaaaaagcaucuauugcuggcaccaucugacguggcaggcugggggauuuuuaucaaagauccugugcagaaaaaugaauucaucucagaauacuguggagagauuauuucucaagaugaagcugacagaagagggaaaguguaugauaaauacaugugcagcuuucuguucaacuugaacaaugauuuugugguggaugcaacccgcaaggguaacaaaauucguuuugcaaaucauucgguaaauccaaacugcuaugcaaaaguuaugaugguuaacggugaucacaggauagguauuuuugccaagagagccauccagacuggcgaagagcuguuuuuugauuacagauacagccaggcugaugcccugaaguaugucggcaucgaaagagaaauggaaaucccuuga

SEQ ID NO: 1492 - RNA, 1998 nt, Artificial Sequence
  derived and/or modified sequence opt1 from EZH2__Homo_sapiens__AEA07595
augggccagaccgggaagaaguccgagaagggccccgugugcuggcgcaagcgggucaagagcgaguacaugcgccugcggcagcucaagcgcuuccggcgcgccgacgaggucaagagcauguucuccagcaaccggcagaagauccuggagcgcaccgagauccugaaccaggaguggaagcagcggcgcauccagccggugcacauccucacguccgugagcucccugcgggggacccgcgagguggaggacgagaccgugcugcacaacauccccuacaugggcgacgagguccucgaccaggacgggaccuucaucgaggagcugaucaagaacuacgacggcaaggugcacggcgaccgggagugcggguucaucaacgacgagaucuucguggagcuggucaacgcccucggccaguacaacgacgacgacgacgacgacgacggggacgaccccgaggagcgcgaggagaagcagaaggaccuggaggaccaccgggacgacaaggagagccggcccccgcgcaaguuccccuccgacaagaucuucgaggcgaucagcuccauguuccccgacaagggcacggccgaggagcugaaggagaaguacaaggagcucaccgagcagcagcugcccggggcccugccgcccgagugcacccccaacaucgacggccccaacgccaagagcgugcagcgcgagcagucccuccacagcuuccacacccuguucugccggcgcugcuucaaguacgacugcuuccugcacccguuccacgccacgcccaacaccuacaagcggaagaacaccgagaccgcgcucgacaacaagcccugcggcccccagugcuaccagcaccuggagggggccaaggaguucgccgccgcgcugacggccgagcgcaucaagaccccgcccaagcgccccggcgggcggcgccggggccgccuccccaacaacuccagccggccguccacccccaccaucaacgugcuggagagcaaggacacggacuccgaccgcgaggccggcaccgagaccgggggcgagaacaacgacaaggaggaggaggagaagaaggacgagaccagcagcuccagcgaggccaacucccggugccagacgcccaucaagaugaagcccaacaucgagccgcccgagaacgucgaguggagcggggccgaggcguccauguuccgcgugcugaucggcaccuacuacgacaacuucugcgccaucgcccggcucaucgggaccaagaccugccgccagguguacgaguuccgggucaaggagagcuccaucaucgcccccgcccccgcggaggacguggacacgccgccccgcaagaagaagcggaagcaccgccugugggccgcccacugccggaagauccagcugaagaagggccagaaccgcuuccccggcugccggugcaaggcccagugcaacaccaagcagugcccgugcuaccucgccgugcgcgagugcgaccccgaccugugccugaccugcggggcggccgaccacugggacagcaagaacgucuccugcaagaacugcagcauccagcggggcuccaagaagcaccuccugcuggcccccagcgacguggccggguggggcaucuucaucaaggaccccgugcagaagaacgaguucaucuccgaguacugcggggagaucaucagccaggacgaggccgaccgccgcggcaaggucuacgacaaguacaugugcuccuuccucuucaaccugaacaacgacuucgugguggacgcgacccggaagggcaacaagauccgcuucgccaaccacagcgucaacccgaacugcuacgccaaggugaugauggucaacggggaccaccggaucggcaucuucgccaagcgcgcgauccagacgggggaggagcuguucuucgacuaccgguacucccaggccgacgcccucaaguacgugggcaucgagcgcgagauggagauccccuga

SEQ ID NO: 1493 - RNA, 1998 nt, Artificial Sequence
  derived and/or modified sequence opt2 from EZH2__Homo_sapiens__AEA07595
augggccagaccggcaagaaguccgagaagggccccgucugcuggcgcaagcgcgucaaguccgaguacaugcgccuccgccagcucaagcgcuuccgccgcgccgacgaggucaaguccauguucuccuccaaccgccagaagauccucgagcgcaccgagauccucaaccaggaguggaagcagcgccgcauccagcccguccacauccucaccuccgucuccucccuccgcggcacccgcgaggucgaggacgagaccguccuccacaacauccccuacaugggcgacgagguccucgaccaggacggcaccuucaucgaggagcucaucaagaacuacgacggcaagguccacggcgaccgcgagugcggcuucaucaacgacgagaucuucgucgagcucgucaacgcccucggccaguacaacgacgacgacgacgacgacgacggcgacgaccccgaggagcgcgaggagaagcagaaggaccucgaggaccaccgcgacgacaaggagucccgccccccccgcaaguuccccuccgacaagaucuucgaggccaucuccuccauguuccccgacaagggcaccgccgaggagcucaaggagaaguacaaggagcucaccgagcagcagcuccccggcgcccucccccccgagugcacccccaacaucgacggccccaacgccaaguccguccagcgcgagcagucccuccacuccuuccacacccucuucugccgccgcugcuucaaguacgacugcuuccuccaccccuuccacgccacccccaacaccuacaagcgcaagaacaccgagaccgcccucgacaacaagcccugcggcccccagugcuaccagcaccucgagggcgccaaggaguucgccgccgcccucaccgccgagcgcaucaagaccccccccaagcgccccggcggccgccgccgcggccgccuccccaacaacuccucccgccccuccacccccaccaucaacguccucgaguccaaggacaccgacuccgaccgcgaggccggcaccgagaccggcggcgagaacaacgacaaggaggaggaggagaagaaggacgagaccuccuccuccuccgaggccaacucccgcugccagacccccaucaagaugaagcccaacaucgagccccccgagaacgucgagugguccggcgccgaggccuccauguuccgcguccucaucggcaccuacuacgacaacuucugcgccaucgcccgccucaucggcaccaagaccugccgccaggucuacgaguuccgcgucaaggaguccuccaucaucgcccccgcccccgccgaggacgucgacacccccccccgcaagaagaagcgcaagcaccgccucugggccgcccacugccgcaagauccagcucaagaagggccagaaccgcuuccccggcugccgcugcaaggcccagugcaacaccaagcagugccccugcuaccucgccguccgcgagugcgaccccgaccucugccucaccugcggcgccgccgaccacugggacuccaagaacgucuccugcaagaacugcuccauccagcgcggcuccaagaagcaccuccuccucgcccccuccgacgucgccggcuggggcaucuucaucaaggaccccguccagaagaacgaguucaucuccgaguacugcggcgagaucaucucccaggacgaggccgaccgccgcggcaaggucuacgacaaguacaugugcuccuuccucuucaaccucaacaacgacuucgucgucgacgccacccgcaagggcaacaagauccgcuucgccaaccacuccgucaaccccaacugcuacgccaaggucaugauggucaacggcgaccaccgcaucggcaucuucgccaagcgcgccauccagaccggcgaggagcucuucuucgacuaccgcuacucccaggccgacgcccucaaguacgucggcaucgagcgcgagauggagauccccuga

SEQ ID NO: 1494 - RNA, 1998 nt, Artificial Sequence
  derived and/or modified sequence opt3 from EZH2__Homo_sapiens__AEA07595
augggccagaccgggaagaaaagcgagaagggacccgugugcuggagaaaaagggucaaguccgaauacaugcggcugcgccaacucaaacgauuccguagagccgacgagguuaagucuauguuuucaaguaacaggcagaagauccuugaacggacagagauucugaaucaggaauggaaacagcgcagaauacaaccugugcacaucuugacuagcguauccucuuuaagggguacgcgggagguggaggaugaaaccguccugcauaacauuccauauaugggcgacgaggugcuagaucaggacgggacauucaucgaagaacucauuaagaauuacgauggaaaaguucacggcgaccgcgagugugguuuuaucaacgaugaaauauucguggagcuggucaaugcucuugggcaguauaacgacgaugacgaugacgaugacggagacgauccggaggagcgagaagagaagcagaaagaccuggaggaucauagagacgauaaggaaucgaggcccccucggaaguuuccaucagacaaaaucuucgaggcaauuagcaguauguuucccgauaagggcacugccgaagaguugaaagaaaaguacaaagagcucaccgagcaacagcugccuggcgcgcugccacccgaaugcacaccuaauaucgacgggccaaacgcuaaguccgugcagcgugagcagucucuccacagcuuccauaccuuauuuugucgcagaugcuucaaauaugauuguuuucugcacccguuccacgccacucccaauacauacaagaggaagaacaccgaaacggcacuugacaauaaaccuugcggaccacaauguuaucagcauuuggagggugccaaggaauuugcugcagcccugacugcugagcggauuaaaacacccccuaagcgaccaggcgggcgcagaaggggacggcuacccaacaauuccucacgcccgaguaccccuacuaucaacguacucgagagcaaagauaccgacucugacagagaagccggcacagagaccgguggggaaaauaacgauaaggaggaggaagagaagaaagacgaaacguccucaagcagugaggcgaacucuaggugccagacucccauaaagaugaaaccaaauauugaaccucccgagaacguugagugguccggagcagaagccagcauguuccgugugcugaucggcacauacuacgauaauuucugugcuauugcccggcuuaucggcaccaagacuugccgacaagucuaugaguuuagagugaaagaaucgucuaucauugcaccagcucccgccgaggacguggauacaccuccaaggaagaagaaacgcaagcaccggcugugggcggcccauuguagaaaaauacaguugaagaaagggcagaacagguucccgggaugccgcugcaaggcacaguguaauaccaagcaaugccccuguuaccucgcuguccgagaaugcgacccugaucuguguuuaacgugcggugccgcugaccacugggauuccaaaaacguuucauguaagaauugcaguauccagcggggcagcaaaaagcaucugcuccuugccccauccgacguggcaggguggggaauuuuuaucaaagaucccguacagaagaacgaguucauaucugaguauuguggcgaaauuaucagccaggacgaggccgaucguagagguaaaguguacgacaaguauaugugcucauuucuguucaauuugaacaaugacuuugucguggaugcuaccaggaaggggaacaaaauccgcuucgcgaaucacaguguuaacccuaauuguuacgcaaaggugaugauggucaacggcgaccaccggauuggaaucuuugccaaaagagcuauucaaacaggcgaggaacuauucuuugauuauagguacucccaggccgacgcacugaaguacguggggauagaacgagagauggagaucccauga

SEQ ID NO: 1495 - RNA, 1998 nt, Artificial Sequence
  derived and/or modified sequence opt4 from EZH2__Homo_sapiens__AEA07595
augggccagaccggcaagaagagcgagaagggccccgugugcuggagaaagagagugaagagcgaguacaugagacugagacagcugaagagauucagaagagccgacgaggugaagagcauguucagcagcaacagacagaagauccuggagagaaccgagauccugaaccaggaguggaagcagagaagaauccagcccgugcacauccugaccagcgugagcagccugagaggcaccagagagguggaggacgagaccgugcugcacaacauccccuacaugggcgacgaggugcuggaccaggacggcaccuucaucgaggagcugaucaagaacuacgacggcaaggugcacggcgacagagagugcggcuucaucaacgacgagaucuucguggagcuggugaacgcccugggccaguacaacgacgacgacgacgacgacgacggcgacgaccccgaggagagagaggagaagcagaaggaccuggaggaccacagagacgacaaggagagcagaccccccagaaaguuccccagcgacaagaucuucgaggccaucagcagcauguuccccgacaagggcaccgccgaggagcugaaggagaaguacaaggagcugaccgagcagcagcugcccggcgcccugccccccgagugcacccccaacaucgacggccccaacgccaagagcgugcagagagagcagagccugcacagcuuccacacccuguucugcagaagaugcuucaaguacgacugcuuccugcaccccuuccacgccacccccaacaccuacaagagaaagaacaccgagaccgcccuggacaacaagcccugcggcccccagugcuaccagcaccuggagggcgccaaggaguucgccgccgcccugaccgccgagagaaucaagaccccccccaagagacccggcggcagaagaagaggcagacugcccaacaacagcagcagacccagcacccccaccaucaacgugcuggagagcaaggacaccgacagcgacagagaggccggcaccgagaccggcggcgagaacaacgacaaggaggaggaggagaagaaggacgagaccagcagcagcagcgaggccaacagcagaugccagacccccaucaagaugaagcccaacaucgagccccccgagaacguggaguggagcggcgccgaggccagcauguucagagugcugaucggcaccuacuacgacaacuucugcgccaucgccagacugaucggcaccaagaccugcagacagguguacgaguucagagugaaggagagcagcaucaucgcccccgcccccgccgaggacguggacaccccccccagaaagaagaagagaaagcacagacugugggccgcccacugcagaaagauccagcugaagaagggccagaacagauuccccggcugcagaugcaaggcccagugcaacaccaagcagugccccugcuaccuggccgugagagagugcgaccccgaccugugccugaccugcggcgccgccgaccacugggacagcaagaacgugagcugcaagaacugcagcauccagagaggcagcaagaagcaccugcugcuggcccccagcgacguggccggcuggggcaucuucaucaaggaccccgugcagaagaacgaguucaucagcgaguacugcggcgagaucaucagccaggacgaggccgacagaagaggcaagguguacgacaaguacaugugcagcuuccuguucaaccugaacaacgacuucgugguggacgccaccagaaagggcaacaagaucagauucgccaaccacagcgugaaccccaacugcuacgccaaggugaugauggugaacggcgaccacagaaucggcaucuucgccaagagagccauccagaccggcgaggagcuguucuucgacuacagauacagccaggccgacgcccugaaguacgugggcaucgagagagagauggagauccccuga

SEQ ID NO: 1496 - RNA, 1998 nt, Artificial Sequence
  derived and/or modified sequence opt5 from EZH2__Homo_sapiens__AEA07595
augggccagaccgggaagaaaagcgagaagggacccgugugcuggagaaaacgggucaaguccgaauacaugcgccugagacaacucaaacgguuccgcagagccgacgagguuaagucuauguuuagcuccaaccggcagaagauccuggaacgcacagagauucuuaaucaggaauggaaacagagacggauccaaccugugcacauucugacgucugugagcucccuccgcggcaccagagaggucgaggaugaaacagugcugcauaacaucccguauaugggggacgagguucuugaucaggacggaaccuucauugaagaacugaucaagaauuacgauggcaaagugcacggggaccgggaguguggauuuaucaacgaugaaauuuucgucgagcucgugaaugcucugggccaguauaacgacgaugacgaugacgaugacggcgacgaucccgaagaacgcgaagagaagcagaaagaccuggaggaucauagagacgauaaggaaucucggccuccccgcaaguuuccuagcgacaaaaucuucgaggccauuuccagcauguuucccgauaaggggacagcggaggagcucaaagaaaaguacaaagagcugaccgagcaacagcuuccuggagcucugccgcccgaaugcacaccuaauaucgacggccccaacgccaagucuguucagagagagcagucccuccacagcuuccauacccuguuuugucggagaugcuucaaauaugauuguuuucuucacccuuuccacgccacgcccaauaccuacaagcgcaagaacacagaaaccgcucuggacaauaaaccgugcgggccucaauguuaucagcaucucgagggagccaaggaauuugcugccgcgcugacagccgagcggauuaaaacgcccccuaagagacccggcgggcgccggagaggacgccugcccaacaauucuucccggccuagcaccccgacaaucaacgugcucgagucuaaagauaccgacuccgacagagaagcuggcacagagaccggcggggaaaauaacgauaaggaggaggaagagaagaaagacgaaaccagcuccucuagcgaggccaacucccgcugccagacacccauuaagaugaaaccuaauaucgaacccccugagaacgucgaguggagcggagcugaagccucuauguuccgggugcugaucggcacguacuacgauaauuucugugcgauugccagacuuaucgggaccaagacaugccgccaaguguaugaguuucgggucaaagaauccagcauuaucgcucccgccccggcugaggacguugauaccccucccagaaagaagaaacggaagcaccgccugugggccgcccauuguagaaaaauucagcucaagaaaggacagaaccgguucccuggcugcagaugcaaggcucaguguaauacaaagcaaugccccuguuaccuggcggugcgcgaaugcgacccugaucuuugucugaccugcggggccgcugaccacugggauucuaaaaacgugagcuguaagaauugcuccauccagcggggaucuaaaaagcaccuccugcuggcccccagcgacgucgccggcuggggcaucuuuauuaaagauccggugcagaagaacgaguucaucuccgaguauuguggggaaauuaucagccaggacgaggcugauagacgcggaaaaguuuacgacaaguauaugugcucuuuucucuucaaucugaacaaugacuuuguggucgaugccacgagaaagggcaacaaaauucgguucgcgaaucauuccgugaacccuaauuguuacgcuaagguuaugauggugaacggggaccaccgcaucggaaucuuugccaaaagagccauucaaacaggcgaggagcuuuucuuugauuaucgguacagccaggcugacgcccugaaguacgucgggaucgaacgcgagauggagauucccuga

SEQ ID NO: 1497 - protein, 334 aa, Artificial Sequence
  EZH2__Homo_sapiens__G3XAL2
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLPLLPRN

SEQ ID NO: 1498 - RNA, 1005 nt, Artificial Sequence
  EZH2__Homo_sapiens__EAW80068
augggccagacugggaagaaaucugagaagggaccaguuuguuggcggaagcguguaaaaucagaguacaugcgacugagacagcucaagagguucagacgagcugaugaaguaaagaguauguuuaguuccaaucgucagaaaauuuuggaaagaacggaaaucuuaaaccaagaauggaaacagcgaaggauacagccugugcacauccugacuucugugagcucauugcgcgggacuagggaguguucggugaccagugacuuggauuuuccaacacaagucaucccauuaaagacucugaaugcaguugcuucaguacccauaauguauucuuggucuccccuacagcagaauuuuaugguggaagaugaaacuguuuuacauaacauuccuuauaugggagaugaaguuuuagaucaggaugguacuuucauugaagaacuaauaaaaaauuaugaugggaaaguacacggggauagagaauguggguuuauaaaugaugaaauuuuuguggaguuggugaaugcccuuggucaauauaaugaugaugacgaugaugaugauggagacgauccugaagaaagagaagaaaagcagaaagaucuggaggaucaccgagaugauaaagaaagccgcccaccucggaaauuuccuucugauaaaauuuuugaagccauuuccucaauguuuccagauaagggcacagcagaagaacuaaaggaaaaauauaaagaacucaccgaacagcagcucccaggcgcacuuccuccugaauguacccccaacauagauggaccaaaugcuaaaucuguucagagagagcaaagcuuacacuccuuucauacgcuuuucuguaggcgauguuuuaaauaugacugcuuccuacauccuuuucaugcaacacccaacacuuauaagcggaagaacacagaaacagcucuagacaacaaaccuuguggaccacaguguuaccagcauuugccacuccuaccuaggaacuaa

SEQ ID NO: 1499 - RNA, 1005 nt, Artificial Sequence
  derived and/or modified sequence opt1 from EZH2__Homo_sapiens__EAW80068
augggccagaccgggaagaaguccgagaagggccccgugugcuggcgcaagcgggucaagagcgaguacaugcgccugcggcagcucaagcgcuuccggcgcgccgacgaggucaagagcauguucuccagcaaccggcagaagauccuggagcgcaccgagauccugaaccaggaguggaagcagcggcgcauccagccggugcacauccucacguccgugagcucccugcgggggacccgcgagugcagcgugaccuccgaccuggacuuccccacccaggugaucccccucaagacgcugaacgccgucgcgagcgugcccaucauguacuccuggagcccgcugcagcagaacuucaugguggaggacgagaccguccuccacaacauccccuacaugggcgacgaggugcuggaccaggacgggaccuucaucgaggagcugaucaagaacuacgacggcaaggugcacggcgaccgggagugcggguucaucaacgacgagaucuucgucgagcucgugaacgcccugggccaguacaacgacgacgacgacgacgacgacggggacgaccccgaggagcgcgaggagaagcagaaggaccuggaggaccaccgggacgacaaggagucccggcccccgcgcaaguuccccagcgacaagaucuucgaggccaucuccagcauguuccccgacaagggcaccgccgaggagcucaaggagaaguacaaggagcugacggagcagcagcugcccggggcccucccgcccgagugcacccccaacaucgacggccccaacgcgaaguccgugcagcgcgagcagagccugcacuccuuccacacccuguucugccggcgcugcuucaaguacgacugcuuccuccacccguuccacgccacccccaacacguacaagcggaagaacaccgagaccgcccuggacaacaagcccugcggcccccagugcuaccagcaccucccgcugcugccccgcaacuga

SEQ ID NO: 1500 - RNA, 1005 nt, Artificial Sequence
  derived and/or modified sequence opt2 from EZH2__Homo_sapiens__EAW80068
augggccagaccggcaagaaguccgagaagggccccgucugcuggcgcaagcgcgucaaguccgaguacaugcgccuccgccagcucaagcgcuuccgccgcgccgacgaggucaaguccauguucuccuccaaccgccagaagauccucgagcgcaccgagauccucaaccaggaguggaagcagcgccgcauccagcccguccacauccucaccuccgucuccucccuccgcggcacccgcgagugcuccgucaccuccgaccucgacuuccccacccaggucaucccccucaagacccucaacgccgucgccuccguccccaucauguacuccugguccccccuccagcagaacuucauggucgaggacgagaccguccuccacaacauccccuacaugggcgacgagguccucgaccaggacggcaccuucaucgaggagcucaucaagaacuacgacggcaagguccacggcgaccgcgagugcggcuucaucaacgacgagaucuucgucgagcucgucaacgcccucggccaguacaacgacgacgacgacgacgacgacggcgacgaccccgaggagcgcgaggagaagcagaaggaccucgaggaccaccgcgacgacaaggagucccgccccccccgcaaguuccccuccgacaagaucuucgaggccaucuccuccauguuccccgacaagggcaccgccgaggagcucaaggagaaguacaaggagcucaccgagcagcagcuccccggcgcccucccccccgagugcacccccaacaucgacggccccaacgccaaguccguccagcgcgagcagucccuccacuccuuccacacccucuucugccgccgcugcuucaaguacgacugcuuccuccaccccuuccacgccacccccaacaccuacaagcgcaagaacaccgagaccgcccucgacaacaagcccugcggcccccagugcuaccagcaccucccccuccucccccgcaacuga

SEQ ID NO: 1501 - RNA, 1005 nt, Artificial Sequence
  derived and/or modified sequence opt3 from EZH2__Homo_sapiens__EAW80068
augggccagaccgggaagaaaagcgagaagggacccgugugcuggagaaaaagggucaaguccgaauacaugcggcugcgccaacucaaacgauuccguagagccgacgagguuaagucuauguuuucaaguaacaggcagaagauccuugaacggacagagauucugaaucaggaauggaaacagcgcagaauacaaccugugcacaucuugacuagcguauccucuuuaagggguacgcgggaguguucggugaccucagaucuggacuucccaacacaggucauuccgcuaaagacucucaacgcuguggcaagcguucccaucauguauaguugguccccucugcagcagaauuuuaugguggaggaugaaaccguccuucauaacauuccauacaugggcgacgaggugcuggaucaagacgggacauucaucgaagaguugaucaaaaauuaugauggaaagguacacggcgaccgcgagugcgguuuuauaaacgaugaaauuuucguugagcucgugaaugcccuggggcaguacaacgacgaugacgaugacgacgauggagacgaucccgaagaacgagaagagaaacagaaggaccuggaggaucauagagacgauaaggaaucuaggccuccacggaaauuucccagcgacaagaucuucgaggcgauuuccucaauguuuccugauaaaggcaccgcugaggagcucaaggaaaaauauaaggaguuaacugagcagcaacugccaggcgcccuuccgcccgaauguacaccuaauaucgacgggccaaacgcaaaaaguguccagcgugagcagagcuugcacucuuuccauacccuguuuugccgcagauguuucaaguacgauugcuuucuacaccccuuccacgccacgccuaauacuuauaagaggaaaaacaccgaaacagcucucgacaauaagccauguggaccccaaugcuaccagcaucugccgcuucugccucggaacuga

SEQ ID NO: 1502 - RNA, 1005 nt, Artificial Sequence
  derived and/or modified sequence opt4 from EZH2__Homo_sapiens__EAW80068
augggccagaccggcaagaagagcgagaagggccccgugugcuggagaaagagagugaagagcgaguacaugagacugagacagcugaagagauucagaagagccgacgaggugaagagcauguucagcagcaacagacagaagauccuggagagaaccgagauccugaaccaggaguggaagcagagaagaauccagcccgugcacauccugaccagcgugagcagccugagaggcaccagagagugcagcgugaccagcgaccuggacuuccccacccaggugaucccccugaagacccugaacgccguggccagcgugcccaucauguacagcuggagcccccugcagcagaacuucaugguggaggacgagaccgugcugcacaacauccccuacaugggcgacgaggugcuggaccaggacggcaccuucaucgaggagcugaucaagaacuacgacggcaaggugcacggcgacagagagugcggcuucaucaacgacgagaucuucguggagcuggugaacgcccugggccaguacaacgacgacgacgacgacgacgacggcgacgaccccgaggagagagaggagaagcagaaggaccuggaggaccacagagacgacaaggagagcagaccccccagaaaguuccccagcgacaagaucuucgaggccaucagcagcauguuccccgacaagggcaccgccgaggagcugaaggagaaguacaaggagcugaccgagcagcagcugcccggcgcccugccccccgagugcacccccaacaucgacggccccaacgccaagagcgugcagagagagcagagccugcacagcuuccacacccuguucugcagaagaugcuucaaguacgacugcuuccugcaccccuuccacgccacccccaacaccuacaagagaaagaacaccgagaccgcccuggacaacaagcccugcggcccccagugcuaccagcaccugccccugcugcccagaaacuga

SEQ ID NO: 1503 - RNA, 1005 nt, Artificial Sequence
  derived and/or modified sequence opt5 from EZH2__Homo_sapiens__EAW80068
augggccagaccgggaagaaaagcgagaagggacccgugugcuggagaaaacgggucaaguccgaauacaugcgccugagacaacucaaacgguuccgcagagccgacgagguuaagucuauguuuagcuccaaccggcagaagauccuggaacgcacagagauucuuaaucaggaauggaaacagagacggauccaaccugugcacauucugacgucugugagcucccuccgcggcaccagagaguguucugucacaagcgaucuggacuucccgacccaggugaucccccuuaagacacugaacgcuguugccuccgugccuauuauguauagcuggucuccccuccagcagaauuuuauggucgaggaugaaaccgugcugcauaacaucccuuacaugggggacgagguucuggaucaagacggaacauucaucgaagaacucauuaaaaauuaugauggcaaggugcacggggaccgggagugcggauuuaucaacgaugaaauuuucgucgagcuggugaaugcgcuuggccaguacaacgacgaugacgaugacgacgauggcgacgaucccgaggagcgcgaagagaaacagaaggaccuggaggaucauagagacgauaaggaaucccggccuccgcgcaaauuucccagcgacaagaucuucgaggcuauuucuuccauguuuccugauaaagggaccgccgaggaacucaaggaaaaauauaaggagcugacggagcagcaacuucccggagcccugccucccgaauguaccccgaauaucgacggcccuaacgcuaaaagcgugcagagagagcagucucuccacuccuuccauacacuguuuugccggagauguuucaaguacgauugcuuucugcaccccuuccacgccaccccuaauacauauaagcgcaaaaacaccgaaacggcucucgacaauaagcccugugggccccaaugcuaccagcaucugccucuucugccgcggaacuga

SEQ ID NO: 1504 - protein, 64 aa, Artificial Sequence
  EZH2__Homo_sapiens__L0R855
MPLVNIMMMTMMMMETILKKEKKSRKIWRITEMIKKAAHLGNFLLIKFLKPFPQCFQIRAQQKN

SEQ ID NO: 1505 - RNA, 195 nt, Artificial Sequence
  EZH2__Homo_sapiens__CCO13726
augcccuuggucaauauaaugaugaugacgaugaugaugauggagacgauccugaagaaagagaagaaaagcagaaagaucuggaggaucaccgagaugauaaagaaagccgcccaccucggaaauuuccuucugauaaaauuuuugaagccauuuccucaauguuuccagauaagggcacagcagaagaacuaa

SEQ ID NO: 1506 - RNA, 195 nt, Artificial Sequence
  derived and/or modified sequence opt1 from EZH2__Homo_sapiens__CCO13726
augccccuggugaacaucaugaugaugaccaugaugaugauggagaccauccucaagaaggagaagaagagccgcaagaucuggcggaucacggagaugaucaagaaggccgcccaccugggcaacuuccugcucaucaaguuccugaagccguucccccagugcuuccagauccgcgcgcagcagaagaacuga

SEQ ID NO: 1507 - RNA, 195 nt, Artificial Sequence
  derived and/or modified sequence opt2 from EZH2__Homo_sapiens__CCO13726
augccccucgucaacaucaugaugaugaccaugaugaugauggagaccauccucaagaaggagaagaagucccgcaagaucuggcgcaucaccgagaugaucaagaaggccgcccaccucggcaacuuccuccucaucaaguuccucaagcccuucccccagugcuuccagauccgcgcccagcagaagaacuga

SEQ ID NO: 1508 - RNA, 195 nt, Artificial Sequence
  derived and/or modified sequence opt3 from EZH2__Homo_sapiens__CCO13726
augccccuggugaacaucaugaugaugaccaugaugaugauggagacaauucucaagaaagaaaagaaaagcagaaagauauggaggaucacugagaugauuaaaaaggccgcucaccuuggcaauuuccuguugaucaaguuuuuaaaaccuuucccacagugcuuucaaauucgggcacagcagaagaacuga

SEQ ID NO: 1509 - RNA, 195 nt, Artificial Sequence
  derived and/or modified sequence opt4 from EZH2__Homo_sapiens__CCO13726
augccccuggugaacaucaugaugaugaccaugaugaugauggagaccauccugaagaaggagaagaagagcagaaagaucuggagaaucaccgagaugaucaagaaggccgcccaccugggcaacuuccugcugaucaaguuccugaagcccuucccccagugcuuccagaucagagcccagcagaagaacuga

SEQ ID NO: 1510 - RNA, 195 nt, Artificial Sequence
  derived and/or modified sequence opt5 from EZH2__Homo_sapiens__CCO13726
augccccuggugaacaucaugaugaugaccaugaugaugauggagacaauucucaagaaagaaaagaaaagcagaaagaucuggcggauuacggagaugaucaaaaaggccgcucaccugggcaauuuccuucugauuaaguuucucaaaccuuucccgcagugcuuucaaauccgcgcccagcagaagaacuga

SEQ ID NO: 1511 - protein, 746 aa, Artificial Sequence
  EZH2__Homo_sapiens__Q15910
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 1512 - RNA, 2241 nt, Artificial Sequence
  EZH2__Homo_sapiens__AAC51520
augggccagacugggaagaaaucugagaagggaccaguuuguuggcggaagcguguaaaaucagaguacaugcgacugagacagcucaagagguucagacgagcugaugaaguaaagaguauguuuaguuccaaucgucagaaaauuuuggaaagaacggaaaucuuaaaccaagaauggaaacagcgaaggauacagccugugcacauccugacuucugugagcucauugcgcgggacuagggaguguucggugaccagugacuuggauuuuccaacacaagucaucccauuaaagacucugaaugcaguugcuucaguacccauaauguauucuuggucuccccuacagcagaauuuuaugguggaagaugaaacuguuuuacauaacauuccuuauaugggagaugaaguuuuagaucaggaugguacuuucauugaagaacuaauaaaaaauuaugaugggaaaguacacggggauagagaauguggguuuauaaaugaugaaauuuuuguggaguuggugaaugcccuuggucaauauaaugaugaugacgaugaugaugauggagacgauccugaagaaagagaagaaaagcagaaagaucuggaggaucaccgagaugauaaagaaagccgcccaccucggaaauuuccuucugauaaaauuuuugaagccauuuccucaauguuuccagauaagggcacagcagaagaacuaaaggaaaaauauaaagaacucaccgaacagcagcucccaggcgcacuuccuccugaauguacccccaacauagauggaccaaaugcuaaaucuguucagagagagcaaagcuuacacuccuuucauacgcuuuucuguaggcgauguuuuaaauaugacugcuuccuacauccuuuucaugcaacacccaacacuuauaagcggaagaacacagaaacagcucuagacaacaaaccuuguggaccacaguguuaccagcauuuggagggagcaaaggaguuugcugcugcucucaccgcugagcggauaaagaccccaccaaaacguccaggaggccgcagaagaggacggcuucccaauaacaguagcaggcccagcacccccaccauuaaugugcuggaaucaaaggauacagacagugauagggaagcagggacugaaacggggggagagaacaaugauaaagaagaagaagagaagaaagaugaaacuucgagcuccucugaagcaaauucucggugucaaacaccaauaaagaugaagccaaauauugaaccuccugagaauguggaguggaguggugcugaagccucaauguuuagaguccucauuggcacuuacuaugacaauuucugugccauugcuagguuaauugggaccaaaacauguagacagguguaugaguuuagagucaaagaaucuagcaucauagcuccagcucccgcugaggauguggauacuccuccaaggaaaaagaagaggaaacaccgguugugggcugcacacugcagaaagauacagcugaaaaaggacggcuccucuaaccauguuuacaacuaucaacccugugaucauccacggcagccuugugacaguucgugcccuugugugauagcacaaaauuuuugugaaaaguuuugucaauguaguucagagugucaaaaccgcuuuccgggaugccgcugcaaagcacagugcaacaccaagcagugcccgugcuaccuggcuguccgagagugugacccugaccucugucuuacuuguggagccgcugaccauugggacaguaaaaauguguccugcaagaacugcaguauucagcggggcuccaaaaagcaucuauugcuggcaccaucugacguggcaggcugggggauuuuuaucaaagauccugugcagaaaaaugaauucaucucagaauacuguggagagauuauuucucaagaugaagcugacagaagagggaaaguguaugauaaauacaugugcagcuuucuguucaacuugaacaaugauuuugugguggaugcaacccgcaaggguaacaaaauucguuuugcaaaucauucgguaaauccaaacugcuaugcaaaaguuaugaugguuaacggugaucacaggauagguauuuuugccaagagagccauccagacuggcgaagagcuguuuuuugauuacagauacagccaggcugaugcccugaaguaugucggcaucgaaagagaaauggaaaucccuuga

SEQ ID NO: 1513 - RNA, 2241 nt, Artificial Sequence
  derived and/or modified sequence opt1 from EZH2__Homo_sapiens__AAC51520
augggccagaccgggaagaaguccgagaagggccccgugugcuggcgcaagcgggucaagagcgaguacaugcgccugcggcagcucaagcgcuuccggcgcgccgacgaggucaagagcauguucuccagcaaccggcagaagauccuggagcgcaccgagauccugaaccaggaguggaagcagcggcgcauccagccggugcacauccucacguccgugagcucccugcgggggacccgcgagugcagcgugaccuccgaccuggacuuccccacccaggugaucccccucaagacgcugaacgccgucgcgagcgugcccaucauguacuccuggagcccgcugcagcagaacuucaugguggaggacgagaccguccuccacaacauccccuacaugggcgacgaggugcuggaccaggacgggaccuucaucgaggagcugaucaagaacuacgacggcaaggugcacggcgaccgggagugcggguucaucaacgacgagaucuucgucgagcucgugaacgcccugggccaguacaacgacgacgacgacgacgacgacggggacgaccccgaggagcgcgaggagaagcagaaggaccuggaggaccaccgggacgacaaggagucccggcccccgcgcaaguuccccagcgacaagaucuucgaggccaucuccagcauguuccccgacaagggcaccgccgaggagcucaaggagaaguacaaggagcugacggagcagcagcugcccggggcccucccgcccgagugcacccccaacaucgacggccccaacgcgaaguccgugcagcgcgagcagagccugcacuccuuccacacccuguucugccggcgcugcuucaaguacgacugcuuccuccacccguuccacgccacccccaacacguacaagcggaagaacaccgagaccgcccuggacaacaagcccugcggcccccagugcuaccagcaccuggagggggccaaggaguucgcggccgcccucaccgccgagcgcaucaagacgccgcccaagcgccccggcgggcggcgccggggccgccugcccaacaacagcagccggccguccacccccaccaucaacguccuggagagcaaggacaccgacuccgaccgcgaggccggcacggagaccgggggcgagaacaacgacaaggaggaggaggagaagaaggacgagaccagcuccagcuccgaggcgaacagccggugccagacccccaucaagaugaagcccaacaucgagccgcccgagaacguggagugguccggggccgaggccagcauguuccgcgugcucaucggcacguacuacgacaacuucugcgccaucgcccggcugaucgggaccaagaccugccgccaggucuacgaguuccgggugaaggaguccagcaucaucgcgcccgccccggccgaggacguggacaccccgccccgcaagaagaagcggaagcaccgccugugggccgcccacugccggaagauccagcucaagaaggacggcuccagcaaccacgucuacaacuaccagcccugcgaccacccccgccagcccugcgacuccagcugccccugcgugaucgcgcagaacuucugcgagaaguucugccagugcuccagcgagugccagaaccgguuccccggcugccgcugcaaggcccagugcaacacgaagcagugcccgugcuaccuggccgugcgggagugcgaccccgaccugugccugaccugcggggccgccgaccacugggacuccaagaacgucagcugcaagaacugcagcauccagcgcggcuccaagaagcaccuccugcucgcgcccagcgacguggccggguggggcaucuucaucaaggaccccguccagaagaacgaguucaucuccgaguacugcggggagaucaucagccaggacgaggccgaccgccggggcaagguguacgacaaguacaugugcuccuuccuguucaaccugaacaacgacuucguggucgacgccacccgcaagggcaacaagauccgguucgcgaaccacagcgugaacccgaacugcuacgccaaggugaugauggucaacggggaccaccgcaucggcaucuucgccaagcgggccauccagaccggggaggagcuguucuucgacuaccgcuacucccaggccgacgcgcucaaguacgugggcaucgagcgggagauggagauccccuga

SEQ ID NO: 1514 - RNA, 2241 nt, Artificial Sequence
  derived and/or modified sequence opt2 from EZH2__Homo_sapiens__AAC51520
augggccagaccggcaagaaguccgagaagggccccgucugcuggcgcaagcgcgucaaguccgaguacaugcgccuccgccagcucaagcgcuuccgccgcgccgacgaggucaaguccauguucuccuccaaccgccagaagauccucgagcgcaccgagauccucaaccaggaguggaagcagcgccgcauccagcccguccacauccucaccuccgucuccucccuccgcggcacccgcgagugcuccgucaccuccgaccucgacuuccccacccaggucaucccccucaagacccucaacgccgucgccuccguccccaucauguacuccugguccccccuccagcagaacuucauggucgaggacgagaccguccuccacaacauccccuacaugggcgacgagguccucgaccaggacggcaccuucaucgaggagcucaucaagaacuacgacggcaagguccacggcgaccgcgagugcggcuucaucaacgacgagaucuucgucgagcucgucaacgcccucggccaguacaacgacgacgacgacgacgacgacggcgacgaccccgaggagcgcgaggagaagcagaaggaccucgaggaccaccgcgacgacaaggagucccgccccccccgcaaguuccccuccgacaagaucuucgaggccaucuccuccauguuccccgacaagggcaccgccgaggagcucaaggagaaguacaaggagcucaccgagcagcagcuccccggcgcccucccccccgagugcacccccaacaucgacggccccaacgccaaguccguccagcgcgagcagucccuccacuccuuccacacccucuucugccgccgcugcuucaaguacgacugcuuccuccaccccuuccacgccacccccaacaccuacaagcgcaagaacaccgagaccgcccucgacaacaagcccugcggcccccagugcuaccagcaccucgagggcgccaaggaguucgccgccgcccucaccgccgagcgcaucaagaccccccccaagcgccccggcggccgccgccgcggccgccuccccaacaacuccucccgccccuccacccccaccaucaacguccucgaguccaaggacaccgacuccgaccgcgaggccggcaccgagaccggcggcgagaacaacgacaaggaggaggaggagaagaaggacgagaccuccuccuccuccgaggccaacucccgcugccagacccccaucaagaugaagcccaacaucgagccccccgagaacgucgagugguccggcgccgaggccuccauguuccgcguccucaucggcaccuacuacgacaacuucugcgccaucgcccgccucaucggcaccaagaccugccgccaggucuacgaguuccgcgucaaggaguccuccaucaucgcccccgcccccgccgaggacgucgacacccccccccgcaagaagaagcgcaagcaccgccucugggccgcccacugccgcaagauccagcucaagaaggacggcuccuccaaccacgucuacaacuaccagcccugcgaccacccccgccagcccugcgacuccuccugccccugcgucaucgcccagaacuucugcgagaaguucugccagugcuccuccgagugccagaaccgcuuccccggcugccgcugcaaggcccagugcaacaccaagcagugccccugcuaccucgccguccgcgagugcgaccccgaccucugccucaccugcggcgccgccgaccacugggacuccaagaacgucuccugcaagaacugcuccauccagcgcggcuccaagaagcaccuccuccucgcccccuccgacgucgccggcuggggcaucuucaucaaggaccccguccagaagaacgaguucaucuccgaguacugcggcgagaucaucucccaggacgaggccgaccgccgcggcaaggucuacgacaaguacaugugcuccuuccucuucaaccucaacaacgacuucgucgucgacgccacccgcaagggcaacaagauccgcuucgccaaccacuccgucaaccccaacugcuacgccaaggucaugauggucaacggcgaccaccgcaucggcaucuucgccaagcgcgccauccagaccggcgaggagcucuucuucgacuaccgcuacucccaggccgacgcccucaaguacgucggcaucgagcgcgagauggagauccccuga

SEQ ID NO: 1515 - RNA, 2241 nt, Artificial Sequence
  derived and/or modified sequence opt3 from EZH2__Homo_sapiens__AAC51520
augggccagaccgggaagaaaagcgagaagggacccgugugcuggagaaaaagggucaaguccgaauacaugcggcugcgccaacucaaacgauuccguagagccgacgagguuaagucuauguuuucaaguaacaggcagaagauccuugaacggacagagauucugaaucaggaauggaaacagcgcagaauacaaccugugcacaucuugacuagcguauccucuuuaagggguacgcgggaguguucggugaccucagaucuggacuucccaacacaggucauuccgcuaaagacucucaacgcuguggcaagcguucccaucauguauaguugguccccucugcagcagaauuuuaugguggaggaugaaaccguccuucauaacauuccauacaugggcgacgaggugcuggaucaagacgggacauucaucgaagaguugaucaaaaauuaugauggaaagguacacggcgaccgcgagugcgguuuuauaaacgaugaaauuuucguugagcucgugaaugcccuggggcaguacaacgacgaugacgaugacgacgauggagacgaucccgaagaacgagaagagaaacagaaggaccuggaggaucauagagacgauaaggaaucuaggccuccacggaaauuucccagcgacaagaucuucgaggcgauuuccucaauguuuccugauaaaggcaccgcugaagaacucaaggaaaaauauaaggaguuaacugagcagcaacugccaggcgcccuuccgcccgaauguacaccuaauaucgacgggccaaacgcaaaaaguguccagcgugagcagagcuugcacucuuuccauacccuguuuugccgcagauguuucaaguacgauugcuuucuacaccccuuccacgccacgccuaauacuuauaagaggaaaaacaccgaaacagcucucgacaauaagccauguggaccccaaugcuaccagcaucuggagggugcaaaagaguucgccgcugcccuuacugcggagcggauaaagaccccgccuaaacgacccggcgggcgcagaaggggacggcugccaaacaauuccucacgcccuagcacacccaccauuaacguguuggagaguaaggacacggauucugacagagaagcaggcacugagacagguggggaaaacaaugauaaggaggaggaagagaaaaaggacgaaaccuccagcucgucugaggccaacuccaggugucagacuccaaucaaaaugaagcccaauauugaaccuccagagaacguggaguggucaggagcugaagccaguauguuucguguccucaucggcacauacuaugauaauuucugcgcaaucgcucggcugauuggcaccaaaacgugucgacagguuuacgaguuuagagugaaggaaagcuccauaaucgccccggcgcccgccgaggacguagauaccccuccaaggaagaaaaagcgcaaacaccgguuaugggcagcucauugcagaaagauucaacugaaaaaggacgggucuagcaaccacguguauaauuaccagcccugcgaucacccuaggcagccaugugacucaaguugccccugugucaucgcccagaacuucugcgaaaaguuuugucaaugcuccagcgagugucagaaucgcuucccgggaugccgauguaaagcucagugcaacacaaagcaguguccuugcuaucucgccgugcgggagugcgauccagaccuuugucugacuugcggugcagccgaucauugggacucuaaaaauguuucauguaagaacugcaguauacaacguggcagcaaaaagcacuugcuacuggcucccuccgacguggcgggguggggaauuuuuaucaaagauccuguccagaagaaugaguucaucucugaguacuguggcgaaauuaucucgcaggacgaggcagauagaagggguaagguguaugacaaauacaugugcagcuuucucuucaaccugaauaacgauuuuguaguugacgccacccgcaaggggaacaaaauucgguucgcuaaucauuccgugaaccccaauuguuacgccaaggucaugauggugaacggcgaucacagaauaggaaucuuugcaaaaagggccauucagacaggcgaggaacuuuucuucgacuaucgauacucacaagcugaugcccugaaguaugucgggaucgagcgcgaaauggagaucccauga

SEQ ID NO: 1516 - RNA, 2241 nt, Artificial Sequence
  derived and/or modified sequence opt4 from EZH2__Homo_sapiens__AAC51520
augggccagaccggcaagaagagcgagaagggccccgugugcuggagaaagagagugaagagcgaguacaugagacugagacagcugaagagauucagaagagccgacgaggugaagagcauguucagcagcaacagacagaagauccuggagagaaccgagauccugaaccaggaguggaagcagagaagaauccagcccgugcacauccugaccagcgugagcagccugagaggcaccagagagugcagcgugaccagcgaccuggacuuccccacccaggugaucccccugaagacccugaacgccguggccagcgugcccaucauguacagcuggagcccccugcagcagaacuucaugguggaggacgagaccgugcugcacaacauccccuacaugggcgacgaggugcuggaccaggacggcaccuucaucgaggagcugaucaagaacuacgacggcaaggugcacggcgacagagagugcggcuucaucaacgacgagaucuucguggagcuggugaacgcccugggccaguacaacgacgacgacgacgacgacgacggcgacgaccccgaggagagagaggagaagcagaaggaccuggaggaccacagagacgacaaggagagcagaccccccagaaaguuccccagcgacaagaucuucgaggccaucagcagcauguuccccgacaagggcaccgccgaggagcugaaggagaaguacaaggagcugaccgagcagcagcugcccggcgcccugccccccgagugcacccccaacaucgacggccccaacgccaagagcgugcagagagagcagagccugcacagcuuccacacccuguucugcagaagaugcuucaaguacgacugcuuccugcaccccuuccacgccacccccaacaccuacaagagaaagaacaccgagaccgcccuggacaacaagcccugcggcccccagugcuaccagcaccuggagggcgccaaggaguucgccgccgcccugaccgccgagagaaucaagaccccccccaagagacccggcggcagaagaagaggcagacugcccaacaacagcagcagacccagcacccccaccaucaacgugcuggagagcaaggacaccgacagcgacagagaggccggcaccgagaccggcggcgagaacaacgacaaggaggaggaggagaagaaggacgagaccagcagcagcagcgaggccaacagcagaugccagacccccaucaagaugaagcccaacaucgagccccccgagaacguggaguggagcggcgccgaggccagcauguucagagugcugaucggcaccuacuacgacaacuucugcgccaucgccagacugaucggcaccaagaccugcagacagguguacgaguucagagugaaggagagcagcaucaucgcccccgcccccgccgaggacguggacaccccccccagaaagaagaagagaaagcacagacugugggccgcccacugcagaaagauccagcugaagaaggacggcagcagcaaccacguguacaacuaccagcccugcgaccaccccagacagcccugcgacagcagcugccccugcgugaucgcccagaacuucugcgagaaguucugccagugcagcagcgagugccagaacagauuccccggcugcagaugcaaggcccagugcaacaccaagcagugccccugcuaccuggccgugagagagugcgaccccgaccugugccugaccugcggcgccgccgaccacugggacagcaagaacgugagcugcaagaacugcagcauccagagaggcagcaagaagcaccugcugcuggcccccagcgacguggccggcuggggcaucuucaucaaggaccccgugcagaagaacgaguucaucagcgaguacugcggcgagaucaucagccaggacgaggccgacagaagaggcaagguguacgacaaguacaugugcagcuuccuguucaaccugaacaacgacuucgugguggacgccaccagaaagggcaacaagaucagauucgccaaccacagcgugaaccccaacugcuacgccaaggugaugauggugaacggcgaccacagaaucggcaucuucgccaagagagccauccagaccggcgaggagcuguucuucgacuacagauacagccaggccgacgcccugaaguacgugggcaucgagagagagauggagauccccuga

SEQ ID NO: 1517 - RNA, 2241 nt, Artificial Sequence
  derived and/or modified sequence opt5 from EZH2__Homo_sapiens__AAC51520
augggccagaccgggaagaaaagcgagaagggacccgugugcuggagaaaacgggucaaguccgaauacaugcgccugagacaacucaaacgguuccgcagagccgacgagguuaagucuauguuuagcuccaaccggcagaagauccuggaacgcacagagauucuuaaucaggaauggaaacagagacggauccaaccugugcacauucugacgucugugagcucccuccgcggcaccagagaguguucugucacaagcgaucuggacuucccgacccaggugaucccccuuaagacacugaacgcuguugccuccgugccuauuauguauagcuggucuccccuccagcagaauuuuauggucgaggaugaaaccgugcugcauaacaucccuuacaugggggacgagguucuggaucaagacggaacauucaucgaagaacucauuaaaaauuaugauggcaaggugcacggggaccgggagugcggauuuaucaacgaugaaauuuucgucgagcuggugaaugcgcuuggccaguacaacgacgaugacgaugacgacgauggcgacgaucccgaagaacgcgaagagaaacagaaggaccuggaggaucauagagacgauaaggaaucccggccuccgcgcaaauuucccagcgacaagaucuucgaggcuauuucuuccauguuuccugauaaagggaccgccgaagaacucaaggaaaaauauaaggagcugacggagcagcaacuucccggagcccugccucccgaauguaccccgaauaucgacggcccuaacgcuaaaagcgugcagagagagcagucucuccacuccuuccauacacuguuuugccggagauguuucaaguacgauugcuuucugcaccccuuccacgccaccccuaauacauauaagcgcaaaaacaccgaaacggcucucgacaauaagcccugugggccccaaugcuaccagcaucuggagggagccaaagaguucgcggccgcucuuacagccgagcggauuaagaccccuccgaaaagacccggcgggcgccggagaggacgccugccuaacaauagcucccggcccucuacaccuaccaucaacguccucgagagcaaggacaccgauuccgacagagaagcuggcacagagacgggcggggaaaacaaugauaaggaggaggaagagaaaaaggacgaaaccucuagcuccagcgaggccaacucucgcugucagacacccaucaaaaugaagccgaauauugaaccucccgagaacguugaguggagcggagcggaagccuccauguuucgggugcugaucggcaccuacuaugauaauuucugcgcuauugccagacuuaucgggacaaaaaccugucgccagguguacgaguuucgggucaaggaaucuagcauuaucgcuccugcccccgccgaggacguggauacgccucccagaaagaaaaagcggaaacaccgccugugggcugcgcauugcagaaagauccaacucaaaaaggacggauccagcaaccacguuuauaauuaccagccgugcgaucacccucggcagcccugugacucuuccugccccugugugauugcccagaacuucugcgaaaaguuuugucaaugcagcucugagugucagaauagauucccuggcugccgcuguaaagcucagugcaacacaaagcaguguccgugcuaucuggccguccgggagugcgaucccgaccugugucugaccugcggggccgcugaucauugggacuccaaaaaugugagcuguaagaacugcuccauccaaagaggaucuaaaaagcaucuccuucuggccccuagcgacguugcgggcuggggcauuuuuaucaaagaucccgugcagaagaaugaguucauuuccgaguacuguggggaaaucaucucucaggacgaggcugaucgcagaggaaaggucuaugacaaauacaugugcagcuuucucuucaaccugaauaacgauuuuguggucgacgccacccggaagggcaacaaaauucgcuucgccaaucacuccgugaacccuaauuguuacgcuaagguuaugauggugaacggggaucacagaaucggaauuuuugccaaacgggcuauccagacaggcgaggagcuuuucuucgacuaucgcuacagccaagccgaugcgcugaaguaugucgggauugagagagaaauggagauccccuga

SEQ ID NO: 1518 - protein, 707 aa, Artificial Sequence
  EZH2__Homo_sapiens__S4S3R8
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 1519 - RNA, 2124 nt, Artificial Sequence
  EZH2__Homo_sapiens__AEN79481
augggccagacugggaagaaaucugagaagggaccaguuuguuggcggaagcguguaaaaucagaguacaugcgacugagacagcucaagagguucagacgagcugaugaaguaaagaguauguuuaguuccaaucgucagaaaauuuuggaaagaacggaaaucuuaaaccaagaauggaaacagcgaaggauacagccugugcacauccugacuucugugagcucauugcgcgggacuagggagguggaagaugaaacuguuuuacauaacauuccuuauaugggagaugaaguuuuagaucaggaugguacuuucauugaagaacuaauaaaaaauuaugaugggaaaguacacggggauagagaauguggguuuauaaaugaugaaauuuuuguggaguuggugaaugcccuuggucaauauaaugaugaugacgaugaugaugauggagacgauccugaagaaagagaagaaaagcagaaagaucuggaggaucaccgagaugauaaagaaagccgcccaccucggaaauuuccuucugauaaaauuuuugaagccauuuccucaauguuuccagauaagggcacagcagaagaacuaaaggaaaaauauaaagaacucaccgaacagcagcucccaggcgcacuuccuccugaauguacccccaacauagauggaccaaaugcuaaaucuguucagagagagcaaagcuuacacuccuuucauacgcuuuucuguaggcgauguuuuaaauaugacugcuuccuacauccuuuucaugcaacacccaacacuuauaagcggaagaacacagaaacagcucuagacaacaaaccuuguggaccacaguguuaccagcauuuggagggagcaaaggaguuugcugcugcucucaccgcugagcggauaaagaccccaccaaaacguccaggaggccgcagaagaggacggcuucccaauaacaguagcaggcccagcacccccaccauuaaugugcuggaaucaaaggauacagacagugauagggaagcagggacugaaacggggggagagaacaaugauaaagaagaagaagagaagaaagaugaaacuucgagcuccucugaagcaaauucucggugucaaacaccaauaaagaugaagccaaauauugaaccuccugagaauguggaguggaguggugcugaagccucaauguuuagaguccucauuggcacuuacuaugacaauuucugugccauugcuagguuaauugggaccaaaacauguagacagguguaugaguuuagagucaaagaaucuagcaucauagcuccagcucccgcugaggauguggauacuccuccaaggaaaaagaagaggaaacaccgguugugggcugcacacugcagaaagauacagcugaaaaaggacggcuccucuaaccauguuuacaacuaucaacccugugaucauccacggcagccuugugacaguucgugcccuugugugauagcacaaaauuuuugugaaaaguuuugucaauguaguucagagugucaaaaccgcuuuccgggaugccgcugcaaagcacagugcaacaccaagcagugcccgugcuaccuggcuguccgagagugugacccugaccucugucuuacuuguggagccgcugaccauugggacaguaaaaauguguccugcaagaacugcaguauucagcggggcuccaaaaagcaucuauugcuggcaccaucugacguggcaggcugggggauuuuuaucaaagauccugugcagaaaaaugaauucaucucagaauacuguggagagauuauuucucaagaugaagcugacagaagagggaaaguguaugauaaauacaugugcagcuuucuguucaacuugaacaaugauuuugugguggaugcaacccgcaaggguaacaaaauucguuuugcaaaucauucgguaaauccaaacugcuaugcaaaaguuaugaugguuaacggugaucacaggauagguauuuuugccaagagagccauccagacuggcgaagagcuguuuuuugauuacagauacagccaggcugaugcccugaaguaugucggcaucgaaagagaaauggaaaucccuuga

SEQ ID NO: 1520 - RNA, 2124 nt, Artificial Sequence
  derived and/or modified sequence opt1 from EZH2__Homo_sapiens__AEN79481
augggccagaccgggaagaaguccgagaagggccccgugugcuggcgcaagcgggucaagagcgaguacaugcgccugcggcagcucaagcgcuuccggcgcgccgacgaggucaagagcauguucuccagcaaccggcagaagauccuggagcgcaccgagauccugaaccaggaguggaagcagcggcgcauccagccggugcacauccucacguccgugagcucccugcgggggacccgcgagguggaggacgagaccgugcugcacaacauccccuacaugggcgacgagguccucgaccaggacgggaccuucaucgaggagcugaucaagaacuacgacggcaaggugcacggcgaccgggagugcggguucaucaacgacgagaucuucguggagcuggucaacgcccucggccaguacaacgacgacgacgacgacgacgacggggacgaccccgaggagcgcgaggagaagcagaaggaccuggaggaccaccgggacgacaaggagagccggcccccgcgcaaguuccccuccgacaagaucuucgaggcgaucagcuccauguuccccgacaagggcacggccgaggagcugaaggagaaguacaaggagcucaccgagcagcagcugcccggggcccugccgcccgagugcacccccaacaucgacggccccaacgccaagagcgugcagcgcgagcagucccuccacagcuuccacacccuguucugccggcgcugcuucaaguacgacugcuuccugcacccguuccacgccacgcccaacaccuacaagcggaagaacaccgagaccgcgcucgacaacaagcccugcggcccccagugcuaccagcaccuggagggggccaaggaguucgccgccgcgcugacggccgagcgcaucaagaccccgcccaagcgccccggcgggcggcgccggggccgccuccccaacaacuccagccggccguccacccccaccaucaacgugcuggagagcaaggacacggacuccgaccgcgaggccggcaccgagaccgggggcgagaacaacgacaaggaggaggaggagaagaaggacgagaccagcagcuccagcgaggccaacucccggugccagacgcccaucaagaugaagcccaacaucgagccgcccgagaacgucgaguggagcggggccgaggcguccauguuccgcgugcugaucggcaccuacuacgacaacuucugcgccaucgcccggcucaucgggaccaagaccugccgccagguguacgaguuccgggucaaggagagcuccaucaucgcccccgcccccgcggaggacguggacacgccgccccgcaagaagaagcggaagcaccgccugugggccgcccacugccggaagauccagcugaagaaggacggcagcuccaaccacguguacaacuaccagcccugcgaccacccgcgccagcccugcgacagcuccugccccugcgucaucgcccagaacuucugcgagaaguucugccagugcagcuccgagugccagaaccgguuccccggcugccgcugcaaggcccagugcaacaccaagcagugcccgugcuaccucgcggugcgggagugcgaccccgaccugugccugaccugcggggccgccgaccacugggacagcaagaacguguccugcaagaacugcagcauccagcgcggcuccaagaagcaccuccugcuggcccccagcgacgucgccggguggggcaucuucaucaaggaccccgugcagaagaacgaguucaucuccgaguacugcggggagaucaucagccaggacgaggcggaccgccggggcaagguguacgacaaguacaugugcagcuuccucuucaaccugaacaacgacuucgucguggacgccacccgcaagggcaacaagauccgguucgccaaccacuccgucaacccgaacugcuacgccaaggugaugauggugaacggggaccaccgcaucggcaucuucgcgaagcgggccauccagacgggggaggagcuguucuucgacuaccgcuacagccaggccgacgcccucaaguacgucggcaucgagcgggagauggagauccccuga

SEQ ID NO: 1521 - RNA, 2124 nt, Artificial Sequence
  derived and/or modified sequence opt2 from EZH2__Homo_sapiens__AEN79481
augggccagaccggcaagaaguccgagaagggccccgucugcuggcgcaagcgcgucaaguccgaguacaugcgccuccgccagcucaagcgcuuccgccgcgccgacgaggucaaguccauguucuccuccaaccgccagaagauccucgagcgcaccgagauccucaaccaggaguggaagcagcgccgcauccagcccguccacauccucaccuccgucuccucccuccgcggcacccgcgaggucgaggacgagaccguccuccacaacauccccuacaugggcgacgagguccucgaccaggacggcaccuucaucgaggagcucaucaagaacuacgacggcaagguccacggcgaccgcgagugcggcuucaucaacgacgagaucuucgucgagcucgucaacgcccucggccaguacaacgacgacgacgacgacgacgacggcgacgaccccgaggagcgcgaggagaagcagaaggaccucgaggaccaccgcgacgacaaggagucccgccccccccgcaaguuccccuccgacaagaucuucgaggccaucuccuccauguuccccgacaagggcaccgccgaggagcucaaggagaaguacaaggagcucaccgagcagcagcuccccggcgcccucccccccgagugcacccccaacaucgacggccccaacgccaaguccguccagcgcgagcagucccuccacuccuuccacacccucuucugccgccgcugcuucaaguacgacugcuuccuccaccccuuccacgccacccccaacaccuacaagcgcaagaacaccgagaccgcccucgacaacaagcccugcggcccccagugcuaccagcaccucgagggcgccaaggaguucgccgccgcccucaccgccgagcgcaucaagaccccccccaagcgccccggcggccgccgccgcggccgccuccccaacaacuccucccgccccuccacccccaccaucaacguccucgaguccaaggacaccgacuccgaccgcgaggccggcaccgagaccggcggcgagaacaacgacaaggaggaggaggagaagaaggacgagaccuccuccuccuccgaggccaacucccgcugccagacccccaucaagaugaagcccaacaucgagccccccgagaacgucgagugguccggcgccgaggccuccauguuccgcguccucaucggcaccuacuacgacaacuucugcgccaucgcccgccucaucggcaccaagaccugccgccaggucuacgaguuccgcgucaaggaguccuccaucaucgcccccgcccccgccgaggacgucgacacccccccccgcaagaagaagcgcaagcaccgccucugggccgcccacugccgcaagauccagcucaagaaggacggcuccuccaaccacgucuacaacuaccagcccugcgaccacccccgccagcccugcgacuccuccugccccugcgucaucgcccagaacuucugcgagaaguucugccagugcuccuccgagugccagaaccgcuuccccggcugccgcugcaaggcccagugcaacaccaagcagugccccugcuaccucgccguccgcgagugcgaccccgaccucugccucaccugcggcgccgccgaccacugggacuccaagaacgucuccugcaagaacugcuccauccagcgcggcuccaagaagcaccuccuccucgcccccuccgacgucgccggcuggggcaucuucaucaaggaccccguccagaagaacgaguucaucuccgaguacugcggcgagaucaucucccaggacgaggccgaccgccgcggcaaggucuacgacaaguacaugugcuccuuccucuucaaccucaacaacgacuucgucgucgacgccacccgcaagggcaacaagauccgcuucgccaaccacuccgucaaccccaacugcuacgccaaggucaugauggucaacggcgaccaccgcaucggcaucuucgccaagcgcgccauccagaccggcgaggagcucuucuucgacuaccgcuacucccaggccgacgcccucaaguacgucggcaucgagcgcgagauggagauccccuga

SEQ ID NO: 1522 - RNA, 2124 nt, Artificial Sequence
  derived and/or modified sequence opt3 from EZH2__Homo_sapiens__AEN79481
augggccagaccgggaagaaaagcgagaagggacccgugugcuggagaaaaagggucaaguccgaauacaugcggcugcgccaacucaaacgauuccguagagccgacgagguuaagucuauguuuucaaguaacaggcagaagauccuugaacggacagagauucugaaucaggaauggaaacagcgcagaauacaaccugugcacaucuugacuagcguauccucuuuaagggguacgcgggagguggaggaugaaaccguccugcauaacauuccauauaugggcgacgaggugcuagaucaggacgggacauucaucgaagaacucauuaagaauuacgauggaaaaguucacggcgaccgcgagugugguuuuaucaacgaugaaauauucguggagcuggucaaugcucuugggcaguauaacgacgaugacgaugacgaugacggagacgauccggaagaacgagaagagaagcagaaagaccuggaggaucauagagacgauaaggaaucgaggcccccucggaaguuuccaucagacaaaaucuucgaggcaauuagcaguauguuucccgauaagggcacugccgaagaguugaaagaaaaguacaaagagcucaccgagcaacagcugccuggcgcgcugccacccgaaugcacaccuaauaucgacgggccaaacgcuaaguccgugcagcgugagcagucucuccacagcuuccauaccuuauuuugucgcagaugcuucaaauaugauuguuuucugcacccguuccacgccacucccaauacauacaagaggaagaacaccgaaacggcacuugacaauaaaccuugcggaccacaauguuaucagcauuuggagggugccaaggaauuugcugcagcccugacugcugagcggauuaaaacacccccuaagcgaccaggcgggcgcagaaggggacggcuacccaacaauuccucacgcccgaguaccccuacuaucaacguacucgagagcaaagauaccgacucugacagagaagccggcacagagaccgguggggaaaauaacgauaaggaggaggaagagaagaaagacgaaacguccucaagcagugaggcgaacucuaggugccagacucccauaaagaugaaaccaaauauugaaccucccgagaacguugagugguccggagcagaagccagcauguuccgugugcugaucggcacauacuacgauaauuucugugcuauugcccggcuuaucggcaccaagacuugccgacaagucuaugaguuuagagugaaagaaucgucuaucauugcaccagcucccgccgaggacguggauacaccuccaaggaagaagaaacgcaagcaccggcugugggcggcccauuguagaaaaauacaguugaagaaagacggguccucaaaccacgucuacaauuaucagccgugcgaucaccccaggcagccuugcgacaguagcuguccaugcguuaucgcacaaaacuucugugaaaaguuuugccaguguuccucugagugccagaaucgcuuccccggaugucgaugcaaggcucaguguaacaccaaacaaugcccuuguuaccucgccgugcgggagugcgauccagaccugugcuuaacguguggugcugccgaucauugggacagcaagaauguaucaugcaaaaacuguaguauucagcguggcuccaagaaacaucugcuccuugcacccagcgauguggccggguggggaaucuuuauaaaggacccgguccagaaaaaugaguucauuucugaguauugcggcgaaaucaucucacaggacgaggcugauagaagggguaagguguacgacaaguauauguguaguuuucuguucaacuugaauaacgauuuuguuguggacgcgacccgcaaagggaauaagauucgguucgcaaaccacagcgucaacccuaauugcuacgccaaagugaugaugguaaacggcgaucacagaaucggaauuuuugcuaagagggccauacaaacaggcgaggagcuauucuuugacuaccgauauucccaggcagaugcccugaaauacguugggaucgagcgcgaaauggagauuccauga

SEQ ID NO: 1523 - RNA, 2124 nt, Artificial Sequence
  derived and/or modified sequence opt4 from EZH2__Homo_sapiens__AEN79481
augggccagaccggcaagaagagcgagaagggccccgugugcuggagaaagagagugaagagcgaguacaugagacugagacagcugaagagauucagaagagccgacgaggugaagagcauguucagcagcaacagacagaagauccuggagagaaccgagauccugaaccaggaguggaagcagagaagaauccagcccgugcacauccugaccagcgugagcagccugagaggcaccagagagguggaggacgagaccgugcugcacaacauccccuacaugggcgacgaggugcuggaccaggacggcaccuucaucgaggagcugaucaagaacuacgacggcaaggugcacggcgacagagagugcggcuucaucaacgacgagaucuucguggagcuggugaacgcccugggccaguacaacgacgacgacgacgacgacgacggcgacgaccccgaggagagagaggagaagcagaaggaccuggaggaccacagagacgacaaggagagcagaccccccagaaaguuccccagcgacaagaucuucgaggccaucagcagcauguuccccgacaagggcaccgccgaggagcugaaggagaaguacaaggagcugaccgagcagcagcugcccggcgcccugccccccgagugcacccccaacaucgacggccccaacgccaagagcgugcagagagagcagagccugcacagcuuccacacccuguucugcagaagaugcuucaaguacgacugcuuccugcaccccuuccacgccacccccaacaccuacaagagaaagaacaccgagaccgcccuggacaacaagcccugcggcccccagugcuaccagcaccuggagggcgccaaggaguucgccgccgcccugaccgccgagagaaucaagaccccccccaagagacccggcggcagaagaagaggcagacugcccaacaacagcagcagacccagcacccccaccaucaacgugcuggagagcaaggacaccgacagcgacagagaggccggcaccgagaccggcggcgagaacaacgacaaggaggaggaggagaagaaggacgagaccagcagcagcagcgaggccaacagcagaugccagacccccaucaagaugaagcccaacaucgagccccccgagaacguggaguggagcggcgccgaggccagcauguucagagugcugaucggcaccuacuacgacaacuucugcgccaucgccagacugaucggcaccaagaccugcagacagguguacgaguucagagugaaggagagcagcaucaucgcccccgcccccgccgaggacguggacaccccccccagaaagaagaagagaaagcacagacugugggccgcccacugcagaaagauccagcugaagaaggacggcagcagcaaccacguguacaacuaccagcccugcgaccaccccagacagcccugcgacagcagcugccccugcgugaucgcccagaacuucugcgagaaguucugccagugcagcagcgagugccagaacagauuccccggcugcagaugcaaggcccagugcaacaccaagcagugccccugcuaccuggccgugagagagugcgaccccgaccugugccugaccugcggcgccgccgaccacugggacagcaagaacgugagcugcaagaacugcagcauccagagaggcagcaagaagcaccugcugcuggcccccagcgacguggccggcuggggcaucuucaucaaggaccccgugcagaagaacgaguucaucagcgaguacugcggcgagaucaucagccaggacgaggccgacagaagaggcaagguguacgacaaguacaugugcagcuuccuguucaaccugaacaacgacuucgugguggacgccaccagaaagggcaacaagaucagauucgccaaccacagcgugaaccccaacugcuacgccaaggugaugauggugaacggcgaccacagaaucggcaucuucgccaagagagccauccagaccggcgaggagcuguucuucgacuacagauacagccaggccgacgcccugaaguacgugggcaucgagagagagauggagauccccuga

SEQ ID NO: 1524 - RNA, 2124 nt, Artificial Sequence
  derived and/or modified sequence opt5 from EZH2__Homo_sapiens__AEN79481
augggccagaccgggaagaaaagcgagaagggacccgugugcuggagaaaacgggucaaguccgaauacaugcgccugagacaacucaaacgguuccgcagagccgacgagguuaagucuauguuuagcuccaaccggcagaagauccuggaacgcacagagauucuuaaucaggaauggaaacagagacggauccaaccugugcacauucugacgucugugagcucccuccgcggcaccagagaggucgaggaugaaacagugcugcauaacaucccguauaugggggacgagguucuugaucaggacggaaccuucauugaagaacugaucaagaauuacgauggcaaagugcacggggaccgggaguguggauuuaucaacgaugaaauuuucgucgagcucgugaaugcucugggccaguauaacgacgaugacgaugacgaugacggcgacgaucccgaagaacgcgaagagaagcagaaagaccuggaggaucauagagacgauaaggaaucucggccuccccgcaaguuuccuagcgacaaaaucuucgaggccauuuccagcauguuucccgauaaggggacagcggaggagcucaaagaaaaguacaaagagcugaccgagcaacagcuuccuggagcucugccgcccgaaugcacaccuaauaucgacggccccaacgccaagucuguucagagagagcagucccuccacagcuuccauacccuguuuugucggagaugcuucaaauaugauuguuuucuucacccuuuccacgccacgcccaauaccuacaagcgcaagaacacagaaaccgcucuggacaauaaaccgugcgggccucaauguuaucagcaucucgagggagccaaggaauuugcugccgcgcugacagccgagcggauuaaaacgcccccuaagagacccggcgggcgccggagaggacgccugcccaacaauucuucccggccuagcaccccgacaaucaacgugcucgagucuaaagauaccgacuccgacagagaagcuggcacagagaccggcggggaaaauaacgauaaggaggaggaagagaagaaagacgaaaccagcuccucuagcgaggccaacucccgcugccagacacccauuaagaugaaaccuaauaucgaacccccugagaacgucgaguggagcggagcugaagccucuauguuccgggugcugaucggcacguacuacgauaauuucugugcgauugccagacuuaucgggaccaagacaugccgccaaguguaugaguuucgggucaaagaauccagcauuaucgcucccgccccggcugaggacguugauaccccucccagaaagaagaaacggaagcaccgccugugggccgcccauuguagaaaaauucagcucaagaaagacggaucuagcaaccacguguacaauuaucagccuugcgaucacccccggcagccuugcgacuccucuugucccugcgugaucgcucaaaacuucugugaaaaguuuugccaguguagcuccgagugccagaauagauucccgggcugucgcugcaaggcgcaguguaacacaaaacaaugcccuuguuaccuggccguccgggagugcgaucccgaccuuugccugaccuguggggcugccgaucauugggacagcaagaaugugucuugcaaaaacuguuccauccagagaggaagcaagaaacaccuccugcuggcccccucugauguugcuggcuggggcauuuuuaucaaggacccugugcagaaaaaugaguucauuuccgaguauugcggggaaaucauuagccaggacgaggccgaucgcagaggaaaggucuacgacaaguauauguguuccuuucucuucaaccugaauaacgauuuugugguugacgcgacgcggaaaggcaauaagauccgcuucgcuaaccauucugugaacccgaauugcuacgccaaagucaugauggugaacggggaucacagaaucggaauuuuugccaagcgggcuauccaaacaggcgaggaacuuuucuuugacuaccgcuauagccaggccgaugcucugaaauacgucgggauugagagagaaauggagauccccuga

SEQ ID NO: 1525 - protein, 132 aa, Artificial Sequence
  FABP7__Homo_sapiens__O15540
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMTLTFGDVVAVRHYEKA

SEQ ID NO: 1526 - RNA, 399 nt, Artificial Sequence
  FABP7__Homo_sapiens__AAB87141
augguggaggcuuucugugcuaccuggaagcugaccaacagucagaacuuugaugaguacaugaaggcucuaggcgugggcuuugccacuaggcaggugggaaaugugaccaaaccaacgguaauuaucagucaagaaggagacaaaguggucaucaggacucucagcacauucaagaacacggagauuaguuuccagcugggagaagaguuugaugaaaccacugcagaugauagaaacuguaagucuguuguuagccuggauggagacaaacuuguucacauacagaaaugggauggcaaagaaacaaauuuuguaagagaaauuaaggauggcaaaaugguuaugacccuuacuuuuggugaugugguugcuguucgccacuaugagaaggcauaa

SEQ ID NO: 1527 - RNA, 399 nt, Artificial Sequence
  derived and/or modified sequence opt1 from FABP7__Homo_sapiens__AAB87141
augguggaggccuucugcgccaccuggaagcugaccaacagccagaacuucgacgaguacaugaaggcgcucggcgucggguucgccacgcgccaggugggcaacgugaccaagcccaccgucaucaucucccaggagggggacaagguggugauccggacccugagcacguucaagaacaccgagaucuccuuccagcugggcgaggaguucgacgagaccaccgccgacgaccgcaacugcaagagcgucgugucccucgacggggacaagcuggugcacauccagaagugggacggcaaggagacgaacuucguccgggagaucaaggacggcaagauggugaugacccugaccuucggggacguggucgccgugcgccacuacgagaaggccuga

SEQ ID NO: 1528 - RNA, 399 nt, Artificial Sequence
  derived and/or modified sequence opt2 from FABP7__Homo_sapiens__AAB87141
auggucgaggccuucugcgccaccuggaagcucaccaacucccagaacuucgacgaguacaugaaggcccucggcgucggcuucgccacccgccaggucggcaacgucaccaagcccaccgucaucaucucccaggagggcgacaaggucgucauccgcacccucuccaccuucaagaacaccgagaucuccuuccagcucggcgaggaguucgacgagaccaccgccgacgaccgcaacugcaaguccgucgucucccucgacggcgacaagcucguccacauccagaagugggacggcaaggagaccaacuucguccgcgagaucaaggacggcaagauggucaugacccucaccuucggcgacgucgucgccguccgccacuacgagaaggccuga

SEQ ID NO: 1529 - RNA, 399 nt, Artificial Sequence
  derived and/or modified sequence opt3 from FABP7__Homo_sapiens__AAB87141
augguggaggccuucugcgcuaccuggaagcugacaaacagccagaauuuugacgaauacaugaaagcacucggcgucggguucgccacuagacaaguuggaaacgugacgaagcccaccguaaucauuucccaggagggugauaaaguggucauaaggacacuuucuacuuuuaagaauaccgaaaucucauuccagcugggcgaggaauuugacgagacaaccgcggaugaccggaacuguaaaagugugguuagcuuggauggggacaaguuagugcacauucagaagugggauggaaaagagacuaauuucguccgcgaaaucaaggacggcaaaauggugaugacacugaccuuuggugauguaguugcugugcgacauuaugagaaggccuga

SEQ ID NO: 1530 - RNA, 399 nt, Artificial Sequence
  derived and/or modified sequence opt4 from FABP7__Homo_sapiens__AAB87141
augguggaggccuucugcgccaccuggaagcugaccaacagccagaacuucgacgaguacaugaaggcccugggcgugggcuucgccaccagacaggugggcaacgugaccaagcccaccgugaucaucagccaggagggcgacaagguggugaucagaacccugagcaccuucaagaacaccgagaucagcuuccagcugggcgaggaguucgacgagaccaccgccgacgacagaaacugcaagagcguggugagccuggacggcgacaagcuggugcacauccagaagugggacggcaaggagaccaacuucgugagagagaucaaggacggcaagauggugaugacccugaccuucggcgacgugguggccgugagacacuacgagaaggccuga

SEQ ID NO: 1531 - RNA, 399 nt, Artificial Sequence
  derived and/or modified sequence opt5 from FABP7__Homo_sapiens__AAB87141
augguggaggccuucugcgcuaccuggaagcugacaaacagccagaauuuugacgaauacaugaaagcccucggcgucggguucgcgacgagacaaguuggaaacgugaccaagcccacagugaucauuucccaggagggcgauaaagucgugauccggacccugucuacauuuaagaauaccgaaauuagcuuccagcuuggggaggaauuugacgagacaaccgcugaugaccgcaacuguaaauccguugugucucuggauggagacaagcucguccacauccagaagugggauggcaaagagacgaauuucgugagagaaauuaaggacgggaaaaugguuaugacccugacauuuggagauguggucgccgugcggcauuaugagaaggccuga

SEQ ID NO: 1532 - protein, 254 aa, Artificial Sequence
  FCGR3A_Version_1__Homo_sapiens__P08637
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 1533 - RNA, 765 nt, Artificial Sequence
  FCGR3A_Version_1__Homo_sapiens__CAA36870
auguggcagcugcuccucccaacugcucugcuacuucuaguuucagcuggcaugcggacugaagaucucccaaaggcugugguguuccuggagccucaaugguacagggugcucgagaaggacagugugacucugaagugccagggagccuacuccccugaggacaauuccacacagugguuucacaaugagagccucaucucaagccaggccucgagcuacuucauugacgcugccacagucgacgacaguggagaguacaggugccagacaaaccucuccacccucagugacccggugcagcuagaaguccauaucggcuggcuguugcuccaggccccucgguggguguucaaggaggaagacccuauucaccugaggugucacagcuggaagaacacugcucugcauaaggucacauauuuacagaauggcaaaggcaggaaguauuuucaucauaauucugacuucuacauuccaaaagccacacucaaagacagcggcuccuacuucugcagggggcuuuuugggaguaaaaaugugucuucagagacugugaacaucaccaucacucaagguuuggcagugucaaccaucucaucauucuuuccaccuggguaccaagucucuuucugcuuggugaugguacuccuuuuugcaguggacacaggacuauauuucucugugaagacaaacauucgaagcucaacaagagacuggaaggaccauaaauuuaaauggagaaaggacccucaagacaaauga

SEQ ID NO: 1534 - RNA, 765 nt, Artificial Sequence
  derived and/or modified sequence opt1 from FCGR3A_Version_1__Homo_sapiens__CAA36870
auguggcagcugcuccugcccaccgcccugcuccugcuggugagcgccggcaugcgcaccgaggaccucccgaaggcggucguguuccuggagccccagugguaccgggugcuggagaaggacuccgucacgcucaagugccagggggccuacagccccgaggacaacuccacccagugguuccacaacgagagccugaucuccagccaggccuccagcuacuucaucgacgccgccaccguggacgacuccggcgaguaccgcugccagaccaaccugagcacgcucuccgaccccgugcagcuggagguccacaucggguggcugcuccugcaggcgccgcgguggguguucaaggaggaggaccccauccaccuccgcugccacagcuggaagaacaccgcccugcacaaggugaccuaccugcagaacggcaaggggcggaaguacuuccaccacaacuccgacuucuacauccccaaggccacccugaaggacagcggcuccuacuucugccgcggccucuucgggagcaagaacgucuccagcgagacggugaacaucaccaucacccagggccuggccguguccaccaucagcagcuucuucccgcccggguaccaggucuccuucugccuggugauggugcuccuguucgcggucgacacgggccuguacuucagcgugaagaccaacauccgguccagcacccgcgacuggaaggaccacaaguucaaguggcggaaggacccccaggacaaguga

SEQ ID NO: 1535 - RNA, 765 nt, Artificial Sequence
  derived and/or modified sequence opt2 from FCGR3A_Version_1__Homo_sapiens__CAA36870
auguggcagcuccuccuccccaccgcccuccuccuccucgucuccgccggcaugcgcaccgaggaccuccccaaggccgucgucuuccucgagccccagugguaccgcguccucgagaaggacuccgucacccucaagugccagggcgccuacucccccgaggacaacuccacccagugguuccacaacgagucccucaucuccucccaggccuccuccuacuucaucgacgccgccaccgucgacgacuccggcgaguaccgcugccagaccaaccucuccacccucuccgaccccguccagcucgagguccacaucggcuggcuccuccuccaggccccccgcugggucuucaaggaggaggaccccauccaccuccgcugccacuccuggaagaacaccgcccuccacaaggucaccuaccuccagaacggcaagggccgcaaguacuuccaccacaacuccgacuucuacauccccaaggccacccucaaggacuccggcuccuacuucugccgcggccucuucggcuccaagaacgucuccuccgagaccgucaacaucaccaucacccagggccucgccgucuccaccaucuccuccuucuucccccccggcuaccaggucuccuucugccucgucaugguccuccucuucgccgucgacaccggccucuacuucuccgucaagaccaacauccgcuccuccacccgcgacuggaaggaccacaaguucaaguggcgcaaggacccccaggacaaguga

SEQ ID NO: 1536 - RNA, 765 nt, Artificial Sequence
  derived and/or modified sequence opt3 from FCGR3A_Version_1__Homo_sapiens__CAA36870
auguggcagcugcuccuucccaccgcccuguuguuacuggugagcgcuggcaugagaacagaggaccuaccuaaggcagucguuuuccucgaaccacaaugguacagggugcuggagaaagauuccguaacucuuaagugccagggggccuauucuccggaagacaacucaacgcagugguuucacaaugagagucugaucagcucccaggcgucuucguacuucauugaugcugccaccguggacgauucaggagaauaucggugucaaacaaacuugagcacucucagugaccccguccagcuggaggugcauauagguuggcugcucuuacaggcaccucgcuggguuuuuaaagaggaagauccaauccaucugcgaugccacuccuggaagaauaccgcccuucacaaagugacauacuugcagaacggcaaggggcguaaguauuuccaucacaauucugacuuuuacauucccaaagcuacccugaaggauagcggauccuauuucuguagaggccuauuugguaguaaaaacgucucaagcgagacugugaauaucacaauuacccaagggcucgcaguaucuacgaucuccucauucuuuccuccaggauaccagguuagcuucugccuggugaugguccuucuguuugccguggacacuggcuuguacuucagugugaagaccaacauaaggucuuccacacgggauuggaaagaccacaaguuuaaguggcgcaaagauccccaggacaaguga

SEQ ID NO: 1537 - RNA, 765 nt, Artificial Sequence
  derived and/or modified sequence opt4 from FCGR3A_Version_1__Homo_sapiens__CAA36870
auguggcagcugcugcugcccaccgcccugcugcugcuggugagcgccggcaugagaaccgaggaccugcccaaggccgugguguuccuggagccccagugguacagagugcuggagaaggacagcgugacccugaagugccagggcgccuacagccccgaggacaacagcacccagugguuccacaacgagagccugaucagcagccaggccagcagcuacuucaucgacgccgccaccguggacgacagcggcgaguacagaugccagaccaaccugagcacccugagcgaccccgugcagcuggaggugcacaucggcuggcugcugcugcaggcccccagauggguguucaaggaggaggaccccauccaccugagaugccacagcuggaagaacaccgcccugcacaaggugaccuaccugcagaacggcaagggcagaaaguacuuccaccacaacagcgacuucuacauccccaaggccacccugaaggacagcggcagcuacuucugcagaggccuguucggcagcaagaacgugagcagcgagaccgugaacaucaccaucacccagggccuggccgugagcaccaucagcagcuucuucccccccggcuaccaggugagcuucugccuggugauggugcugcuguucgccguggacaccggccuguacuucagcgugaagaccaacaucagaagcagcaccagagacuggaaggaccacaaguucaaguggagaaaggacccccaggacaaguga

SEQ ID NO: 1538 - RNA, 765 nt, Artificial Sequence
  derived and/or modified sequence opt5 from FCGR3A_Version_1__Homo_sapiens__CAA36870
auguggcagcugcuccugcccaccgcccuucugcuccuggugagcgcuggcaugagaacagaggaccuuccuaaggccgucguuuuccuggaaccgcaaugguaccgggugcucgagaaagauuccgugacgcugaagugccagggggcguauucucccgaagacaacagcacccagugguuucacaaugagucccugaucucuagccaggcuuccucuuacuucauugaugccgccacagucgacgauagcggagaauaucgcugucaaaccaaccucuccacacugagcgacccugugcagcuugagguucauaucggcuggcugcuccugcaggcucccagauggguguuuaaagaggaagauccuauucaccuucggugccauucuuggaagaauaccgcccugcacaaagucacauaccuccagaacgggaagggacgcaaguauuuccaucacaauuccgacuuuuacauccccaaagcuacccugaaggauagcggcucuuauuucuguagagggcuguuuggauccaaaaacgugagcucugagacgguuaauauuaccaucacacaaggccucgccguguccaccaucagcuccuucuuuccuccgggcuaccaggucucuuucugccuggugauggugcuucuguuugcggucgacacagggcucuacuucagcguuaagaccaacauucgguccagcacgcgcgauuggaaagaccacaaguuuaaguggagaaaagauccccaggacaaguga

SEQ ID NO: 1539 - protein, 290 aa, Artificial Sequence
  FCGR3A_Version_2__Homo_sapiens__CCDS1232.1
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 1540 - RNA, 873 nt, Artificial Sequence
  FCGR3A_Version_2__Homo_sapiens__CCDS1232.1
auggguggaggggcuggggaaaggcuguuuacuuccuccugucuagucgguuuggucccuuuagggcuccggauaucuuuggugacuuguccacuccaguguggcaucauguggcagcugcuccucccaacugcucugcuacuucuaguuucagcuggcaugcggacugaagaucucccaaaggcugugguguuccuggagccucaaugguacagggugcucgagaaggacagugugacucugaagugccagggagccuacuccccugaggacaauuccacacagugguuucacaaugagagccucaucucaagccaggccucgagcuacuucauugacgcugccacagucgacgacaguggagaguacaggugccagacaaaccucuccacccucagugacccggugcagcuagaaguccauaucggcuggcuguugcuccaggccccucgguggguguucaaggaggaagacccuauucaccugaggugucacagcuggaagaacacugcucugcauaaggucacauauuuacagaauggcaaaggcaggaaguauuuucaucauaauucugacuucuacauuccaaaagccacacucaaagacagcggcuccuacuucugcagggggcuuuuugggaguaaaaaugugucuucagagacugugaacaucaccaucacucaagguuuggcagugucaaccaucucaucauucuuuccaccuggguaccaagucucuuucugcuuggugaugguacuccuuuuugcaguggacacaggacuauauuucucugugaagacaaacauucgaagcucaacaagagacuggaaggaccauaaauuuaaauggagaaaggacccucaagacaaauga

SEQ ID NO: 1541 - RNA, 873 nt, Artificial Sequence
  derived and/or modified sequence opt1 from FCGR3A_Version_2__Homo_sapiens__CCDS1232.1
augggcgggggcgccggggagcgccuguucaccagcuccugccucgugggccuggucccccuggggcuccggaucagccuggugaccugcccccugcagugcggcaucauguggcagcuccugcugcccacggcccuccugcugcucguguccgcgggcaugcgcaccgaggaccugcccaaggccgucguguuccuggagccccagugguaccgggugcucgagaaggacagcgucacccugaagugccagggggccuacuccccggaggacaacagcacccagugguuccacaacgagucccugaucagcucccaggccagcuccuacuucaucgacgccgcgacgguggacgacagcggcgaguaccgcugccagaccaaccucuccacccugagcgaccccgugcagcuggagguccacaucggguggcuccugcugcaggcgccccgguggguguucaaggaggaggaccccauccaccuccgcugccacuccuggaagaacaccgcccugcacaaggugacguaccugcagaacggcaaggggcggaaguacuuccaccacaacagcgacuucuacaucccgaaggccacccucaaggacuccggcagcuacuucugccgcggccuguucggguccaagaacgucagcagcgagaccgugaacaucaccaucacgcagggccuggccguguccaccaucagcuccuucuucccgcccggguaccaggucagcuucugccucgugauggugcugcuguucgccgucgacaccggccucuacuucuccgugaagaccaacauccggagcuccacgcgcgacuggaaggaccacaaguucaaguggcggaaggacccccaggacaaguga

SEQ ID NO: 1542 - RNA, 873 nt, Artificial Sequence
  derived and/or modified sequence opt2 from FCGR3A_Version_2__Homo_sapiens__CCDS1232.1
augggcggcggcgccggcgagcgccucuucaccuccuccugccucgucggccucgucccccucggccuccgcaucucccucgucaccugcccccuccagugcggcaucauguggcagcuccuccuccccaccgcccuccuccuccucgucuccgccggcaugcgcaccgaggaccuccccaaggccgucgucuuccucgagccccagugguaccgcguccucgagaaggacuccgucacccucaagugccagggcgccuacucccccgaggacaacuccacccagugguuccacaacgagucccucaucuccucccaggccuccuccuacuucaucgacgccgccaccgucgacgacuccggcgaguaccgcugccagaccaaccucuccacccucuccgaccccguccagcucgagguccacaucggcuggcuccuccuccaggccccccgcugggucuucaaggaggaggaccccauccaccuccgcugccacuccuggaagaacaccgcccuccacaaggucaccuaccuccagaacggcaagggccgcaaguacuuccaccacaacuccgacuucuacauccccaaggccacccucaaggacuccggcuccuacuucugccgcggccucuucggcuccaagaacgucuccuccgagaccgucaacaucaccaucacccagggccucgccgucuccaccaucuccuccuucuucccccccggcuaccaggucuccuucugccucgucaugguccuccucuucgccgucgacaccggccucuacuucuccgucaagaccaacauccgcuccuccacccgcgacuggaaggaccacaaguucaaguggcgcaaggacccccaggacaaguga

SEQ ID NO: 1543 - RNA, 873 nt, Artificial Sequence
  derived and/or modified sequence opt3 from FCGR3A_Version_2__Homo_sapiens__CCDS1232.1
augggcgggggagccggugagagacuguucaccagcuccugccucgugggccuugucccccugggguugaggaucucuuuaguuacauguccucugcagugcggaauuauguggcaacuacuccugccaacugcccuucuguugcucgugucagcaggcaugcggacggaagaccugccgaaggccguaguguuucuggagccccagugguaccgcguccucgaaaaagauagugugaccuuaaagugucagggugcguauagcccugaggacaacuccacacagugguuccacaaugaaucucugauaucgucacaagcuagcaguuacuuuaucgaugccgcaacuguugacgauuccggggaguaucgaugccagaccaaccuuucuacauugagcgacccagugcagcuggagguccauauuggauggcuacuccugcaggcuccccguuggguguucaaagaagaggauccuauccaccuuagaugucauuccuggaagaauaccgcucugcacaaaguaacuuacuugcaaaacggcaagggcaggaaguauuuucaucacaauucagacuucuacauuccaaaagcaacacucaaggauagugggagcuauuuuugccggggacuguucgguucuaaaaacguuuccucagaaaccgugaauaucacgauaacucagggcuuagccgucagcaccaucaguucuuucuuucccccuggguaccagguguccuuuugucuggugaugguccuccuuuucgcuguugacacaggacuguacuuuagcgugaagacuaacauucgcucgucuaccagagauuggaaagaccacaaguucaaguggaggaaagauccacaggacaaguga

SEQ ID NO: 1544 - RNA, 873 nt, Artificial Sequence
  derived and/or modified sequence opt4 from FCGR3A_Version_2__Homo_sapiens__CCDS1232.1
augggcggcggcgccggcgagagacuguucaccagcagcugccuggugggccuggugccccugggccugagaaucagccuggugaccugcccccugcagugcggcaucauguggcagcugcugcugcccaccgcccugcugcugcuggugagcgccggcaugagaaccgaggaccugcccaaggccgugguguuccuggagccccagugguacagagugcuggagaaggacagcgugacccugaagugccagggcgccuacagccccgaggacaacagcacccagugguuccacaacgagagccugaucagcagccaggccagcagcuacuucaucgacgccgccaccguggacgacagcggcgaguacagaugccagaccaaccugagcacccugagcgaccccgugcagcuggaggugcacaucggcuggcugcugcugcaggcccccagauggguguucaaggaggaggaccccauccaccugagaugccacagcuggaagaacaccgcccugcacaaggugaccuaccugcagaacggcaagggcagaaaguacuuccaccacaacagcgacuucuacauccccaaggccacccugaaggacagcggcagcuacuucugcagaggccuguucggcagcaagaacgugagcagcgagaccgugaacaucaccaucacccagggccuggccgugagcaccaucagcagcuucuucccccccggcuaccaggugagcuucugccuggugauggugcugcuguucgccguggacaccggccuguacuucagcgugaagaccaacaucagaagcagcaccagagacuggaaggaccacaaguucaaguggagaaaggacccccaggacaaguga

SEQ ID NO: 1545 - RNA, 873 nt, Artificial Sequence
  derived and/or modified sequence opt5 from FCGR3A_Version_2__Homo_sapiens__CCDS1232.1
augggcgggggagccggcgagagacuguucaccagcuccugccucguggggcuggucccccuuggacugcggaucucucucguuacauguccucugcagugcggcauuauguggcaacuucugcucccgacggcucugcugcuccuggugagcgccgggaugcgcaccgaagaccuucccaaggcgguggucuuucuggagccucagugguacagagugcucgaaaaagauuccguuacacugaagugucagggagcuuauucucccgaggacaacagcacccagugguuccacaaugaaucccuuaucucuagccaagccuccagcuacuuuauugaugccgcuacaguggacgauucuggcgaguaucggugccagaccaaccuguccacacucagcgacccuguccagcuggaggugcauaucggcuggcugcuccugcaggcuccccgcuggguuuucaaagaagaggauccuauucaccuuagaugucauucuuggaagaauaccgcccugcacaaagugacguaccuccaaaacgggaagggacggaaguauuuucaucacaauuccgacuucuacaucccgaaagccacccugaaggauagcggcucuuauuuuugccgcgggcuuuucggauccaaaaacgucagcuccgaaacagugaauaucaccauuacacagggccuggcggugucuaccaucagcuccuuuuucccucccggguaccaggucagcuuuugucucguuauggugcugcuguucgccguggacacgggacucuacuuuucugucaagacaaacauuagauccagcacccgggauuggaaagaccacaaguucaaguggcgcaaagauccccaggacaaguga

SEQ ID NO: 1546 - protein, 268 aa, Artificial Sequence
  FGF5__Homo_sapiens__P12034
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 1547 - RNA, 807 nt, Artificial Sequence
  FGF5__Homo_sapiens__AAH74858
augagcuuguccuuccuccuccuccucuucuucagccaccugauccucagcgccugggcucacggggagaagcgucucgcccccaaagggcaacccggacccgcugccacugauaggaacccuagaggcuccagcagcagacagagcagcaguagcgcuaugucuuccucuucugccuccuccucccccgcagcuucucugggcagccaaggaaguggcuuggagcagagcaguuuccaguggagccccucggggcgccggaccggcagccucuacugcagagugggcaucgguuuccaucugcagaucuacccggauggcaaagucaauggaucccacgaagccaauauguuaaguguuuuggaaauauuugcugugucucaggggauuguaggaauacgaggaguuuucagcaacaaauuuuuagcgaugucaaaaaaaggaaaacuccaugcaagugccaaguucacagaugacugcaaguucagggagcguuuucaagaaaauagcuauaauaccuaugccucagcaauacauagaacugaaaaaacagggcgggagugguauguggcccugaauaaaagaggaaaagccaaacgagggugcagcccccggguuaaaccccagcauaucucuacccauuuucugccaagauucaagcagucggagcagccagaacuuucuuucacgguuacuguuccugaaaagaaaaagccaccuagcccuaucaagccaaagauuccccuuucugcaccucggaaaaauaccaacucagugaaauacagacucaaguuucgcuuuggauaa

SEQ ID NO: 1548 - RNA, 807 nt, Artificial Sequence
  derived and/or modified sequence opt1 from FGF5__Homo_sapiens__AAH74858
augagccuguccuuccuccugcugcuguucuucagccaccugauccuguccgccugggcccacggcgagaagcgccucgcgcccaaggggcagccgggccccgccgccaccgaccggaacccccgcgggagcuccagccggcaguccagcuccagcgccauguccagcuccagcgccuccagcucccccgcggccagccugggcucccaggggagcggccuggagcagagcuccuuccaguggagcccguccggccgccggaccgggagccucuacugccgcgugggcaucggguuccaccuccagaucuaccccgacggcaaggucaacgggucccacgaggccaacaugcugagcgugcucgagaucuucgccgugucccagggcaucgucggcauccgcgggguguucagcaacaaguuccuggcgauguccaagaagggcaagcugcacgccagcgccaaguucacggacgacugcaaguuccgggagcgguuccaggagaacuccuacaacaccuacgccagcgccauccaccgcaccgagaagaccgggcgggagugguacguggcgcucaacaagcgcggcaaggccaagcggggcugcagcccccgcgucaagccccagcacaucuccacgcacuuccugccgcgguucaagcaguccgagcagcccgagcugagcuucaccgugaccgugcccgagaagaagaagcccccgucccccaucaagcccaagaucccccucagcgccccgcgcaagaacaccaacuccgucaaguaccggcugaaguuccgcuucggguga

SEQ ID NO: 1549 - RNA, 807 nt, Artificial Sequence
  derived and/or modified sequence opt2 from FGF5__Homo_sapiens__AAH74858
augucccucuccuuccuccuccuccucuucuucucccaccucauccucuccgccugggcccacggcgagaagcgccucgcccccaagggccagcccggccccgccgccaccgaccgcaacccccgcggcuccuccucccgccaguccuccuccuccgccauguccuccuccuccgccuccuccucccccgccgccucccucggcucccagggcuccggccucgagcaguccuccuuccaguggucccccuccggccgccgcaccggcucccucuacugccgcgucggcaucggcuuccaccuccagaucuaccccgacggcaaggucaacggcucccacgaggccaacaugcucuccguccucgagaucuucgccgucucccagggcaucgucggcauccgcggcgucuucuccaacaaguuccucgccauguccaagaagggcaagcuccacgccuccgccaaguucaccgacgacugcaaguuccgcgagcgcuuccaggagaacuccuacaacaccuacgccuccgccauccaccgcaccgagaagaccggccgcgagugguacgucgcccucaacaagcgcggcaaggccaagcgcggcugcuccccccgcgucaagccccagcacaucuccacccacuuccucccccgcuucaagcaguccgagcagcccgagcucuccuucaccgucaccguccccgagaagaagaagccccccucccccaucaagcccaagaucccccucuccgccccccgcaagaacaccaacuccgucaaguaccgccucaaguuccgcuucggcuga

SEQ ID NO: 1550 - RNA, 807 nt, Artificial Sequence
  derived and/or modified sequence opt3 from FGF5__Homo_sapiens__AAH74858
augagccuguccuuccuccuucuguuguuuuucucucacuuaauccugucagccugggcucauggcgaaaagagacuagcacccaaagggcagccuggaccagccgcgaccgacaggaacccgcgggguaguagcucccgccaaucuucgucaagcgcuaugaguuccucuagcgccuccucaagucccgcagccagccucggcucucagggguccggacuggaacagagcucauuucaguggaguccuucuggccgacguacagguucccuuuacugcagaguggggauuggauuccaucugcaaauauauccagauggcaaggucaauggcagccacgaggcuaacauguugucgguucucgaaaucuuugcagugucucaggggauuguaggaaucagggguguguucuccaauaaauuucuggccaugucaaagaaaggcaagcugcacgcuagugccaaguucacugacgauuguaaauuucgggagcgcuuccaggaaaacagcuacaauacguaugcguccgcaauucauagaaccgagaagacagggagggagugguacgucgcccucaacaaacggggaaaggcuaaacgcggcugcucuccccgagugaagccucagcacaucagcacucacuuuuuaccaagauucaagcaaucagaacagcccgagcugaguuuuaccguuacagugccugagaaaaagaaaccaccgucccccauaaagccuaaaaucccacuuagcgcccccaggaagaauaccaacucugucaaauaucgguugaaguuccguuucgguuga

SEQ ID NO: 1551 - RNA, 807 nt, Artificial Sequence
  derived and/or modified sequence opt4 from FGF5__Homo_sapiens__AAH74858
augagccugagcuuccugcugcugcuguucuucagccaccugauccugagcgccugggcccacggcgagaagagacuggcccccaagggccagcccggccccgccgccaccgacagaaaccccagaggcagcagcagcagacagagcagcagcagcgccaugagcagcagcagcgccagcagcagccccgccgccagccugggcagccagggcagcggccuggagcagagcagcuuccaguggagccccagcggcagaagaaccggcagccuguacugcagagugggcaucggcuuccaccugcagaucuaccccgacggcaaggugaacggcagccacgaggccaacaugcugagcgugcuggagaucuucgccgugagccagggcaucgugggcaucagaggcguguucagcaacaaguuccuggccaugagcaagaagggcaagcugcacgccagcgccaaguucaccgacgacugcaaguucagagagagauuccaggagaacagcuacaacaccuacgccagcgccauccacagaaccgagaagaccggcagagagugguacguggcccugaacaagagaggcaaggccaagagaggcugcagccccagagugaagccccagcacaucagcacccacuuccugcccagauucaagcagagcgagcagcccgagcugagcuucaccgugaccgugcccgagaagaagaagccccccagccccaucaagcccaagaucccccugagcgcccccagaaagaacaccaacagcgugaaguacagacugaaguucagauucggcuga

SEQ ID NO: 1552 - RNA, 807 nt, Artificial Sequence
  derived and/or modified sequence opt5 from FGF5__Homo_sapiens__AAH74858
augagccuguccuuccuccugcuucuguuuuucucucaccucauccugagcgccugggcccauggcgaaaagagacuugcccccaaagggcagccuggaccggcggcuaccgaccggaacccccgcggcuccucuagcagacaauccucuagcuccgccauguccucuuccagcgccucuuccagcccugcugccucucuggggucccagggaagcggccucgaacaguccucuuuucaguggagccccuccgggcggcgcacaggaagccuguacugcagagugggcauuggcuuccaucugcaaaucuauccugaugggaaggucaauggaucucacgaggcuaacaugcucuccguucuggaaauuuuugccgugagccagggcaucguggggauucggggagucuucucuaauaaauuucuugcgaugagcaagaaaggcaagcugcacgccuccgcuaaguucacggacgauuguaaauuucgcgagagauuccaggaaaacucuuacaauaccuaugccagcgcuauccaucggacagagaagaccgggcgcgagugguacguggcccucaacaaaagaggaaaggcgaaacggggcugcagcccccgcguuaagccucagcacaucagcacacacuuucugccgagauucaagcaaucugaacagcccgagcuuuccuuuaccgugacagucccugagaaaaagaaacccccuagccccauuaagccgaaaaucccucugucugcuccccggaagaauaccaacuccgugaaauaucgccucaaguucagauucggcuga

SEQ ID NO: 1553 - protein, 38 aa, Artificial Sequence
  FGF5__Homo_sapiens__Q60518
MSTRCGEAGRARGTQPHRGYRAQNQPYKMHLGPPRLEE

SEQ ID NO: 1554 - RNA, 117 nt, Artificial Sequence
  FGF5__Homo_sapiens__AAB06462
auguccacccggugcggcgaggcgggcagagccagaggcacgcagccgcacaggggcuacagagcccagaaucagcccuacaagaugcacuuaggacccccgcggcuggaagaauga

SEQ ID NO: 1555 - RNA, 117 nt, Artificial Sequence
  derived and/or modified sequence opt1 from FGF5__Homo_sapiens__AAB06462
augagcacccgcugcggcgaggccgggcgggcccgcggcacccagccccaccggggguaccgcgcgcagaaccagcccuacaagaugcaccugggcccgccccggcucgaggaguga

SEQ ID NO: 1556 - RNA, 117 nt, Artificial Sequence
  derived and/or modified sequence opt2 from FGF5__Homo_sapiens__AAB06462
auguccacccgcugcggcgaggccggccgcgcccgcggcacccagccccaccgcggcuaccgcgcccagaaccagcccuacaagaugcaccucggccccccccgccucgaggaguga

SEQ ID NO: 1557 - RNA, 117 nt, Artificial Sequence
  derived and/or modified sequence opt3 from FGF5__Homo_sapiens__AAB06462
augagcaccagaugcggcgaggccgggagggcucggggaacacagccccaccgcgguuaccgagcacaaaaccagccuuauaagaugcaucugggcccaccgcgucucgaagaguga

SEQ ID NO: 1558 - RNA, 117 nt, Artificial Sequence
  derived and/or modified sequence opt4 from FGF5__Homo_sapiens__AAB06462
augagcaccagaugcggcgaggccggcagagccagaggcacccagccccacagaggcuacagagcccagaaccagcccuacaagaugcaccugggcccccccagacuggaggaguga

SEQ ID NO: 1559 - RNA, 117 nt, Artificial Sequence
  derived and/or modified sequence opt5 from FGF5__Homo_sapiens__AAB06462
augagcaccagaugcggcgaggccgggcgggcucgcggaacacagccccacagaggcuaccgggcccaaaaccagccuuauaagaugcaucuggggccgccccgccucgaagaguga

SEQ ID NO: 1560 - protein, 821 aa, Artificial Sequence
  FGFR2__Homo_sapiens__P21802
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 1561 - RNA, 2466 nt, Artificial Sequence
  FGFR2__Homo_sapiens__AAA59470
auggucagcuggggucguuucaucugccuggucguggucaccauggcaaccuugucccuggcccggcccuccuucaguuuaguugaggauaccacauuagagccagaagagccaccaaccaaauaccaaaucucucaaccagaaguguacguggcugcgccaggggagucgcuagaggugcgcugccuguugaaagaugccgccgugaucaguuggacuaaggauggggugcacuuggggcccaacaauaggacagugcuuauuggggaguacuugcagauaaagggcgccacgccuagagacuccggccucuaugcuuguacugccaguaggacuguagacagugaaacuugguacuucauggugaaugucacagaugccaucucauccggagaugaugaggaugacaccgauggugcggaagauuuugucagugagaacaguaacaacaagagagcaccauacuggaccaacacagaaaagauggaaaagcggcuccaugcugugccugcggccaacacugucaaguuucgcugcccagccggggggaacccaaugccaaccaugcgguggcugaaaaacgggaaggaguuuaagcaggagcaucgcauuggaggcuacaagguacgaaaccagcacuggagccucauuauggaaaguguggucccaucugacaagggaaauuauaccugugugguggagaaugaauacggguccaucaaucacacguaccaccuggauguuguggagcgaucgccucaccggcccauccuccaagccggacugccggcaaaugccuccacaguggucggaggagacguagaguuugucugcaagguuuacagugaugcccagccccacauccaguggaucaagcacguggaaaagaacggcaguaaauacgggcccgacgggcugcccuaccucaagguucucaaggccgccgguguuaacaccacggacaaagagauugagguucucuauauucggaauguaacuuuugaggacgcuggggaauauacgugcuuggcggguaauucuauugggauauccuuucacucugcaugguugacaguucugccagcgccuggaagagaaaaggagauuacagcuuccccagacuaccuggagauagccauuuacugcauaggggucuucuuaaucgccuguauggugguaacagucauccugugccgaaugaagaacacgaccaagaagccagacuucagcagccagccggcugugcacaagcugaccaaacguaucccccugcggagacagguaacaguuucggcugaguccagcuccuccaugaacuccaacaccccgcuggugaggauaacaacacgccucucuucaacggcagacacccccaugcuggcaggggucuccgaguaugaacuuccagaggacccaaaaugggaguuuccaagagauaagcugacacugggcaagccccugggagaagguugcuuugggcaaguggucauggcggaagcagugggaauugacaaagacaagcccaaggaggcggucaccguggccgugaagauguugaaagaugaugccacagagaaagaccuuucugaucuggugucagagauggagaugaugaagaugauugggaaacacaagaauaucauaaaucuucuuggagccugcacacaggaugggccucucuaugucauaguugaguaugccucuaaaggcaaccuccgagaauaccuccgagcccggaggccacccgggauggaguacuccuaugacauuaaccguguuccugaggagcagaugaccuucaaggacuuggugucaugcaccuaccagcuggccagaggcauggaguacuuggcuucccaaaaauguauucaucgagauuuagcagccagaaauguuuugguaacagaaaacaaugugaugaaaauagcagacuuuggacucgccagagauaucaacaauauagacuauuacaaaaagaccaccaaugggcggcuuccagucaaguggauggcuccagaagcccuguuugauagaguauacacucaucagagugaugucugguccuucgggguguuaaugugggagaucuucacuuuagggggcucgcccuacccagggauucccguggaggaacuuuuuaagcugcugaaggaaggacacagaauggauaagccagccaacugcaccaacgaacuguacaugaugaugagggacuguuggcaugcagugcccucccagagaccaacguucaagcaguugguagaagacuuggaucgaauucucacucucacaaccaaugaggaauacuuggaccucagccaaccucucgaacaguauucaccuaguuacccugacacaagaaguucuuguucuucaggagaugauucuguuuuuucuccagaccccaugccuuacgaaccaugccuuccucaguauccacacauaaacggcaguguuaaaacauga

SEQ ID NO: 1562 - RNA, 2466 nt, Artificial Sequence
  derived and/or modified sequence opt1 from FGFR2__Homo_sapiens__AAA59470
auggugagcuggggccgcuucaucugccuggucguggugaccauggccacccucucccuggcccggcccagcuucucccuggucgaggacacgacccucgagccggaggagccgcccaccaaguaccagaucagccagcccgagguguacguggcggcccccggggagucccuggagguccgcugccugcucaaggacgccgccgugaucagcuggaccaaggacggcgugcaccuggggcccaacaaccggacgguccugaucggcgaguaccuccagaucaagggggccacgccccgcgacuccggccuguacgcgugcaccgccagccggaccguggacuccgagaccugguacuucauggugaacgucaccgacgccaucagcuccggcgacgacgaggacgacaccgacggggccgaggacuucgugagcgagaacuccaacaacaagcgcgcgcccuacuggaccaacacggagaagauggagaagcggcugcacgccgugccggccgccaacaccgucaaguuccgcugccccgccggcgggaaccccaugcccaccaugcgguggcucaagaacggcaaggaguucaagcaggagcaccgcaucgggggcuacaaggugcggaaccagcacuggagccugaucauggaguccguggucccgagcgacaagggcaacuacacgugcgugguggagaacgaguacggguccaucaaccacaccuaccaccuggacgucguggagcgcagcccccaccggcccauccuccaggcgggccugcccgccaacgccuccaccguggucgggggcgacguggaguucgucugcaagguguacagcgacgcccagccgcacauccaguggaucaagcacguggagaagaacggcagcaaguacgggcccgacggccugcccuaccucaagguccugaaggccgcgggggugaacaccaccgacaaggagaucgaggugcuguacauccgcaacgucacguucgaggacgccggcgaguacacgugccucgccgggaacuccaucggcaucagcuuccacuccgccuggcugaccgugcugcccgccccgggccgggagaaggagaucaccgcgagccccgacuaccucgagaucgccaucuacugcaucgggguguuccugaucgccugcauggucgugaccgugauccugugccgcaugaagaacaccaccaagaagcccgacuucuccagccagcccgccguccacaagcucaccaagcggaucccgcugcgccgccaggugacgguguccgccgagagcuccagcuccaugaacagcaacacgccccugguccggaucaccacccggcucuccagcaccgcggacacccccaugcuggccggcguguccgaguacgagcugcccgaggacccgaagugggaguucccccgcgacaagcucacccuggggaagccccugggcgaggggugcuucggccagguggucauggccgaggccgugggcaucgacaaggacaagccgaaggaggcggugaccgucgccgugaagaugcucaaggacgacgccacggagaaggaccugagcgaccugguguccgagauggagaugaugaagaugaucgggaagcacaagaacaucaucaaccuccugggcgccugcacccaggacgggccccuguacgucaucguggaguacgccagcaagggcaaccuccgcgaguaccugcgggcgcgccggccgcccgggauggaguacuccuacgacaucaaccgcgugcccgaggagcagaugaccuucaaggaccuggucagcugcaccuaccagcucgcccggggcauggaguaccuggccagccagaagugcauccaccgcgaccuggccgcccggaacgugcucgugaccgagaacaacgucaugaagaucgcggacuucggccuggcccgcgacaucaacaacaucgacuacuacaagaagacgaccaacgggcggcugcccgugaaguggauggcccccgaggcccuguucgaccgcguguacacccaccaguccgacgucuggagcuucggcgugcucaugugggagaucuucacccucgggggcucccccuacccgggcauccccguggaggagcuguucaagcugcugaaggaggggcaccggauggacaagcccgccaacugcacgaacgagcuguacaugaugaugcgcgacugcuggcacgcgguccccagccagcggccgaccuucaagcagcucguggaggaccuggaccgcauccugacccucaccacgaacgaggaguaccuggaccugucccagccccucgagcaguacagccccuccuaccccgacacccggagcuccugcagcuccggcgacgacagcguguucuccccggaccccaugcccuacgagcccugccugccgcaguacccccacaucaacgggagcgucaagaccuga

SEQ ID NO: 1563 - RNA, 2466 nt, Artificial Sequence
  derived and/or modified sequence opt2 from FGFR2__Homo_sapiens__AAA59470
auggucuccuggggccgcuucaucugccucgucgucgucaccauggccacccucucccucgcccgccccuccuucucccucgucgaggacaccacccucgagcccgaggagccccccaccaaguaccagaucucccagcccgaggucuacgucgccgcccccggcgagucccucgagguccgcugccuccucaaggacgccgccgucaucuccuggaccaaggacggcguccaccucggccccaacaaccgcaccguccucaucggcgaguaccuccagaucaagggcgccaccccccgcgacuccggccucuacgccugcaccgccucccgcaccgucgacuccgagaccugguacuucauggucaacgucaccgacgccaucuccuccggcgacgacgaggacgacaccgacggcgccgaggacuucgucuccgagaacuccaacaacaagcgcgcccccuacuggaccaacaccgagaagauggagaagcgccuccacgccguccccgccgccaacaccgucaaguuccgcugccccgccggcggcaaccccaugcccaccaugcgcuggcucaagaacggcaaggaguucaagcaggagcaccgcaucggcggcuacaagguccgcaaccagcacuggucccucaucauggaguccgucguccccuccgacaagggcaacuacaccugcgucgucgagaacgaguacggcuccaucaaccacaccuaccaccucgacgucgucgagcgcuccccccaccgccccauccuccaggccggccuccccgccaacgccuccaccgucgucggcggcgacgucgaguucgucugcaaggucuacuccgacgcccagccccacauccaguggaucaagcacgucgagaagaacggcuccaaguacggccccgacggccuccccuaccucaagguccucaaggccgccggcgucaacaccaccgacaaggagaucgagguccucuacauccgcaacgucaccuucgaggacgccggcgaguacaccugccucgccggcaacuccaucggcaucuccuuccacuccgccuggcucaccguccuccccgcccccggccgcgagaaggagaucaccgccucccccgacuaccucgagaucgccaucuacugcaucggcgucuuccucaucgccugcauggucgucaccgucauccucugccgcaugaagaacaccaccaagaagcccgacuucuccucccagcccgccguccacaagcucaccaagcgcaucccccuccgccgccaggucaccgucuccgccgaguccuccuccuccaugaacuccaacaccccccucguccgcaucaccacccgccucuccuccaccgccgacacccccaugcucgccggcgucuccgaguacgagcuccccgaggaccccaagugggaguucccccgcgacaagcucacccucggcaagccccucggcgagggcugcuucggccaggucgucauggccgaggccgucggcaucgacaaggacaagcccaaggaggccgucaccgucgccgucaagaugcucaaggacgacgccaccgagaaggaccucuccgaccucgucuccgagauggagaugaugaagaugaucggcaagcacaagaacaucaucaaccuccucggcgccugcacccaggacggcccccucuacgucaucgucgaguacgccuccaagggcaaccuccgcgaguaccuccgcgcccgccgcccccccggcauggaguacuccuacgacaucaaccgcguccccgaggagcagaugaccuucaaggaccucgucuccugcaccuaccagcucgcccgcggcauggaguaccucgccucccagaagugcauccaccgcgaccucgccgcccgcaacguccucgucaccgagaacaacgucaugaagaucgccgacuucggccucgcccgcgacaucaacaacaucgacuacuacaagaagaccaccaacggccgccuccccgucaaguggauggcccccgaggcccucuucgaccgcgucuacacccaccaguccgacgucugguccuucggcguccucaugugggagaucuucacccucggcggcucccccuaccccggcauccccgucgaggagcucuucaagcuccucaaggagggccaccgcauggacaagcccgccaacugcaccaacgagcucuacaugaugaugcgcgacugcuggcacgccguccccucccagcgccccaccuucaagcagcucgucgaggaccucgaccgcauccucacccucaccaccaacgaggaguaccucgaccucucccagccccucgagcaguacucccccuccuaccccgacacccgcuccuccugcuccuccggcgacgacuccgucuucucccccgaccccaugcccuacgagcccugccucccccaguacccccacaucaacggcuccgucaagaccuga

SEQ ID NO: 1564 - RNA, 2466 nt, Artificial Sequence
  derived and/or modified sequence opt3 from FGFR2__Homo_sapiens__AAA59470
auggugagcuggggcagauucaucugccuggucguugugaccauggccacacucucccuugcuaggcccucuuuuucacugguagaggacacuacguuggaaccugaggaaccaccgaccaaguaccagauuagucaacccgagguguaugucgcagccccuggggaauccuuagaggugcggugucugcuaaaagaugcggcuguuauauccuggacaaaggacggagugcaccucgguccaaacaaucgcacuguccugaucggcgaguaccuucagauuaaaggggccacaccccgagauucuggacuguaugcaugcaccgccucgcguaccguggacucagaaacuugguacuucaugguaaacguuacagaugcuaucagcaguggcgacgaugaggacgauaccgacggugcagaagauuuuguguccgaaaauucuaacaauaagagagccccuuauuggacgaacacugagaaaauggaaaagagguugcaugcugucccagccgcgaauaccgugaaguuccggugucccgcagggggaaacccuaugccaacaaugcgcuggcucaaaaauggcaaggaguuuaaacaggaacacagaauuggcggguacaaggugaggaaccagcauuggagccugaucauggaguccgucguuccgucagacaaaggaaauuauacuugcgugguagaaaacgaguacgguaguauaaaucacaccuaccaucuggauguggucgagcggagcccccaccgcccuauccuccaagccggcuuaccagcuaacgccucuacagugguugggggagacguggaguucgucuguaagguguauuccgacgcacagccccacauucaguggaucaagcauguagagaaaaauggcucaaaguacgguccugaugggcugccauaucuuaaaguuuugaaggcugccggagugaacaccacggacaaagaaauugagguccuguacauccgaaacgugacuuuugaagaugcgggcgaguauacaugccuagccggcaauagcauagggauuaguuuccacucugcauggcucaccguccugcccgcuccgggaagagagaaggaaaucacugccuccccugacuaccuugagauugcuaucuauuguaucgguguguuucugauugccugcaugguugugacaguaauauuguguaggaugaaaaacaccacgaagaagcccgauuucagcucgcagccagcaguccauaaacucaccaagcggaucccucugcgucgccaagugacaguuucugccgaauccucaaguagcaugaauagcaacacucccuuagugagaauuaccacaaggcugucuagcacugcugacaccccaaugcucgcgggcgucucagaguacgaacuucccgaggauccuaaaugggaguuuccacgggacaagcugacauuggggaaaccgcuaggagaaggcugcuucggucaggugguaauggcagaggccguggggaucgauaaggacaagcccaaagaagcuguuaccgucgccgugaagaugcugaaagaugacgcaacugagaaggaccucagugaucugguguccgagauggaaaugaugaaaaugauaggcaagcacaagaauauuaucaaccuucugggagccuguacgcaggacggcccuuuguacgucaucguugaguaugcuagcaaagggaaucuccgagaauaccugcgcgccagaaggccacccggaauggaguauucuuacgauauuaaccgggugccugaggaacagaugacauuuaaggacuuagugucaugcaccuaucaacuggcacgcgguauggaguaccuagcgagucagaaaugcauccacagagaucucgcugccaggaauguacuggucacugaaaacaaugugaugaagauugcagacuucggccuugcccgugauauaaacaauaucgacuauuacaaaaagaccacaaacgggcgguugccaguuaaguggauggcucccgaggcccuguucgaucgaguguacacccaucagagcgacgucugguccuuuggagugcucaugugggaaauuuucacucugggcgguucuccguauccugggaucccaguugaggaacuuuuuaaacuguugaaggagggccacagaauggauaaacccgcaaauuguacaaacgagcucuacaugaugaugagggacugcuggcaugcugugccuucgcaacgccccacguucaagcagcugguagaagauuuagaccggauccugacccuaacuacaaacgaggaauaucucgaccugagccagccacuugagcaguacuccccuucauaucccgauaccagaaguucuuguagcuccggagacgauucagucuuuagcccagacccgaugccuuacgaacccugcuugccacaauauccccacauuaauggcucugugaaaacauga

SEQ ID NO: 1565 - RNA, 2466 nt, Artificial Sequence
  derived and/or modified sequence opt4 from FGFR2__Homo_sapiens__AAA59470
auggugagcuggggcagauucaucugccuggugguggugaccauggccacccugagccuggccagacccagcuucagccugguggaggacaccacccuggagcccgaggagccccccaccaaguaccagaucagccagcccgagguguacguggccgcccccggcgagagccuggaggugagaugccugcugaaggacgccgccgugaucagcuggaccaaggacggcgugcaccugggccccaacaacagaaccgugcugaucggcgaguaccugcagaucaagggcgccacccccagagacagcggccuguacgccugcaccgccagcagaaccguggacagcgagaccugguacuucauggugaacgugaccgacgccaucagcagcggcgacgacgaggacgacaccgacggcgccgaggacuucgugagcgagaacagcaacaacaagagagcccccuacuggaccaacaccgagaagauggagaagagacugcacgccgugcccgccgccaacaccgugaaguucagaugccccgccggcggcaaccccaugcccaccaugagauggcugaagaacggcaaggaguucaagcaggagcacagaaucggcggcuacaaggugagaaaccagcacuggagccugaucauggagagcguggugcccagcgacaagggcaacuacaccugcgugguggagaacgaguacggcagcaucaaccacaccuaccaccuggacgugguggagagaagcccccacagacccauccugcaggccggccugcccgccaacgccagcaccguggugggcggcgacguggaguucgugugcaagguguacagcgacgcccagccccacauccaguggaucaagcacguggagaagaacggcagcaaguacggccccgacggccugcccuaccugaaggugcugaaggccgccggcgugaacaccaccgacaaggagaucgaggugcuguacaucagaaacgugaccuucgaggacgccggcgaguacaccugccuggccggcaacagcaucggcaucagcuuccacagcgccuggcugaccgugcugcccgcccccggcagagagaaggagaucaccgccagccccgacuaccuggagaucgccaucuacugcaucggcguguuccugaucgccugcaugguggugaccgugauccugugcagaaugaagaacaccaccaagaagcccgacuucagcagccagcccgccgugcacaagcugaccaagagaaucccccugagaagacaggugaccgugagcgccgagagcagcagcagcaugaacagcaacaccccccuggugagaaucaccaccagacugagcagcaccgccgacacccccaugcuggccggcgugagcgaguacgagcugcccgaggaccccaagugggaguuccccagagacaagcugacccugggcaagccccugggcgagggcugcuucggccagguggugauggccgaggccgugggcaucgacaaggacaagcccaaggaggccgugaccguggccgugaagaugcugaaggacgacgccaccgagaaggaccugagcgaccuggugagcgagauggagaugaugaagaugaucggcaagcacaagaacaucaucaaccugcugggcgccugcacccaggacggcccccuguacgugaucguggaguacgccagcaagggcaaccugagagaguaccugagagccagaagaccccccggcauggaguacagcuacgacaucaacagagugcccgaggagcagaugaccuucaaggaccuggugagcugcaccuaccagcuggccagaggcauggaguaccuggccagccagaagugcauccacagagaccuggccgccagaaacgugcuggugaccgagaacaacgugaugaagaucgccgacuucggccuggccagagacaucaacaacaucgacuacuacaagaagaccaccaacggcagacugcccgugaaguggauggcccccgaggcccuguucgacagaguguacacccaccagagcgacguguggagcuucggcgugcugaugugggagaucuucacccugggcggcagccccuaccccggcauccccguggaggagcuguucaagcugcugaaggagggccacagaauggacaagcccgccaacugcaccaacgagcuguacaugaugaugagagacugcuggcacgccgugcccagccagagacccaccuucaagcagcugguggaggaccuggacagaauccugacccugaccaccaacgaggaguaccuggaccugagccagccccuggagcaguacagccccagcuaccccgacaccagaagcagcugcagcagcggcgacgacagcguguucagccccgaccccaugcccuacgagcccugccugccccaguacccccacaucaacggcagcgugaagaccuga

SEQ ID NO: 1566 - RNA, 2466 nt, Artificial Sequence
  derived and/or modified sequence opt5 from FGFR2__Homo_sapiens__AAA59470
auggugagcuggggcagauucaucugccuggucguugugaccauggccacacucucccuggcucggcccucuuuuagccuuguggaggacacgacccuggaaccugaggaaccgcccacaaaguaccagauuucccaaccugaggucuauguggccgcgcccggggaaucucucgagguucgcugucugcuuaaagaugcugccgugaucagcuggaccaaggacggaguccaccugggcccuaacaauagaacagugcucauuggggaguaccugcagaucaaaggagccacaccccgggauuccggccuguaugcuugcaccgccucucgcaccguugacagcgaaacgugguacuucauggugaacgucaccgaugcuauuuccagcggggacgaugaggacgauacagacggagccgaagauuuugugucugaaaauuccaacaauaagagagcgccuuauuggaccaacacagagaaaauggaaaagcggcuccaugccgugccggcugccaauaccgucaaguuccgcugucccgcuggcggcaacccuaugcccacgaugagauggcugaaaaaugggaaggaguuuaaacaggaacaccggaucggaggcuacaagguucgcaaccagcauuggagccuuaucauggagucuguggugccuuccgacaaagggaauuauacaugcgucguggaaaacgaguacggaagcauuaaucacaccuaccaucuggauguuguggagagaucuccccaccggccgauccuccaagccggccugccugcgaacgccuccacagucguugggggagacguggaguucguguguaaggucuauagcgacgcucagccccacauucaguggaucaagcauguggagaaaaauggcuccaaguacggcccugaugggcuucccuaucugaaaguccucaaggccgcuggagugaacaccaccgacaaagaaauugagguucuguacauccgcaacgugacauuugaagaugccggcgaguauacgugccuggccggaaauucuauuggaaucagcuuccacuccgcuuggcucaccguccugcccgcgccuggcagagagaaggaaaucacagccagcccggacuaccuugagauugcuaucuauuguauugggguguuucugaucgccugcaugguugugaccgucauucucugucggaugaaaaacacaaccaagaagcccgauuucucuucccagccugccgugcauaaacugacgaagcgcaucccccuuagacggcaagugacaguuagcgcugaaucuagcuccucuaugaauagcaacaccccucuggucagaaucaccacacgccucuccagcaccgccgacacacccaugcuggcgggagugucugaguacgaacugccggaggauccuaaaugggaguuuccccgggacaagcucacgcugggcaaaccucuuggcgaagggugcuucggacagguggucauggcugaggccgugggcauugauaaggacaagcccaaagaagccguuaccguggcugucaagaugcugaaagaugacgccacagagaaggaccucuccgaucuggugagcgagauggaaaugaugaaaaugaucgggaagcacaagaauauuaucaaccuucugggagcuuguacccaggacggcccucucuacguuauuguggaguaugccucuaaagggaaucugagagaauaccugcgcgcgcggagacccccgggcauggaguauuccuacgauaucaaccgcgucccugaggaacagaugacauuuaaggaccucgugagcugcaccuaucaacuggcccggggaauggaguaccuugcuucccagaaaugcauccacagagaucuggccgcucgcaauguucucgugacggaaaacaaugucaugaagauugccgacuucggccuggcgcgggauaucaacaauauugacuauuacaaaaagaccacaaacgggagacugcccgugaaguggauggcccccgaggcucuuuucgaucgcguguacacccaucagucugacgucuggagcuuuggaguucucaugugggaaaucuucacacugggcggguccccuuauccggggauucccguggaggaacuguuuaaacuccugaaggagggccaccggauggauaaaccugccaauuguaccaacgagcuuuacaugaugaugagagacugcuggcaugcugugcccucucaacggccuacguucaagcagcuggucgaagaucucgaccgcauccugacacugaccacaaacgaggaauaucuugaccucagccagccccuggagcaguacuccccuagcuaucccgauaccagaucuuccuguagcucuggggacgauuccguguuuagcccggacccuaugcccuacgaaccuugccugccccaauauccgcacauuaauggcucuguuaaaaccuga

SEQ ID NO: 1567 - protein, 635 aa, Artificial Sequence
  fibronectin__Homo_sapiens__A0A024R5I6
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 1568 - RNA, 1908 nt, Artificial Sequence
  fibronectin__Homo_sapiens__EAW74574
auggccccgccgcuccugcugcugcugcuggccaguggagcggccgccugcccgcugcccugcgucugccagaaccuguccgagucgcucagcacccucugugcccaccgaggccugcuguuugugccgcccaacguggaccggcgcacaguggagcugcggcuggcugacaacuucauccaggcccuggggcccccugacuuccgcaacaugacgggacugguggaccugacacugucucgcaaugccaucacccgcauuggggcccgcgccuuuggggaccucgagagccugcguucccuccaccuugacggcaacaggcugguggagcugggcaccgggagccuccggggccccgucaaucugcagcaccucauccucagcggcaaccagcugggccgcaucgcgccgggagccuucgacgacuuccuagagagccuggaggaccuggaccuguccuacaacaaccuccggcaggugcccugggccggcaucggcgccaugccugcccugcacacccucaaccuggaccauaaccuuauugacgcacugcccccaggcgccuucgcccagcucggucagcucucccgccuggaccucaccuccaaccgccuggccacgcuggcuccggacccgcuuuucucucgugggcgugaugcagaggccucucccgccccccuggugcugagcuuuagcgggaacccccugcacugcaacugugagcugcuguggcugcggcggcuggcgcggccggacgaccuggaaacgugcgccuccccgcccggccuggccggccgcuacuucugggcagugcccgagggcgaguucuccugugagccgccccucauugcccgccacacgcagcgccucugggugcuggaaggccagcgggccacgcugcggugccgggcccugggugaccccgcgccuaccaugcacugggucgguccugacgaccgguugguuggcaacuccucccgagcccgggcuuuccccaacgggaccuuagagauuggggugaccggcgcuggggacgcugggggcuacaccugcaucgccaccaacccugcuggugaggccacagcccgaguagaacugcgggugcuggccuugccccauggugggaacagcagugccgaggggggccgccccgggcccucggacaucgccgccuccgcucgcacugcugccgagggugaggggacgcuggagucugagccagccgugcaggugacggaggugaccgccaccucagggcuggugagcuggggucccgggcggccagccgacccaguguggauguuccaaauccaguacaacagcagcgaagaugagacccucaucuaccggauugucccagccuccagccaccacuuccugcugaagcaccucguccccggcgcugacuaugaccucugccugcuggccuugucaccggccgcugggcccucugaccucacggccaccaggcugcugggcugugcccauuucuccacgcugccggccucgccccugugccacgcccugcaggcccacgugcugggcgggacccugaccguggccguggggggugugcugguggcugccuuacuggucuucacuguggccuugcugguucggggccggggggccggaaauggccgccucccccucaagcucagccacguccagucccagaccaauggaggccccagccccacacccaaggcccacccgccgcggagccccccgccccggccgcagcgcagcugcucucuggaccugggagaugccgggugcuacgguuaugccaggcgccugggaggagcuugggcccgacggagccacucugugcauggggggcugcucggggcagggugccgggggguaggaggcagcgccgagcggcuggaagagagugugguguga

SEQ ID NO: 1569 - RNA, 1908 nt, Artificial Sequence
  derived and/or modified sequence opt1 from fibronectin__Homo_sapiens__EAW74574
auggccccgccccugcuccugcugcuccuggccagcggcgcggccgccugcccccugcccugcgugugccagaaccucuccgagagccuguccacccugugcgcccaccgcgggcuccuguucgugcccccgaacgucgaccggcgcaccguggagcugcggcucgccgacaacuucauccaggcgcugggcccgcccgacuuccgcaacaugacggggcuggucgaccucacccugagccggaacgccaucacccgcaucggcgcccgggccuucggggaccuggagucccuccgcagccugcaccuggacggcaaccggcucguggagcugggcaccgggucccugcgcggccccgugaaccuccagcaccugauccugagcgggaaccagcucggccggaucgcgcccggggccuucgacgacuuccuggagucccuggaggaccucgaccugagcuacaacaaccugcgccagguccccugggccggcaucggcgccaugcccgcccuccacacgcugaaccuggaccacaaccucaucgacgcgcugcccccgggggccuucgcccagcugggccagcucucccggcuggaccugaccagcaaccgccucgccacccuggcccccgacccccuguucucccgggggcgcgacgcggaggccagccccgccccgcucgugcuguccuucagcggcaacccccugcacugcaacugcgagcuccuguggcugcggcgccuggcccggcccgacgaccucgagaccugcgccuccccgcccggccuggcggggcgcuacuucugggccgugcccgagggcgaguucagcugcgagccgccccugaucgcccggcacacgcagcgccucuggguccuggaggggcagcgcgccacccugcggugccgcgcccucggcgaccccgcgcccaccaugcacuggguggggcccgacgaccggcuggugggcaacuccagccgcgcccgggccuuccccaacggcacccuggagaucggggucacgggcgccggggacgcgggcggguacacgugcaucgccaccaaccccgccggcgaggccaccgcccgcguggagcuccgggugcuggcgcugccccacggcgggaacagcuccgccgagggcgggcgccccggcccgagcgacaucgccgccuccgcccggaccgcggccgagggggagggcacccucgagagcgagcccgccguccaggugaccgaggugaccgccacguccggccuggucagcugggggcccggccgccccgccgacccgguguggauguuccagauccaguacaacuccagcgaggacgagacccugaucuaccggaucgugcccgcguccagccaccacuuccuccugaagcaccugguccccggggccgacuacgaccucugccugcuggcccucucccccgccgcgggcccgagcgaccugaccgccacccgccugcucggcugcgcccacuucuccacgcugcccgccagcccccugugccacgcccuccaggcgcacgugcucgggggcacccugaccguggccgucgggggcgugcuggucgccgcccugcugguguucaccguggcccuccugguccgggggcgcggcgcgggcaacgggcggcugccccucaagcugucccacgugcagagccagacgaacggcgggccgucccccacccccaaggcccacccgccccgcagcccgccgccccggccccagcgcuccugcagccuggaccucggcgacgccgggugcuacggcuacgcccggcgccugggcggggccugggcgcgccggagccacuccgugcacggcgggcugcucggcgccgggugccgcggcgucggcgggagcgccgagcggcuggaggaguccgugguguga

SEQ ID NO: 1570 - RNA, 1908 nt, Artificial Sequence
  derived and/or modified sequence opt2 from fibronectin__Homo_sapiens__EAW74574
auggcccccccccuccuccuccuccuccucgccuccggcgccgccgccugcccccuccccugcgucugccagaaccucuccgagucccucuccacccucugcgcccaccgcggccuccucuucgucccccccaacgucgaccgccgcaccgucgagcuccgccucgccgacaacuucauccaggcccucggcccccccgacuuccgcaacaugaccggccucgucgaccucacccucucccgcaacgccaucacccgcaucggcgcccgcgccuucggcgaccucgagucccuccgcucccuccaccucgacggcaaccgccucgucgagcucggcaccggcucccuccgcggccccgucaaccuccagcaccucauccucuccggcaaccagcucggccgcaucgcccccggcgccuucgacgacuuccucgagucccucgaggaccucgaccucuccuacaacaaccuccgccagguccccugggccggcaucggcgccaugcccgcccuccacacccucaaccucgaccacaaccucaucgacgcccucccccccggcgccuucgcccagcucggccagcucucccgccucgaccucaccuccaaccgccucgccacccucgcccccgacccccucuucucccgcggccgcgacgccgaggccucccccgccccccucguccucuccuucuccggcaacccccuccacugcaacugcgagcuccucuggcuccgccgccucgcccgccccgacgaccucgagaccugcgccuccccccccggccucgccggccgcuacuucugggccguccccgagggcgaguucuccugcgagcccccccucaucgcccgccacacccagcgccucuggguccucgagggccagcgcgccacccuccgcugccgcgcccucggcgaccccgcccccaccaugcacugggucggccccgacgaccgccucgucggcaacuccucccgcgcccgcgccuuccccaacggcacccucgagaucggcgucaccggcgccggcgacgccggcggcuacaccugcaucgccaccaaccccgccggcgaggccaccgcccgcgucgagcuccgcguccucgcccucccccacggcggcaacuccuccgccgagggcggccgccccggccccuccgacaucgccgccuccgcccgcaccgccgccgagggcgagggcacccucgaguccgagcccgccguccaggucaccgaggucaccgccaccuccggccucgucuccuggggccccggccgccccgccgaccccgucuggauguuccagauccaguacaacuccuccgaggacgagacccucaucuaccgcaucguccccgccuccucccaccacuuccuccucaagcaccucguccccggcgccgacuacgaccucugccuccucgcccucucccccgccgccggccccuccgaccucaccgccacccgccuccucggcugcgcccacuucuccacccuccccgccuccccccucugccacgcccuccaggcccacguccucggcggcacccucaccgucgccgucggcggcguccucgucgccgcccuccucgucuucaccgucgcccuccucguccgcggccgcggcgccggcaacggccgccucccccucaagcucucccacguccagucccagaccaacggcggccccucccccacccccaaggcccaccccccccgcuccccccccccccgcccccagcgcuccugcucccucgaccucggcgacgccggcugcuacggcuacgcccgccgccucggcggcgccugggcccgccgcucccacuccguccacggcggccuccucggcgccggcugccgcggcgucggcggcuccgccgagcgccucgaggaguccgucgucuga

SEQ ID NO: 1571 - RNA, 1908 nt, Artificial Sequence
  derived and/or modified sequence opt3 from fibronectin__Homo_sapiens__EAW74574
auggcacccccucugcuccuucuguuguuagcuagcggcgcagccgcgugcccacugccgugugugugccagaaccuauccgagucucucucaacccugugugcucacagagggcuucuguucguucccccuaaugucgacaggcggacaguggaauugcgccucgccgauaacuuuauccaagcacugggaccacccgacuuccgaaauaugacuggucugguagaucucacguuaagucguaacgccauuaccagaauaggcgcuagggcauuuggggaccuggagagccuucgguccuugcaucuggauggaaaucgccuaguggaacucggcacagguucucugagagggccugucaaccuucagcaccugaucuugucgggaaaucagcucggcaggauugccccaggcgcuuucgacgauuuucuggagucauuagaagaccuggaucucagcuacaacaaucuucgccaggugcccugggccgggaucggagcgaugccugcacugcauacuuugaaccuagaccacaaucugauugaugcccucccaccgggugcuuucgcccaacugggccagcuuagucggcuggacuugaccuccaaccgacucgcaacacuggcucccgauccuuuauuuucuagagggagggacgccgaggcgagcccagcaccccugguucuauccuucucaggaaauccucuccauugcaacugugagcugcuuugguugcggcgucuggcccgcccagacgaucucgaaaccugcgcuagucccccgggccuggccgguagauauuuuugggcugugccugagggggaguucagcugugaacccccacuuaucgccaggcacacucagcggcugugggucuuggagggacagcgagcaacacuccgcugcagagcccugggcgacccugcucccaccaugcacugggugggcccagaugacagguuaguaggaaauucuucccgggcgcgcgcauuucccaacgggacgcuggaaauagguguuacuggcgccggggaugcuggaggcuacaccuguaucgccacaaacccugccggugaggccacugcuagaguggaacuaaggguccucgcccugccacaugggggcaauucaagcgcagagggaggccguccggggcccagugacauugcggcuucugcccggaccgcagccgaaggagaggguacacuugaguccgaaccugcugugcaagugaccgaggucacggccacuagcggcuugguuucgugggggccaggacgacccgcagauccuguguggauguuccagauccaguauaacucuuccgaagacgagacacugauuuacagaaucguaccagcuucaagucaccauuuucuccugaagcacuuagugcccggcgccgauuaugaccugugccuuuuggcgcucagcccggccgcugguccuuccgaucugaccgcaacuaggcuacuggggugugcccacuucucuacacucccagcuagcccccugugccaugcccuucaggcacacgucuugggcggaacccugacgguggcgguuggcgggguguuagucgccgcucuccugguguucaccguagcccuucugguucgcggacggggugcaggcaaugggagauugccucucaaacugucacaugugcaaagucagacaaacggaggccccuccccaacuccuaaggcucaucccccaaggagcccgccuccccgcccacagcgaucuugcucacuagaccugggugacgccggguguuacggcuaugcacggcgucucggaggcgccugggcuagaaggagucacagcguccacgggggacugcuuggcgcggguugccgcggggugggaggcuccgccgaacgguuggaggagucugucguguga

SEQ ID NO: 1572 - RNA, 1908 nt, Artificial Sequence
  derived and/or modified sequence opt4 from fibronectin__Homo_sapiens__EAW74574
auggcccccccccugcugcugcugcugcuggccagcggcgccgccgccugcccccugcccugcgugugccagaaccugagcgagagccugagcacccugugcgcccacagaggccugcuguucgugccccccaacguggacagaagaaccguggagcugagacuggccgacaacuucauccaggcccugggcccccccgacuucagaaacaugaccggccugguggaccugacccugagcagaaacgccaucaccagaaucggcgccagagccuucggcgaccuggagagccugagaagccugcaccuggacggcaacagacugguggagcugggcaccggcagccugagaggccccgugaaccugcagcaccugauccugagcggcaaccagcugggcagaaucgcccccggcgccuucgacgacuuccuggagagccuggaggaccuggaccugagcuacaacaaccugagacaggugcccugggccggcaucggcgccaugcccgcccugcacacccugaaccuggaccacaaccugaucgacgcccugccccccggcgccuucgcccagcugggccagcugagcagacuggaccugaccagcaacagacuggccacccuggcccccgacccccuguucagcagaggcagagacgccgaggccagccccgccccccuggugcugagcuucagcggcaacccccugcacugcaacugcgagcugcuguggcugagaagacuggccagacccgacgaccuggagaccugcgccagcccccccggccuggccggcagauacuucugggccgugcccgagggcgaguucagcugcgagcccccccugaucgccagacacacccagagacugugggugcuggagggccagagagccacccugagaugcagagcccugggcgaccccgcccccaccaugcacugggugggccccgacgacagacuggugggcaacagcagcagagccagagccuuccccaacggcacccuggagaucggcgugaccggcgccggcgacgccggcggcuacaccugcaucgccaccaaccccgccggcgaggccaccgccagaguggagcugagagugcuggcccugccccacggcggcaacagcagcgccgagggcggcagacccggccccagcgacaucgccgccagcgccagaaccgccgccgagggcgagggcacccuggagagcgagcccgccgugcaggugaccgaggugaccgccaccagcggccuggugagcuggggccccggcagacccgccgaccccguguggauguuccagauccaguacaacagcagcgaggacgagacccugaucuacagaaucgugcccgccagcagccaccacuuccugcugaagcaccuggugcccggcgccgacuacgaccugugccugcuggcccugagccccgccgccggccccagcgaccugaccgccaccagacugcugggcugcgcccacuucagcacccugcccgccagcccccugugccacgcccugcaggcccacgugcugggcggcacccugaccguggccgugggcggcgugcugguggccgcccugcugguguucaccguggcccugcuggugagaggcagaggcgccggcaacggcagacugccccugaagcugagccacgugcagagccagaccaacggcggccccagccccacccccaaggcccacccccccagaagccccccccccagaccccagagaagcugcagccuggaccugggcgacgccggcugcuacggcuacgccagaagacugggcggcgccugggccagaagaagccacagcgugcacggcggccugcugggcgccggcugcagaggcgugggcggcagcgccgagagacuggaggagagcgugguguga

SEQ ID NO: 1573 - RNA, 1908 nt, Artificial Sequence
  derived and/or modified sequence opt5 from fibronectin__Homo_sapiens__EAW74574
auggcucccccucugcuccugcuucugcucgccagcggcgccgcggcuugcccgcugcccugugugugccagaaccuuuccgagucucugagcacccucugugcccacagagggcugcuguucgucccucccaauguugaccggcgcacaguggaacucagacuggccgauaacuuuauccaagcucuuggaccucccgacuuccggaauaugacgggccugguggaucucacccugucccgcaacgccauuacaagaaucggggcucgggccuuuggagaccuugagucucugcgcagccuccaucuggauggcaauagacuggucgaacucgggaccggaucccugcggggcccugugaaccuucagcaccugauucucucuggcaaucagcuggggcgcaucgcgccgggagccuucgacgauuuucuugagagccuggaagaccucgaucuguccuacaacaaucugagacagguucccugggcuggcauuggggccaugccugcucuccauacacugaaccuugaccacaaucugaucgaugcccugcccccuggagcguucgcccaacucggccagcuuagccggcuggaccucaccucuaaccgccuggcuacacuggcccccgauccgcucuuuuccagagggcgggacgcugaggccagcccugcuccccuggugcuuucuuucuccggaaauccucugcauugcaacugugagcuccuguggcugcgcagacuugcccggcccgacgaucucgaaaccugcgcgucucccccuggccuggccggcagauauuuuugggcugucccggagggggaguucagcugugaacccccucugaucgcccgccacacgcagcggcucugggugcuggagggacagagagccacccuucgcugccgggcucugggcgaccccgccccuacaaugcacuggguugggcccgaugacagacucgugggaaauuccagccgcgcgcgggcuuuuccgaacggcacccuggaaauuggggucacaggagccggcgaugccggcggguacaccuguaucgcuacgaacccugccggagaggcuacagccagaguggaacugcgcgugcuugcgcucccccauggcgggaacuccucugccgagggaggccggccugggcccagcgacauugcugccuccgcuagaaccgccgcggaaggcgagggaacacuggagagcgaaccugccguccaaguuaccgaggugaccgcuacaucuggccugguguccugggggcccggacgcccggccgauccugucuggauguuccagauccaguauaauagcucugaagacgagacgcucauuuaccggaucgugcccgcuagcucccaccauuuucugcuuaagcaccugguucccggcgccgauuaugaccucugccugcuggcccuuucuccugcugcggggccgagcgaucucaccgccacaagacugcugggaugugcucacuucuccacccuccccgccagcccucugugccaugcccuucaggcucacgugcugggcgggacacucaccgucgccgugggcggaguucugguggcggcucugcuugucuucacgguggcccuccugguccggggccgcggggccggaaauggcagacugccccucaaacugucucaugugcaaucccagacaaacgggggaccuagccccaccccuaaggcucaucccccgcggucuccucccccuagaccccagcgcuccugcagccuugaccugggcgacgccggguguuacggcuaugcgcggagacucggaggcgcuugggcccgcagaucccacucuguucacgggggacugcugggcgccgggugccggggagugggcgggagcgcugaacgccuugaggaguccgucguguga

SEQ ID NO: 1574 - protein, 1098 aa, Artificial Sequence
  fibronectin__Homo_sapiens__A0A024RB01
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 1575 - RNA, 3297 nt, Artificial Sequence
  fibronectin__Homo_sapiens__EAW96782
augcccccccgccagcccccucggcaggcggggggagggcucagccgggaguuuggcaaacuccuccccgcguugagucauucgccucugggagguuuaggaagcggcuccgggucgguggccccaggacagggaagagcgggcgcuauggggagccggacgccagaguccccucuccacgccgugcagcugcgcuggggcccccggcgccgacccccgcugcugccgcugcuguugcugcugcugccgccgccacccagggucgggggcuucaacuuagacgcggaggccccagcaguacucucggggcccccgggcuccuucuucggauucucaguggaguuuuaccggccgggaacagacggggucagugugcuggugggagcacccaaggcuaauaccagccagccaggagugcugcaggguggugcugucuaccucuguccuuggggugccagccccacacagugcacccccauugaauuugacagcaaaggcucucggcuccuggaguccucacuguccagcucagagggagaggagccuguggaguacaaguccuugcagugguucggggcaacaguucgagcccauggcuccuccaucuuggcaugcgcuccacuguacagcuggcgcacagagaaggagccacugagcgaccccgugggcaccugcuaccucuccacagauaacuucacccgaauucuggaguaugcacccugccgcucagauuucagcugggcagcaggacaggguuacugccaaggaggcuucagugccgaguucaccaagacuggccgugugguuuuagguggaccaggaagcuauuucuggcaaggccagauccugucugccacucaggagcagauugcagaaucuuauuaccccgaguaccugaucaaccugguucaggggcagcugcagacucgccaggccaguuccaucuaugaugacagcuaccuaggauacucuguggcuguuggugaauucaguggugaugacacagaagacuuuguugcuggugugcccaaagggaaccucacuuacggcuaugucaccauccuuaauggcucagacauucgaucccucuacaacuucucaggggaacagauggccuccuacuuuggcuaugcaguggccgccacagacgucaauggggacgggcuggaugacuugcuggugggggcaccccugcucauggaucggaccccugacgggcggccucaggaggugggcagggucuacgucuaccugcagcacccagccggcauagagcccacgcccacccuuacccucacuggccaugaugaguuuggccgauuuggcagcuccuugaccccccugggggaccuggaccaggauggcuacaaugauguggccaucggggcucccuuugguggggagacccagcagggaguaguguuuguauuuccugggggcccaggagggcugggcucuaagccuucccagguucugcagccccugugggcagccagccacaccccagacuucuuuggcucugcccuucgaggaggccgagaccuggauggcaauggauauccugaucugauugugggguccuuugguguggacaaggcugugguauacaggggccgccccaucguguccgcuagugccucccucaccaucuuccccgccauguucaacccagaggagcggagcugcagcuuagaggggaacccuguggccugcaucaaccuuagcuucugccucaaugcuucuggaaaacacguugcugacuccauugguuucacaguggaacuucagcuggacuggcagaagcagaagggagggguacggcgggcacuguuccuggccuccaggcaggcaacccugacccagacccugcucauccagaauggggcucgagaggauugcagagagaugaagaucuaccucaggaacgagucagaauuucgagacaaacucucgccgauucacaucgcucucaacuucuccuuggacccccaagccccaguggacagccacggccucaggccagcccuacauuaucagagcaagagccggauagaggacaaggcucagaucuugcuggacuguggagaagacaacaucugugugccugaccugcagcuggaaguguuuggggagcagaaccauguguaccugggugacaagaaugcccugaaccucacuuuccaugcccagaaugugggugaggguggcgccuaugaggcugagcuucgggucaccgccccuccagaggcugaguacucaggacucgucagacacccagggaacuucuccagccugagcugugacuacuuugccgugaaccagagccgccugcuggugugugaccugggcaaccccaugaaggcaggagccagucugugggguggccuucgguuuacagucccucaucuccgggacacuaagaaaaccauccaguuugacuuccagauccucagcaagaaucucaacaacucgcaaagcgacgugguuuccuuucggcucuccguggaggcucaggcccaggucacccugaacggugucuccaagccugaggcagugcuauucccaguaagcgacuggcauccccgagaccagccucagaaggaggaggaccugggaccugcuguccaccaugucuaugagcucaucaaccaaggccccagcuccauuagccagggugugcuggaacucagcuguccccaggcucuggaaggucagcagcuccuauaugugaccagaguuacgggacucaacugcaccaccaaucaccccauuaacccaaagggccuggaguuggaucccgaggguucccugcaccaccagcaaaaacgggaagcuccaagccgcagcucugcuuccucgggaccucagauccugaaaugcccggaggcugaguguuucaggcugcgcugugagcucgggccccugcaccaacaagagagccaaagucugcaguugcauuuccgagucugggccaagacuuucuugcagcgggagcaccagccauuuagccugcagugugaggcuguguacaaagcccugaagaugcccuaccgaauccugccucggcagcugccccaaaaagagcgucagguggccacagcugugcaauggaccaaggcagaaggcagcuauggcgucccacuguggaucaucauccuagccauccuguuuggccuccugcuccuaggucuacucaucuacauccucuacaagcuuggauucuucaaacgcucccucccauauggcaccgccauggaaaaagcucagcucaagccuccagccaccucugaugccuga

SEQ ID NO: 1576 - RNA, 3297 nt, Artificial Sequence
  derived and/or modified sequence opt1 from fibronectin__Homo_sapiens__EAW96782
augcccccgcgccagcccccccggcaggccggcgggggccugagccgcgaguucgggaagcuccugcccgcccugucccacagcccgcucggcgggcugggcuccggcagcggguccguggcgcccggccaggggcgggccggcgccauggggagccgcacccccgaguccccccugcacgccguccagcuccgguggggcccgcgccggcgccccccccugcugccccuccugcugcuccugcugccgccccccccccgggugggcggguucaaccucgacgccgaggcgccggccgugcugagcggcccccccggguccuucuucggcuucagcgucgaguucuaccgccccggcaccgacgggguguccgugcuggucggcgccccgaaggccaacacgagccagcccggggugcuccagggcggggcgguguaccugugccccuggggcgccucccccacccagugcaccccgaucgaguucgacagcaagggcucccggcugcucgagagcucccugagcuccagcgagggggaggagcccgucgaguacaagagccugcagugguucggcgccaccgugcgcgcccacggguccagcauccucgccugcgcgccccuguacuccuggcggacggagaaggagccccugagcgacccggugggcaccugcuaccucuccaccgacaacuucacccgcauccuggaguacgcccccugccggagcgacuucuccugggccgccgggcagggcuacugccagggcggguucagcgccgaguucacgaagaccggccgcgucgugcuggggggccccggguccuacuucuggcagggccagauccucagcgcgacccaggagcagaucgccgaguccuacuacccggaguaccugaucaaccuggugcagggccagcuccagacccggcaggccagcuccaucuacgacgacagcuaccugggguacuccgucgccgugggcgaguucagcggggacgacacggaggacuucguggccggcguccccaagggcaaccugaccuacggguacgugaccauccucaacggcuccgacauccgcagccuguacaacuucuccggggagcagauggcgagcuacuucggcuacgccguggccgccaccgacgucaacggggacggccuggacgaccuccuggugggcgccccccugcucauggaccggacgcccgacgggcgcccgcaggaggugggccgggucuacguguaccugcagcaccccgcggggaucgagcccacccccacccugacccucacgggccacgacgaguucgggcgcuucggcagcucccugaccccgcugggcgaccucgaccaggacggguacaacgacgucgccaucggcgcccccuucgggggcgagacccagcagggggugguguucgucuuccccggcggccccgggggccuggggagcaagccgucccaggugcugcagccccugugggccgcgagccacacccccgacuucuucggcuccgcccuccgcgggggccgggaccuggacggcaacggguaccccgaccugaucgugggcagcuucggggucgacaaggccgugguguaccgcggccggccgaucgucuccgccagcgccucccucacgaucuuccccgcgauguucaaccccgaggagcgcagcugcucccuggagggcaaccccguggccugcaucaaccugagcuucugccucaacgccuccgggaagcacguggccgacagcaucggcuucaccgucgagcugcagcuggacuggcagaagcagaaggggggcgugcggcgcgcccucuuccuggcgucccggcaggccacccugacccagacgcuccugauccagaacggggcccgcgaggacugccgggagaugaagaucuaccugcgcaacgagagcgaguuccgggacaagcucuccccgauccacaucgcccugaacuucagccuggacccccaggcccccguggacagccacggccuccgccccgcgcugcacuaccaguccaagagccggaucgaggacaaggcccagauccugcucgacugcggcgaggacaacaucugcgucccggaccugcagcuggagguguucggggagcagaaccacguguaccucggcgacaagaacgcccugaaccugaccuuccacgcccagaacgucggggagggcggggcguacgaggccgagcuccgcgugaccgccccccccgaggccgaguacuccggccuggugcggcacccgggcaacuucagcucccugagcugcgacuacuucgccgucaaccagucccgccuccuggugugcgaccuggggaaccccaugaaggcgggcgccagccucugggggggccugcgguucaccgugccccaccugcgcgacacgaagaagaccauccaguucgacuuccagauccucuccaagaaccugaacaacagccaguccgacgucgugagcuuccggcuguccguggaggcccaggcccaggucacccucaacggggugagcaagcccgaggccgugcuguucccggucuccgacuggcacccccgcgaccagccccagaaggaggaggaccugggccccgcggugcaccacguguacgagcucaucaaccagggcccgagcuccaucagccaggggguccuggagcuguccugcccccaggcccucgagggccagcagcugcuguacgugacccgcgugacggggcucaacugcaccaccaaccaccccaucaaccccaagggccuggagcuggacccggagggcagccuccaccaccagcagaagcgggaggcccccagccgcuccagcgccuccagcgggccccagauccugaagugccccgaggccgagugcuuccggcugcgcugcgagcucggcccgcugcaccagcaggagucccagagccugcagcuccacuuccgggucugggcgaagaccuuccugcagcgcgagcaccagcccuucucccugcagugcgaggccguguacaaggcccucaagaugcccuaccggauccugccccgccagcugccgcagaaggagcggcagguggccaccgcgguccaguggacgaaggccgaggggagcuacggcgugccccucuggaucaucauccuggccauccuguucgggcuccugcugcucggccugcugaucuacauccucuacaagcugggcuucuucaagcgcucccugcccuacgggaccgccauggagaaggcccagcucaagcccccggcgaccagcgacgccuga

SEQ ID NO: 1577 - RNA, 3297 nt, Artificial Sequence
  derived and/or modified sequence opt2 from fibronectin__Homo_sapiens__EAW96782
augcccccccgccagcccccccgccaggccggcggcggccucucccgcgaguucggcaagcuccuccccgcccucucccacuccccccucggcggccucggcuccggcuccggcuccgucgcccccggccagggccgcgccggcgccaugggcucccgcacccccgaguccccccuccacgccguccagcuccgcuggggcccccgccgccgccccccccuccucccccuccuccuccuccuccuccccccccccccccgcgucggcggcuucaaccucgacgccgaggcccccgccguccucuccggcccccccggcuccuucuucggcuucuccgucgaguucuaccgccccggcaccgacggcgucuccguccucgucggcgcccccaaggccaacaccucccagcccggcguccuccagggcggcgccgucuaccucugccccuggggcgccucccccacccagugcacccccaucgaguucgacuccaagggcucccgccuccucgaguccucccucuccuccuccgagggcgaggagcccgucgaguacaagucccuccagugguucggcgccaccguccgcgcccacggcuccuccauccucgccugcgccccccucuacuccuggcgcaccgagaaggagccccucuccgaccccgucggcaccugcuaccucuccaccgacaacuucacccgcauccucgaguacgcccccugccgcuccgacuucuccugggccgccggccagggcuacugccagggcggcuucuccgccgaguucaccaagaccggccgcgucguccucggcggccccggcuccuacuucuggcagggccagauccucuccgccacccaggagcagaucgccgaguccuacuaccccgaguaccucaucaaccucguccagggccagcuccagacccgccaggccuccuccaucuacgacgacuccuaccucggcuacuccgucgccgucggcgaguucuccggcgacgacaccgaggacuucgucgccggcguccccaagggcaaccucaccuacggcuacgucaccauccucaacggcuccgacauccgcucccucuacaacuucuccggcgagcagauggccuccuacuucggcuacgccgucgccgccaccgacgucaacggcgacggccucgacgaccuccucgucggcgccccccuccucauggaccgcacccccgacggccgcccccaggaggucggccgcgucuacgucuaccuccagcaccccgccggcaucgagcccacccccacccucacccucaccggccacgacgaguucggccgcuucggcuccucccucaccccccucggcgaccucgaccaggacggcuacaacgacgucgccaucggcgcccccuucggcggcgagacccagcagggcgucgucuucgucuuccccggcggccccggcggccucggcuccaagcccucccagguccuccagccccucugggccgccucccacacccccgacuucuucggcuccgcccuccgcggcggccgcgaccucgacggcaacggcuaccccgaccucaucgucggcuccuucggcgucgacaaggccgucgucuaccgcggccgccccaucgucuccgccuccgccucccucaccaucuuccccgccauguucaaccccgaggagcgcuccugcucccucgagggcaaccccgucgccugcaucaaccucuccuucugccucaacgccuccggcaagcacgucgccgacuccaucggcuucaccgucgagcuccagcucgacuggcagaagcagaagggcggcguccgccgcgcccucuuccucgccucccgccaggccacccucacccagacccuccucauccagaacggcgcccgcgaggacugccgcgagaugaagaucuaccuccgcaacgaguccgaguuccgcgacaagcucucccccauccacaucgcccucaacuucucccucgacccccaggcccccgucgacucccacggccuccgccccgcccuccacuaccaguccaagucccgcaucgaggacaaggcccagauccuccucgacugcggcgaggacaacaucugcguccccgaccuccagcucgaggucuucggcgagcagaaccacgucuaccucggcgacaagaacgcccucaaccucaccuuccacgcccagaacgucggcgagggcggcgccuacgaggccgagcuccgcgucaccgccccccccgaggccgaguacuccggccucguccgccaccccggcaacuucuccucccucuccugcgacuacuucgccgucaaccagucccgccuccucgucugcgaccucggcaaccccaugaaggccggcgccucccucuggggcggccuccgcuucaccgucccccaccuccgcgacaccaagaagaccauccaguucgacuuccagauccucuccaagaaccucaacaacucccaguccgacgucgucuccuuccgccucuccgucgaggcccaggcccaggucacccucaacggcgucuccaagcccgaggccguccucuuccccgucuccgacuggcacccccgcgaccagccccagaaggaggaggaccucggccccgccguccaccacgucuacgagcucaucaaccagggccccuccuccaucucccagggcguccucgagcucuccugcccccaggcccucgagggccagcagcuccucuacgucacccgcgucaccggccucaacugcaccaccaaccaccccaucaaccccaagggccucgagcucgaccccgagggcucccuccaccaccagcagaagcgcgaggcccccucccgcuccuccgccuccuccggcccccagauccucaagugccccgaggccgagugcuuccgccuccgcugcgagcucggcccccuccaccagcaggagucccagucccuccagcuccacuuccgcgucugggccaagaccuuccuccagcgcgagcaccagcccuucucccuccagugcgaggccgucuacaaggcccucaagaugcccuaccgcauccucccccgccagcucccccagaaggagcgccaggucgccaccgccguccaguggaccaaggccgagggcuccuacggcgucccccucuggaucaucauccucgccauccucuucggccuccuccuccucggccuccucaucuacauccucuacaagcucggcuucuucaagcgcucccuccccuacggcaccgccauggagaaggcccagcucaagccccccgccaccuccgacgccuga

SEQ ID NO: 1578 - RNA, 3297 nt, Artificial Sequence
  derived and/or modified sequence opt3 from fibronectin__Homo_sapiens__EAW96782
augcccccuagacagccaccgaggcaagccggcgggggacugagccgggaguucgguaagcuccuucccgcucugucccacucuccuuugggcggguuaggaucaggcagugguagcguggcaccagggcagggacgcgccggcgcgaugggcucccgaacccccgaaucuccucugcaugcuguccagcuacguugggggccaagaaggcggcccccucuccugccacuucuguugcuccugcugccgcccccuccacgcguuggagguuuuaaccucgacgccgaggcacccgccguguuaucgggcccuccagggucauucuuuggauucagcguagaauuuuacagacccggcacagauggugugaguguccuggugggggcuccgaaagcaaauacuucccagccuggaguucuucaaggcggcgccguguauuugugccccuggggagcuucuccaacgcaguguaccccuaucgaguucgacagcaagggguccaggcugcuagaaucaagucucucuagcuccgagggugaggaacccgucgaguacaaaucacugcagugguuuggcgccacagugcgggcgcacgggagcaguauucuugcaugcgccccacuguauucuuggcgcacugaaaaggagcccuuguccgauccuguaggaaccuguuaccucagcacagacaacuucacccgaauacuggaguaugcuccaugcagaucggauuuuucuugggccgcaggccaggguuacugucaagggggcuucuccgcugaauuuacuaaaacaggaaggguuguguuaggcgggccgggaucauauuucuggcagggucagauccugagugccacccaggagcaaauugcggaaagcuacuaccccgaguaucucaucaaucuuguccagggccagcugcaaacgcggcaggccuccucuauuuacgacgauagcuauuugggguacucaguggcagugggagaauuuaguggcgacgauacugaggacuucgucgcugguguuccuaaggggaaccuaaccuauggcuacgugacaauccugaauggauccgauauacguagccucuauaacuucucuggcgagcagauggccucauacuuuggguacgcuguagccgcaacugacgugaauggagauggucuggacgaccuucuggucggcgccccauugcucauggaucgcacccccgacgggagaccucaggaagugggaaggguuuauguguaccugcaacauccagcuggcaucgagcccacaccgaccuuaacgcugacuggucacgaugaguucgggcgguuuggcaguagccuaacaccucucggagaccuggaucaggacggcuauaacgaugucgcgauuggggcaccauucggaggcgagacccagcagggugugguauuuguuuuccccgggggaccuggcggucuuggcuccaagcccucucaaguguugcagccacugugggccgcuucgcauacuccugacuuuuucgggagcgcccuccgaggaggccgcgaucuggacgggaauggauaccccgaucuuaucgucggcuccuuugguguggacaaagcagucguguauagagggaggccaauuguuucagccagugcuucucugacaaucuucccggccauguuuaacccugaagaacggagcugcuccuuggagggaaaucccguggcauguauaaaccucucauucugccugaaugcgagcggcaagcacguagcugacucuauugguuuuaccgucgaauuacagcuggauuggcagaaacaaaagggcggggugcgcagagcccuauuccucgcauccaggcaggccacgcugacccagacacuuuugauccagaacggagcucgugaggacugucgggaaaugaaaauuuaccugcgaaaugagagugaguucagagauaagcucagcccaauccacaucgcccugaacuuuucuuuagacccccaagcaccuguugauucccauggccugaggccagcccuucacuaucagucaaagagucgcauugaagacaaagcucagauauugcucgauugcggggaggacaacaucugugugcccgaucugcaacuagaagucuucggagagcagaaucauguguaccugggcgacaagaacgcgcucaaucugacuuuucacgcccagaacguaggugaagggggagcuuacgaggcagagcuucgggugaccgccccuccggaagcugaguauagcggcuugguuagacacccagguaauuucucgucccugucuugcgauuacuuugccgucaaccagagcagguuacucgugugcgaccugggcaaucccaugaaagcaggggcgucacuuuggggaggccugcgcuucacagugccucauuugcgagauacuaagaaaaccauucaauuugacuuccagauccucaguaagaaccugaauaacucccagucugacgucguuagcuuucggcuauccguggaagcccaggcucaagugacacugaaugggguaucaaaaccagaggccguccucuuccccgugagcgauuggcacccucgugaccagccgcagaaggaagaggaucugggacccgcaguucaucacguguaugagcuuauaaaccagggcccaaguucuauuucccaaggugucuuggaacugagcuguccucaggcuuuagaggggcagcaacuccuguacgugaccagaguuacuggacuuaauugcacgacaaaccaucccaucaauccaaagggccuggaacuagacccugagggcucgcuccaccaccagcagaaaagggaagcccccucacgcucuagugcauccagcgggccacagauccugaaguguccggaggccgagugcuuucgguugagaugugaacugggaccuuuacaucaacaggagucucagagccuccagcugcacuucagggugugggcuaaaaccuuucuucaacgagaacaucagcccuucucccugcagugcgaggcgguauauaaggccuugaaaaugccauaccgcauucucccccggcagcugccucaaaaggaaagacaggucgcaacugcugugcaguggaccaaggccgaggguucauauggcgugccacuauggaucauuauacuggccauccuuuucgggcuccuguugcugggauuacucauuuacauccuguacaaacuuggcuuuuucaagaggagucugcccuaugguacagcuauggagaaagcacaguugaagccuccggccaccagcgaugcguga

SEQ ID NO: 1579 - RNA, 3297 nt, Artificial Sequence
  derived and/or modified sequence opt4 from fibronectin__Homo_sapiens__EAW96782
augccccccagacagccccccagacaggccggcggcggccugagcagagaguucggcaagcugcugcccgcccugagccacagcccccugggcggccugggcagcggcagcggcagcguggcccccggccagggcagagccggcgccaugggcagcagaacccccgagagcccccugcacgccgugcagcugagauggggccccagaagaagacccccccugcugccccugcugcugcugcugcugccccccccccccagagugggcggcuucaaccuggacgccgaggcccccgccgugcugagcggcccccccggcagcuucuucggcuucagcguggaguucuacagacccggcaccgacggcgugagcgugcuggugggcgcccccaaggccaacaccagccagcccggcgugcugcagggcggcgccguguaccugugccccuggggcgccagccccacccagugcacccccaucgaguucgacagcaagggcagcagacugcuggagagcagccugagcagcagcgagggcgaggagcccguggaguacaagagccugcagugguucggcgccaccgugagagcccacggcagcagcauccuggccugcgccccccuguacagcuggagaaccgagaaggagccccugagcgaccccgugggcaccugcuaccugagcaccgacaacuucaccagaauccuggaguacgcccccugcagaagcgacuucagcugggccgccggccagggcuacugccagggcggcuucagcgccgaguucaccaagaccggcagaguggugcugggcggccccggcagcuacuucuggcagggccagauccugagcgccacccaggagcagaucgccgagagcuacuaccccgaguaccugaucaaccuggugcagggccagcugcagaccagacaggccagcagcaucuacgacgacagcuaccugggcuacagcguggccgugggcgaguucagcggcgacgacaccgaggacuucguggccggcgugcccaagggcaaccugaccuacggcuacgugaccauccugaacggcagcgacaucagaagccuguacaacuucagcggcgagcagauggccagcuacuucggcuacgccguggccgccaccgacgugaacggcgacggccuggacgaccugcuggugggcgccccccugcugauggacagaacccccgacggcagaccccaggaggugggcagaguguacguguaccugcagcaccccgccggcaucgagcccacccccacccugacccugaccggccacgacgaguucggcagauucggcagcagccugaccccccugggcgaccuggaccaggacggcuacaacgacguggccaucggcgcccccuucggcggcgagacccagcagggcgugguguucguguuccccggcggccccggcggccugggcagcaagcccagccaggugcugcagccccugugggccgccagccacacccccgacuucuucggcagcgcccugagaggcggcagagaccuggacggcaacggcuaccccgaccugaucgugggcagcuucggcguggacaaggccgugguguacagaggcagacccaucgugagcgccagcgccagccugaccaucuuccccgccauguucaaccccgaggagagaagcugcagccuggagggcaaccccguggccugcaucaaccugagcuucugccugaacgccagcggcaagcacguggccgacagcaucggcuucaccguggagcugcagcuggacuggcagaagcagaagggcggcgugagaagagcccuguuccuggccagcagacaggccacccugacccagacccugcugauccagaacggcgccagagaggacugcagagagaugaagaucuaccugagaaacgagagcgaguucagagacaagcugagccccauccacaucgcccugaacuucagccuggacccccaggcccccguggacagccacggccugagacccgcccugcacuaccagagcaagagcagaaucgaggacaaggcccagauccugcuggacugcggcgaggacaacaucugcgugcccgaccugcagcuggagguguucggcgagcagaaccacguguaccugggcgacaagaacgcccugaaccugaccuuccacgcccagaacgugggcgagggcggcgccuacgaggccgagcugagagugaccgccccccccgaggccgaguacagcggccuggugagacaccccggcaacuucagcagccugagcugcgacuacuucgccgugaaccagagcagacugcuggugugcgaccugggcaaccccaugaaggccggcgccagccuguggggcggccugagauucaccgugccccaccugagagacaccaagaagaccauccaguucgacuuccagauccugagcaagaaccugaacaacagccagagcgacguggugagcuucagacugagcguggaggcccaggcccaggugacccugaacggcgugagcaagcccgaggccgugcuguuccccgugagcgacuggcaccccagagaccagccccagaaggaggaggaccugggccccgccgugcaccacguguacgagcugaucaaccagggccccagcagcaucagccagggcgugcuggagcugagcugcccccaggcccuggagggccagcagcugcuguacgugaccagagugaccggccugaacugcaccaccaaccaccccaucaaccccaagggccuggagcuggaccccgagggcagccugcaccaccagcagaagagagaggcccccagcagaagcagcgccagcagcggcccccagauccugaagugccccgaggccgagugcuucagacugagaugcgagcugggcccccugcaccagcaggagagccagagccugcagcugcacuucagagugugggccaagaccuuccugcagagagagcaccagcccuucagccugcagugcgaggccguguacaaggcccugaagaugcccuacagaauccugcccagacagcugccccagaaggagagacagguggccaccgccgugcaguggaccaaggccgagggcagcuacggcgugccccuguggaucaucauccuggccauccuguucggccugcugcugcugggccugcugaucuacauccuguacaagcugggcuucuucaagagaagccugcccuacggcaccgccauggagaaggcccagcugaagccccccgccaccagcgacgccuga

SEQ ID NO: 1580 - RNA, 3297 nt, Artificial Sequence
  derived and/or modified sequence opt5 from fibronectin__Homo_sapiens__EAW96782
augcccccuagacagccgccccggcaagccggcgggggacugagccgcgaguucggcaagcuccugccugcucuuucccacucuccccucgggggacucggcagcggguccggaucuguggccccuggccagggcagagcgggggcuaugggaagccggacccccgaauccccucugcaugccguccagcuucgcuggggcccgagacggagacccccucugcucccccugcugcuccugcuucugccucccccgccucgcguugggggauuuaaccucgacgccgaggcucccgccgugcugucuggcccucccgggagcuucuuuggauucuccguggaauuuuaccggcccggcacagauggcgucagcgugcuuguuggggcuccuaaagccaauacgucucagccgggagugcugcaaggcggggcggucuaucucugccccuggggagccuccccuacccaguguacacccaucgaguucgacagcaagggcucucgccugcuggaauccagccucucuuccagcgagggggaggaaccuguggaguacaaaucccugcagugguuuggagcuaccguuagagcccacggcucuagcauucuugcuugcgcgccccuguauuccuggcggacagaaaaggagccgcucagcgauccugugggcaccuguuaccugucuacagacaacuucacccgcauccuugaguaugcccccugcagauccgauuuuagcugggccgcugggcagggauacugucaaggcggguucucugccgaauuuacgaaaaccggacgggucgugcugggcgggccuggcagcuauuucuggcagggacagauucucuccgcuacacaggagcaaaucgccgaaucuuacuaccccgaguaucugauuaaucuggugcagggccagcuccaaacccgccaggccagcuccaucuacgacgauagcuaucugggguacucugucgcuguuggagaauuuuccggcgacgauacagaggacuucguggcgggggugccuaagggaaaccuuaccuauggcuacgucacgauccugaaugggagcgauauuagaucucucuauaacuucuccggcgagcagauggccagcuacuuuggauacgcuguggccgccacagacguuaauggcgaugggcuggacgaccuucuggugggagcuccccuccugauggaucggaccccggacggcagaccucaggaagucgggcgcguguauguuuaccugcaacaucccgccggaaucgagcccacaccuacccucacccugacaggccacgaugaguucgggcgguuuggcuccucucuuacgccgcugggagaccucgaucaggacggcuauaacgauguggcgauuggggcucccuucggaggcgaaacccagcagggggucguguuugucuucccuggaggccccgggggccugggaagcaagccuucccaagugcugcagccccuuugggccgccucucauacaccugacuuuuucggcagcgcucucagagggggacgcgaucuggacggcaauggguaccccgaucugaucguuggauccuuuggcguggacaaagccgucguguaucggggcagaccgauuguuagcgcuucugccucccucaccaucuucccugcgauguuuaaccccgaggaacgcagcugcucucuggaggggaauccuguggccuguauuaaccuuuccuucugccugaaugcuagcggaaagcacgucgccgacucuaucggcuuuacaguggaacuccagcuggauuggcagaaacaaaaagggggagugcggagagcucuguuccuugccagccgccaggcgacccucacgcagacacugcugauccagaacggcgcccgggaggacuguagagaaaugaagauuuaccuccgcaaugaguccgaguuccgggauaagcugagccccauccacauugcucuuaacuuuucucuggacccgcaagccccuguugauucccaugggcucagacccgcucugcacuaucagagcaagucccggaucgaagacaaagcccagauucugcuugauugcggagaggacaacaucugugucccugaucuccaacuggaaguguucggcgagcagaaucauguguaccugggcgacaagaacgcccucaaucugaccuuucacgcucagaacgucggggaaggaggcgcguacgaggccgagcuucgcgugaccgcuccucccgaagccgaguauucugggcugguuagacaccccggaaauuucagcucccucucuugcgauuacuuugccgugaaccagagccggcugcuggucugcgaccuuggcaauccgaugaaagcuggggccucccucuggggaggccugagauucacagugccccaucugcgcgauaccaagaaaacaauccaauuugacuuccagauucucucuaagaaccugaauaacagccaguccgacguugugagcuuucggcuuucugucgaagcgcaggcucaagugacgcugaauggcguuuccaaaccugaggccgugcuguuccccgucagcgauuggcacccuagagaccagccccagaaggaagaggaucuggggccugccgugcaucacguguaugagcugaucaaccagggaccgucuuccauuagccaaggcguccuugaacugucuuguccccaggcucucgaggggcagcaacugcucuacguuacccgcgugacaggacugaauugcaccacaaaccauccuaucaaucccaagggccuugaacuggacccugaggggucccuccaccaccagcagaaaagagaagcccccagccgguccagcgcgucuagcggaccgcagauucugaaguguccugaggcugagugcuuucgccugagaugugaacuuggcccccugcaucaacaggagucccagucucuccagcugcacuuccgggugugggccaaaaccuuucuccaacgcgaacaucagcccuucagccugcagugcgaggccgucuauaaggcucuuaaaaugccuuacagaauccugccccggcagcucccucaaaaggaacgccagguggccacggcuguucaguggaccaaggccgagggcuccuauggggugccgcuguggaucauuauccuggcgauucuuuucggacugcuccugcucggccugcuuaucuacauucuguacaaacugggguuuuucaagagaucucuccccuauggaacagccauggagaaagcucagcugaagccucccgccaccagcgaugcuuga

SEQ ID NO: 1581 - protein, 1198 aa, Artificial Sequence
  fibronectin__Homo_sapiens__A0A024RDT9
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 1582 - RNA, 3597 nt, Artificial Sequence
  fibronectin__Homo_sapiens__EAX08808
auggcagaacauccaccacuacuggauacaacucagaucuuaaguagugauauuucucuuuugucugccccuauuguaagugcagauggaacacaacagguuauucugguacaaguuaacccaggagaagcauuuacaauaagaagagaagauggacaguuucagugcauuacagguccugcucagguuccaaugauguccccaaaugguucugugccuccuaucuaugugccuccuggauaugccccacagguuauugaagacaaugguguucgaagaguugucguggucccucaggcaccagaguuucacccugguagucacacaguucuccaccguucuccacauccuccucuaccugguuucauuccugucccaacuaugaugccgccuccaccacgucauauguacucacccgugacuggagcuggagacaugacaacacaguauaugccacaguaucagucuucacaagucuauggagauguagaugcucacucuacacauggaagguccaacuuuagagaugaacgaucuaguaaaacauaugaacguuugcagaaaaaauugaaggaucgccaaggaacacagaaagauaaaaugagcaguccaccaucaucaccccagaaaugcccuucucccauuaaugaacauaauggacuuauaaaaggacaaauugcuggugguauaaacacaggaucagcaaaaaucaagucugggaaggggaaaggugguacacaaguugauacagaaauugaagaaaaagaugaagaaacuaaagcauuugaagcacuucuuuccaacauugucaaaccaguggccuccgacauccaggcaaggacaguaguacuuaccuggucaccaccuuccagccucauuaauggugaaacagaugaaaguaguguaccagagcucuaugguuaugaaguucugaucucaaguacuggaaaagaugggaaauacaaaaguguauauguaggagaagaaacaaauaucacuuuaaaugaucucaagccagccauggauuaccaugcaaaaguccaggcagaauauaauucuauaaagggaacuccuucagaggcugaaaucuuuaccaccuugagcugugaaccugauauaccuaauccaccaaggauagccaaucggaccaaaaauucacucacuuugcaauggaaggcaccuagugacaaugguucuaaaauccaaaacuuuguauuagaaugggaugaaggaaaaggaaauggagaauuuugucaguguuacaugggcucacagaaacaauuuaaaauuacuaaacuuucaccagcaaugggcuguaaauucagacuaucggccagaaaugacuaugguacaagugguuuuagugaagaagucuuauauuacaccucaggcugugcuccuucuaugccagcaaguccuguauuaaccaaggcuggaauuacuugguuauccuuacaauggaguaagcccucaggaacaccaucagaugaaggaauuucuuacauuuuagagauggaggaagaaacuucaggauaugguuuuaagccuaaauaugauggagaagaucuugcuuacacagugaaaaaucucagacguaguacuaaguauaaauuuaagguuauugcuuacaacucagaagguaaaaguaauccaagugaaguaguagaauuuacuacuugcccugauaaaccaggcauaccuguaaagccuucagugaaaggaaagauacauucacacaguuuuaaaauaaccugggauccaccaaaagacaauggcggagcaaccaucaauaaauauguaguggagauggcagaagguucuaacggaaacaaaugggaaaugauauacaguggugcuaccagggaacaucuuugugaucgacugaauccaggcuguuucuaucguuuacgaguuuacugcaucagugauggaggacagagugcggucucugaaucuuuacuugugcagacuccagcugugccuccuggcccaugccucccucccagauuacaggguagacccaaagcaaaagaaauacaguuacgauggggacccccucugguugaugguggaucacccauuuccuguuacaguguggaaaugucuccuauagaaaaagaugaaccuagagaaguuuaccaagguucugaaguagaauguacagugagcagccuucuuccuggaaagacauacagcuucagacuacgugcagcuaacaaaaugggguuuggaccauuuucagaaaaaugugauauuacuacagccccugggccaccagaucagugcaagcccccucaagugacauguagaucugcaacuugugcacaagugaauugggagguuccuuugaguaauggaacagaugucacugaauaucgacuggaguggggaggaguugaaggaaguaugcagauauguuacugugggccuggucucaguuaugaaauaaaaggacuuucaccagcaacuaccuauuauugcaggguccaggcucugaguguugugggugcaggcccuuucagugaaguaguagccugugugacuccaccaucaguuccuggcauugugaccugucuucaagaaauaagcgaugaugagauagaaaauccccauuauucaccuucuacaugccuugcaauaagcugggaaaagccuugugaucaugguucggaaauccuugccuacagcauagacuuuggagauaaacaaucccuaacagugggaaagguuacaagcuauauuaucaacaauuugcaaccagauacaacauacagaauacgaauucaagccuugaauagccuuggagcugguccuuucagccauaugauaaaauuaaaaacuaagccucucccuccugauccaccucgucuggaauguguugccuuuagccaccagaaccuuaagcugaaauggggagaaggaacuccaaagacauugucaaccgauucuauucaguaccaccuucagauggaggauaagaauggacgguuuguaucccuauacagaggaccaugucauacauacaaaguacaaagacuuaaugagucaacauccuauaaauucuguauucaagcuuguaaugaagcuggggaagguccccucucccaagaauauauuuucacuacuccaaaaucugucccagcugccuugaaagcccccaaaauagagaaaguaaaugaucacauuugugaaauuacaugggaguguuuacagccaaugaaaggugauccaguuauuuacagucuucaaguuauguugggaaaagauucagaauucaaacagauuuacaagggucccgacucuuccuuccgguauuccagccuucagcugaacugugaauaucgcuuccguguaugugccauucgccagugccaagacucucugggacaccaggaccucguaggucccuacagcaccacagugcucuucaucucucagaggacugaaccaccagccagcaccaacagagacacuguggaaagcacaaggacccgacgggcacugagugacgagcagugugcugccgucauccuugugcuguuugcuuucuuuuccauuuugauugccuuuaucauucaguacuuuguaaucaaguga

SEQ ID NO: 1583 - RNA, 3597 nt, Artificial Sequence
  derived and/or modified sequence opt1 from fibronectin__Homo_sapiens__EAX08808
auggccgagcacccgccccugcucgacaccacccagauccugagcuccgacaucagccugcucuccgcccccaucgugagcgcggacggcacgcagcaggucauccugguccaggugaaccccggggaggccuucaccauccgccgggaggacggccaguuccagugcaucaccgggcccgcccagguccccaugaugucccccaacggcagcgugccgcccaucuacgugccgcccggguacgcgccccaggucaucgaggacaacggcgugcgccggguggucguggugccccaggcccccgaguuccaccccggcucccacaccguccugcaccgcagcccccacccgccccuccccggguucauccccgugcccacgaugaugccgcccccgccccggcacauguacucccccgugaccggcgccggggacaugaccacccaguacaugccccaguaccagagcucccaggucuacggcgacguggacgcccacagcacgcacgggcgcuccaacuuccgggacgagcgcagcuccaagaccuacgagcggcugcagaagaagcugaaggaccgccagggcacccagaaggacaagaugagcuccccgcccagcagcccccagaagugccccucccccaucaacgagcacaacggccucaucaaggggcagaucgccggcgggaucaacaccggcagcgccaagaucaaguccggcaaggggaagggcgggacccagguggacacggagaucgaggagaaggacgaggagaccaaggcguucgaggcccugcugagcaacaucgucaagccgguggccuccgacauccaggcccggaccgugguccucacguggagcccgcccuccagccugaucaacggcgagaccgacgaguccagcgugcccgagcuguacggguacgaggugcucaucuccagcaccggcaaggacggcaaguacaaguccgucuacgugggggaggagaccaacaucacgcugaacgaccugaagcccgccauggacuaccacgcgaagguccaggccgaguacaacagcaucaagggcacccccuccgaggccgagaucuucaccacccucagcugcgagcccgacauccccaacccgccccgcaucgccaaccggacgaagaacucccugacccugcaguggaaggcccccagcgacaacggguccaagauccagaacuucgugcucgagugggacgagggcaaggggaacggcgaguucugccagugcuacaugggcagccagaagcaguucaagaucaccaagcugucccccgcgauggggugcaaguuccgccugagcgcccggaacgacuacggcaccagcggguucuccgaggaggugcucuacuacacgagcggcugcgccccguccaugcccgccagccccguccugaccaaggccgggaucaccuggcugucccuccaguggagcaagcccuccggcaccccgagcgacgagggcaucuccuacauccuggagauggaggaggagacgagcggguacggcuucaagcccaaguacgacggggaggaccuggcguacaccgugaagaaccuccgccgguccaccaaguacaaguucaaggugaucgccuacaacagcgagggcaaguccaaccccagcgaggucguggaguucaccacgugccccgacaagccgggcauccccgugaagcccuccgucaaggggaagauccacagccacuccuucaagaucaccugggacccgcccaaggacaacggcggggccaccaucaacaaguacgugguggagauggccgagggcagcaacgggaacaagugggagaugaucuacagcggcgccacccgcgagcaccugugcgaccggcugaaccccggcugcuucuaccgccuccgggucuacugcaucuccgacgggggccagagcgcgguguccgagagccugcuggugcagacccccgccgucccgcccgggcccugccugcccccgcgccuccagggccgccccaaggccaaggagauccagcugcggugggggccgccccucguggacggcggcucccccaucagcugcuacuccguggagaugagccccaucgagaaggacgagccccgcgaggucuaccagggguccgagguggagugcacggugagcucccugcugcccggcaagaccuacagcuuccggcuccgcgccgcgaacaagaugggguucggcccguucuccgagaagugcgacaucaccaccgcccccgggccgcccgaccagugcaagccgccccaggucacgugccggagcgcgaccugcgcccaggugaacugggaggugccccuguccaacggcaccgacgucaccgaguaccgccuggaguggggcgggguggagggcagcaugcagaucugcuacugcgggcccggccucuccuacgagaucaaggggcugagccccgccacgaccuacuacugccgggugcaggcccuguccgucgugggcgccggccccuucagcgagguggucgccugcgugaccccgcccagcgugcccgggaucgugaccugccuccaggagaucuccgacgacgagaucgagaacccccacuacagccccuccacgugccuggccaucagcugggagaagcccugcgaccacggcuccgagauccuggccuacagcaucgacuucggggacaagcagucccugaccgugggcaaggugaccagcuacaucaucaacaaccuccagccggacaccacguaccgcauccggauccaggcgcugaacucccugggcgccgggcccuucagccacaugaucaagcucaagaccaagccccugccgcccgacccgccccgccuggagugcgucgccuucucccaccagaaccucaagcugaaguggggcgaggggacccccaagacccugagcacggacuccauccaguaccaccuccagauggaggacaagaacggccgguucgugagccuguaccgcgggcccugccacaccuacaaggugcagcggcugaacgaguccaccagcuacaaguucugcauccaggccugcaacgaggccggcgagggcccccucucccaggaguacaucuucaccacgcccaagagcgucccggcggcccugaaggcccccaagaucgagaaggugaacgaccacaucugcgagaucaccugggagugccugcagcccaugaagggggaccccgugaucuacucccuccaggucaugcugggcaaggacagcgaguucaagcagaucuacaaggggccggacagcuccuuccgcuacagcucccugcagcucaacugcgaguaccgguuccgcgugugcgccauccggcagugccaggacagccugggccaccaggaccugguggggcccuacuccaccaccguccucuucaucagccagcgcacggagccgcccgcguccaccaaccgggacaccguggagagcacccgcacgcgccgggcccuguccgacgagcagugcgccgccgugauccugguccucuucgccuucuucagcauccugaucgcguucaucauccaguacuucgugaucaaguga

SEQ ID NO: 1584 - RNA, 3597 nt, Artificial Sequence
  derived and/or modified sequence opt2 from fibronectin__Homo_sapiens__EAX08808
auggccgagcaccccccccuccucgacaccacccagauccucuccuccgacaucucccuccucuccgcccccaucgucuccgccgacggcacccagcaggucauccucguccaggucaaccccggcgaggccuucaccauccgccgcgaggacggccaguuccagugcaucaccggccccgcccagguccccaugaugucccccaacggcuccgucccccccaucuacgucccccccggcuacgccccccaggucaucgaggacaacggcguccgccgcgucgucgucgucccccaggcccccgaguuccaccccggcucccacaccguccuccaccgcuccccccaccccccccuccccggcuucauccccguccccaccaugaugcccccccccccccgccacauguacucccccgucaccggcgccggcgacaugaccacccaguacaugccccaguaccaguccucccaggucuacggcgacgucgacgcccacuccacccacggccgcuccaacuuccgcgacgagcgcuccuccaagaccuacgagcgccuccagaagaagcucaaggaccgccagggcacccagaaggacaagauguccuccccccccuccuccccccagaagugccccucccccaucaacgagcacaacggccucaucaagggccagaucgccggcggcaucaacaccggcuccgccaagaucaaguccggcaagggcaagggcggcacccaggucgacaccgagaucgaggagaaggacgaggagaccaaggccuucgaggcccuccucuccaacaucgucaagcccgucgccuccgacauccaggcccgcaccgucguccucaccugguccccccccuccucccucaucaacggcgagaccgacgaguccuccguccccgagcucuacggcuacgagguccucaucuccuccaccggcaaggacggcaaguacaaguccgucuacgucggcgaggagaccaacaucacccucaacgaccucaagcccgccauggacuaccacgccaagguccaggccgaguacaacuccaucaagggcacccccuccgaggccgagaucuucaccacccucuccugcgagcccgacauccccaaccccccccgcaucgccaaccgcaccaagaacucccucacccuccaguggaaggcccccuccgacaacggcuccaagauccagaacuucguccucgagugggacgagggcaagggcaacggcgaguucugccagugcuacaugggcucccagaagcaguucaagaucaccaagcucucccccgccaugggcugcaaguuccgccucuccgcccgcaacgacuacggcaccuccggcuucuccgaggagguccucuacuacaccuccggcugcgcccccuccaugcccgccucccccguccucaccaaggccggcaucaccuggcucucccuccagugguccaagcccuccggcacccccuccgacgagggcaucuccuacauccucgagauggaggaggagaccuccggcuacggcuucaagcccaaguacgacggcgaggaccucgccuacaccgucaagaaccuccgccgcuccaccaaguacaaguucaaggucaucgccuacaacuccgagggcaaguccaaccccuccgaggucgucgaguucaccaccugccccgacaagcccggcauccccgucaagcccuccgucaagggcaagauccacucccacuccuucaagaucaccugggacccccccaaggacaacggcggcgccaccaucaacaaguacgucgucgagauggccgagggcuccaacggcaacaagugggagaugaucuacuccggcgccacccgcgagcaccucugcgaccgccucaaccccggcugcuucuaccgccuccgcgucuacugcaucuccgacggcggccaguccgccgucuccgagucccuccucguccagacccccgccgucccccccggccccugccuccccccccgccuccagggccgccccaaggccaaggagauccagcuccgcuggggccccccccucgucgacggcggcucccccaucuccugcuacuccgucgagaugucccccaucgagaaggacgagccccgcgaggucuaccagggcuccgaggucgagugcaccgucuccucccuccuccccggcaagaccuacuccuuccgccuccgcgccgccaacaagaugggcuucggccccuucuccgagaagugcgacaucaccaccgcccccggcccccccgaccagugcaagcccccccaggucaccugccgcuccgccaccugcgcccaggucaacugggaggucccccucuccaacggcaccgacgucaccgaguaccgccucgaguggggcggcgucgagggcuccaugcagaucugcuacugcggccccggccucuccuacgagaucaagggccucucccccgccaccaccuacuacugccgcguccaggcccucuccgucgucggcgccggccccuucuccgaggucgucgccugcgucaccccccccuccguccccggcaucgucaccugccuccaggagaucuccgacgacgagaucgagaacccccacuacucccccuccaccugccucgccaucuccugggagaagcccugcgaccacggcuccgagauccucgccuacuccaucgacuucggcgacaagcagucccucaccgucggcaaggucaccuccuacaucaucaacaaccuccagcccgacaccaccuaccgcauccgcauccaggcccucaacucccucggcgccggccccuucucccacaugaucaagcucaagaccaagccccucccccccgaccccccccgccucgagugcgucgccuucucccaccagaaccucaagcucaaguggggcgagggcacccccaagacccucuccaccgacuccauccaguaccaccuccagauggaggacaagaacggccgcuucgucucccucuaccgcggccccugccacaccuacaagguccagcgccucaacgaguccaccuccuacaaguucugcauccaggccugcaacgaggccggcgagggcccccucucccaggaguacaucuucaccacccccaaguccguccccgccgcccucaaggcccccaagaucgagaaggucaacgaccacaucugcgagaucaccugggagugccuccagcccaugaagggcgaccccgucaucuacucccuccaggucaugcucggcaaggacuccgaguucaagcagaucuacaagggccccgacuccuccuuccgcuacuccucccuccagcucaacugcgaguaccgcuuccgcgucugcgccauccgccagugccaggacucccucggccaccaggaccucgucggccccuacuccaccaccguccucuucaucucccagcgcaccgagccccccgccuccaccaaccgcgacaccgucgaguccacccgcacccgccgcgcccucuccgacgagcagugcgccgccgucauccucguccucuucgccuucuucuccauccucaucgccuucaucauccaguacuucgucaucaaguga

SEQ ID NO: 1585 - RNA, 3597 nt, Artificial Sequence
  derived and/or modified sequence opt3 from fibronectin__Homo_sapiens__EAX08808
auggccgagcaucccccucugcucgacaccacacagauccuuagcuccgauauuucucuguugucagcuccaauagugagugcagacggcacucaacaggucaucuuaguucaggugaacccgggggaagccuucacgauuagaagggaggauggacaguuucaaugcaucaccggucccgcgcagguaccuaugaugagcccaaauggcuccgugcccccuauuuacgucccacccggguaugcuccucaggugaucgaagacaacggaguucggcgcguggucgugguaccacaggccccggaguuccaccccggcucucacacaguucugcaucgaucgccucacccaccccuaccugguuuuauaccagugcccacuaugaugccgccucccccacgucauauguacucaccugucaccggggcaggagauaugacaacccaauauaugccccaguaccagagcagucagguguauggcgacguggaugcccacuccacucacggcagaucuaauuucagggacgaacggagcuccaagacauacgagcgccuccaaaagaagcugaaagauagacaggggacccagaaggacaaaaugucaaguccacccagcucuccucaaaaguguccauccccgaucaacgagcauaauggacuuauuaagggucagaucgcuggcgggauuaacacgggaucagcaaaaaucaagagcggcaaagguaaagggggaacucaggucgauaccgaaauagaggaaaaagacgaggagacaaaggccuuugaagcucuguugaguaauauuguuaagcccguggccucugauauccaggcgaggacuguagugcucaccugguccccuccaagcucgcugauuaacggcgagacagacgaaucuuccguccccgagcuguauggcuacgaagugcucaucucaaguaccgggaaagacggaaaguacaaaagcguuuaugugggugaggagacgaauaucacuuuaaacgaucugaagccugcaauggacuaccacgccaaaguccaagcugaauauaauuccauuaagggcacaccaucugaggccgaaauauucaccacucuuagcugcgagcccgauaucccgaacccuccacggauugcaaaucgcaccaaaaacucauugacccugcaguggaaggcucccagugacaauggguccaagauccagaacuuugugcuagaaugggaugagggaaaaggcaacggugaguucugucagugcuacauggggagccaaaagcaguuuaaaauaacgaagcucucuccugccaugggcuguaaauuccgacugucagcgagaaaugacuauggaaccaguggcuuuagcgaagagguacuuuacuauacauccgggugcgcccccucuaugccagcaucgccuguucugacuaaggcuggaauuaccugguugagccuccagugguccaagcccucagguacaccaagugaugaaggcaucucuuacauccuggagauggaagaggagacuagcggguacggauucaaaccgaaguaugacggcgaagauuuagccuacaccgugaaaaaccugaggcgguccacaaaguauaaauuuaaggucauugcuuacaauucagaggguaagagcaacccuucugaaguggucgaguucaccacuugucccgacaaaccagggauccccgugaagccuuccguuaaaggcaagauucauagucacagcuucaaaauaacgugggauccacccaaggacaauggaggcgccacaaucaacaaguaugugguagagauggcagaagggucuaauggaaacaaaugggagaugauuuacuccggugccacccgugaacaccucugcgaccgccuuaauccuggcuguuuuuauagacugagggucuacugcaucucagaugggggacagagugcugugagcgagucguugcuaguucaaacuccggcggugccacccggcccuugucugccaccccggcuccagggucgaccuaaggcaaaagaaauccagcugcgcugggggccgccccuugucgacggcggauccccaauuucuugcuacagcguggagaugucaccuauagagaaggaugaacccagagagguauaucagggcagugaaguggagugcaccguuuccucucuguugccagggaaaacauacagcuucaggcuccgggccgcuaacaagaugggauuuggcccuuucuccgaaaaaugugacaucaccacugcccccgguccaccggaucaaugcaagccuccccaggucacaugucgcucagcaacgugcgcccaggugaauugggaggugccacugagcaacgggaccgacgucacugaguauagauuagaauggggaggcguugaggguaguaugcaaauuuguuacugcggccccgggcugucuuaugaaaucaagggacuauccccugcuacaaccuacuauuguagggugcaggcccucagcgugguaggcgcagggccauuuucggaggucguggcgugcguuacacccccuucagugccgggaauugucacuugucugcaggaaaucucugaugacgagauagagaauccacauuacagucccuccacaugccuugcuaucagcugggaaaaaccuugugaucacggcucugagauuuuggccuacagcaucgacuucggugauaagcagucccugacgguggggaaaguuaccucauauauuaucaacaaucuccaacccgacacaacuuaccguauacggauucaggcacugaacagucuuggagccggcccauuuagccauaugaucaagcugaaaaccaagccuuugcccccagauccuccgcgacucgaaugcguggcuuucucucaccagaaccugaaguuaaaauggggugagggcacacccaagacucuguccaccgacucaauucaguaucaucuacaaauggaggacaaaaaugggagauuuguaagucucuacaggggaccaugccacacguauaagguccagcgccugaacgaaagcacauccuacaaauucuguauccaggccugcaaugaggcaggcgaagggccucuuucucaggaguauauauuuaccacucccaagucggugccagcugccuugaaggcgccuaaaaucgaaaaggugaacgaucacauuugugagaucacaugggagugccugcaacccaugaaaggagacccggucauuuacagccuccagguuaugcugggcaaggauucagaguucaaacagaucuacaaggguccagacuccaguuuucgguauucuagcuuacaacugaauugugaauacagauucagggugugcgccauacgccagugucaggauucccuugggcaucaggacuugguaggaccuuauucaaccacuguccucuucauuucucaacgaaccgaacccccagcuagcacaaaccgggauacgguggagaguacccguacuagaagggcacuguccgacgaacagugcgccgcugugauccuaguucuguuugccuucuuuagcauccucauugcauucaucauucaguacuuugugauaaaguga

SEQ ID NO: 1586 - RNA, 3597 nt, Artificial Sequence
  derived and/or modified sequence opt4 from fibronectin__Homo_sapiens__EAX08808
auggccgagcaccccccccugcuggacaccacccagauccugagcagcgacaucagccugcugagcgcccccaucgugagcgccgacggcacccagcaggugauccuggugcaggugaaccccggcgaggccuucaccaucagaagagaggacggccaguuccagugcaucaccggccccgcccaggugcccaugaugagccccaacggcagcgugccccccaucuacgugccccccggcuacgccccccaggugaucgaggacaacggcgugagaagaguggugguggugccccaggcccccgaguuccaccccggcagccacaccgugcugcacagaagcccccaccccccccugcccggcuucauccccgugcccaccaugaugccccccccccccagacacauguacagccccgugaccggcgccggcgacaugaccacccaguacaugccccaguaccagagcagccagguguacggcgacguggacgcccacagcacccacggcagaagcaacuucagagacgagagaagcagcaagaccuacgagagacugcagaagaagcugaaggacagacagggcacccagaaggacaagaugagcagcccccccagcagcccccagaagugccccagccccaucaacgagcacaacggccugaucaagggccagaucgccggcggcaucaacaccggcagcgccaagaucaagagcggcaagggcaagggcggcacccagguggacaccgagaucgaggagaaggacgaggagaccaaggccuucgaggcccugcugagcaacaucgugaagcccguggccagcgacauccaggccagaaccguggugcugaccuggagcccccccagcagccugaucaacggcgagaccgacgagagcagcgugcccgagcuguacggcuacgaggugcugaucagcagcaccggcaaggacggcaaguacaagagcguguacgugggcgaggagaccaacaucacccugaacgaccugaagcccgccauggacuaccacgccaaggugcaggccgaguacaacagcaucaagggcacccccagcgaggccgagaucuucaccacccugagcugcgagcccgacauccccaacccccccagaaucgccaacagaaccaagaacagccugacccugcaguggaaggcccccagcgacaacggcagcaagauccagaacuucgugcuggagugggacgagggcaagggcaacggcgaguucugccagugcuacaugggcagccagaagcaguucaagaucaccaagcugagccccgccaugggcugcaaguucagacugagcgccagaaacgacuacggcaccagcggcuucagcgaggaggugcuguacuacaccagcggcugcgcccccagcaugcccgccagccccgugcugaccaaggccggcaucaccuggcugagccugcaguggagcaagcccagcggcacccccagcgacgagggcaucagcuacauccuggagauggaggaggagaccagcggcuacggcuucaagcccaaguacgacggcgaggaccuggccuacaccgugaagaaccugagaagaagcaccaaguacaaguucaaggugaucgccuacaacagcgagggcaagagcaaccccagcgaggugguggaguucaccaccugccccgacaagcccggcauccccgugaagcccagcgugaagggcaagauccacagccacagcuucaagaucaccugggacccccccaaggacaacggcggcgccaccaucaacaaguacgugguggagauggccgagggcagcaacggcaacaagugggagaugaucuacagcggcgccaccagagagcaccugugcgacagacugaaccccggcugcuucuacagacugagaguguacugcaucagcgacggcggccagagcgccgugagcgagagccugcuggugcagacccccgccgugccccccggccccugccugccccccagacugcagggcagacccaaggccaaggagauccagcugagauggggccccccccugguggacggcggcagccccaucagcugcuacagcguggagaugagccccaucgagaaggacgagcccagagagguguaccagggcagcgagguggagugcaccgugagcagccugcugcccggcaagaccuacagcuucagacugagagccgccaacaagaugggcuucggccccuucagcgagaagugcgacaucaccaccgcccccggcccccccgaccagugcaagcccccccaggugaccugcagaagcgccaccugcgcccaggugaacugggaggugccccugagcaacggcaccgacgugaccgaguacagacuggaguggggcggcguggagggcagcaugcagaucugcuacugcggccccggccugagcuacgagaucaagggccugagccccgccaccaccuacuacugcagagugcaggcccugagcguggugggcgccggccccuucagcgaggugguggccugcgugaccccccccagcgugcccggcaucgugaccugccugcaggagaucagcgacgacgagaucgagaacccccacuacagccccagcaccugccuggccaucagcugggagaagcccugcgaccacggcagcgagauccuggccuacagcaucgacuucggcgacaagcagagccugaccgugggcaaggugaccagcuacaucaucaacaaccugcagcccgacaccaccuacagaaucagaauccaggcccugaacagccugggcgccggccccuucagccacaugaucaagcugaagaccaagccccugccccccgacccccccagacuggagugcguggccuucagccaccagaaccugaagcugaaguggggcgagggcacccccaagacccugagcaccgacagcauccaguaccaccugcagauggaggacaagaacggcagauucgugagccuguacagaggccccugccacaccuacaaggugcagagacugaacgagagcaccagcuacaaguucugcauccaggccugcaacgaggccggcgagggcccccugagccaggaguacaucuucaccacccccaagagcgugcccgccgcccugaaggcccccaagaucgagaaggugaacgaccacaucugcgagaucaccugggagugccugcagcccaugaagggcgaccccgugaucuacagccugcaggugaugcugggcaaggacagcgaguucaagcagaucuacaagggccccgacagcagcuucagauacagcagccugcagcugaacugcgaguacagauucagagugugcgccaucagacagugccaggacagccugggccaccaggaccuggugggccccuacagcaccaccgugcuguucaucagccagagaaccgagccccccgccagcaccaacagagacaccguggagagcaccagaaccagaagagcccugagcgacgagcagugcgccgccgugauccuggugcuguucgccuucuucagcauccugaucgccuucaucauccaguacuucgugaucaaguga

SEQ ID NO: 1587 - RNA, 3597 nt, Artificial Sequence
  derived and/or modified sequence opt5 from fibronectin__Homo_sapiens__EAX08808
auggccgagcaucccccucugcucgacaccacacagauccugagcuccgauauuucucuucugagcgcuccgaucguguccgccgacggcacgcaacaggucauucucguucaggugaaccccggggaagcguucaccaucagacgggaggauggacaguuucaaugcauuacaggcccugcucaggugcccaugaugucuccuaaugggagcgugcccccuaucuacgucccgcccggauaugccccucagguuaucgaagacaacggcgugcgcagagucgugguugugccccaggccccugaguuccaccccgggucccacaccguccugcaucggucuccgcacccuccccuuccuggauuuauucccgugcccacaaugaugccuccgcccccucgccauauguacagccccgugaccggcgcuggcgauaugacaacccaauauaugccucaguaccaguccagccaggucuauggggacguugaugcccacucuacgcacggaagauccaauuuccgggacgaacgcagcucuaagaccuacgagagacugcaaaagaagcucaaagaucggcagggcacacagaaggacaaaauguccucucccccgagcuccccucaaaagugucccagcccuaucaacgagcauaaugggcugauuaagggacagaucgcuggcgggauuaacaccggauccgccaaaaucaagucuggcaaaggcaaagggggaacacagguggauaccgaaauugaggaaaaagacgaggagacgaaggcguuugaagcccugcucagcaauaucgugaagcccgucgcuuccgauauccaggcccgcacagugguucugaccuggagcccucccucuucccuuauuaacggcgagacagacgaaagcucugugccggagcuguauggguacgaaguccucaucagcuccaccggaaaagacggcaaguacaaaucuguguauguuggggaggagaccaauauuacacugaacgaucuuaagccugcuauggacuaccacgccaaagugcaagcggaauauaauagcaucaagggaacgcccuccgaggccgaaauuuucaccacacugagcugcgagcccgauaucccuaacccgcccagaaucgcuaaucggaccaaaaacucucucacacugcaguggaaggccccuuccgacaauggcagcaagauucagaacuuuguccuggaaugggaugagggcaaagggaacggagaguucugucagugcuacaugggcucucaaaagcaguuuaaaaucaccaagcucucccccgcuaugggguguaaauuccgccugagcgccagaaaugacuauggaacguccggcuuuucugaagaggugcuuuacuauacaagcgggugcgccccuuccaugcccgcuucuccuguccugaccaaggcgggcauuaccuggcucagccugcagugguccaagcccagcggaacaccgucugaugaaggcaucuccuacauucuugagauggaagaggagaccagcggguacggauucaaaccuaaguaugacggcgaagaucuggccuacacagugaaaaaccuccggcgcucuacgaaguauaaauuuaagguuaucgcuuacaauuccgagggaaagagcaaccccucugaaguggucgaguucaccacauguccugacaaacccgggaucccggugaagccuagcguuaaaggcaagauucauucccacagcuucaaaaucaccugggaucccccuaaggacaaugggggcgccacaauuaacaaguauguggucgagauggccgaaggaucuaauggcaacaaaugggagaugaucuacuccggggcuaccagagaacaccugugcgaccggcugaaucccggauguuuuuauagacuccgcguguacugcauuagcgauggcgggcaguccgccgugucugagagccugcuuguucaaacgcccgcggucccuccgggacccugucugccuccccggcuccagggcagaccuaaggcuaaagaaauccagcugcgcugggggcccccucuuguggacggcggauccccgauuucuugcuacagcguggagaugucccccaucgagaaggaugaaccucgggaggucuaucagggcucugaaguggagugcaccguuagcucccugcuccccgggaaaacauacagcuucagacugcgcgccgccaacaagaugggauuuggcccuuucucugaaaaaugugacaucaccacagcucccgggccgccugaucaaugcaagccuccccaggugaccugucgguccgccacgugcgcucaggucaauugggaggugccccugagcaacggaacagacguuaccgaguauagacucgaauggggcgggguggagggcucuaugcaaauuuguuacugcggacccggccuguccuaugaaaucaaggggcuuagcccugccacaaccuacuauugucgcguccaggcgcugucugugguuggagccggcccguuuuccgagguggucgcuugcgugacacccccuagcgugcccgggauugucaccugucuccaggaaaucuccgaugacgagauugagaauccucauuacagccccucuacgugccuggccaucagcugggaaaaaccgugugaucacggauccgagauccuggcuuacucuauugacuucggcgauaagcagagccuuaccguuggcaaagugacauccuauaucauuaacaaucuccaaccugacaccacauaccggauccgcauucaggcccugaacucucugggggcgggacccuuuagccauaugaucaagcucaaaaccaagccucugcccccugaucccccgagacuugaaugcguggccuucucccaccagaaccugaagcucaaauggggcgaggggacgccuaagacacugucuaccgacagcauccaguaucaucugcaaauggaggacaaaaauggacgguuugucucccuuuacagaggccccugccacaccuauaaggugcagcggcucaacgaaagcacaucuuacaaauucuguauucaggcuugcaaugaggccggggaaggaccccugucccaggaguauaucuuuaccacaccuaagagcguuccggcugcccugaaggcccccaaaauugaaaaggugaacgaucacaucugugagauuacgugggagugccuccaaccuaugaaaggcgaccccgucaucuacucucuucaggugaugcugggcaaggauuccgaguucaaacagaucuacaaggggccugacagcuccuuucgcuauucuagccugcaacucaauugugaauacagauuccggguuugcgcuauuagacagugucaggauucccugggacaucaggaccuggugggccccuauagcaccacaguccuuuucaucucucaacgcaccgaaccuccggcguccacaaaccgggauaccguggagagcacgagaacccgcagagcccucucugacgaacagugcgcugccguuauucuggugcuguuugccuucuuuagcauccucauugcuuucaucauucaguacuuugucaucaaguga

SEQ ID NO: 1588 - protein, 1142 aa, Artificial Sequence
  fibronectin__Homo_sapiens__A0A024RDV5
MSGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 1589 - RNA, 3429 nt, Artificial Sequence
  fibronectin__Homo_sapiens__EAX08809
augagugguccugcucagguuccaaugauguccccaaaugguucugugccuccuaucuaugugccuccuggauaugccccacagguuauugaagacaaugguguucgaagaguugucguggucccucaggcaccagaguuucacccugguagucacacaguucuccaccguucuccacauccuccucuaccugguuucauuccugucccaacuaugaugccgccuccaccacgucauauguacucacccgugacuggagcuggagacaugacaacacaguauaugccacaguaucagucuucacaagucuauggagauguagaugcucacucuacacauggaagguccaacuuuagagaugaacgaucuaguaaaacauaugaacguuugcagaaaaaauugaaggaucgccaaggaacacagaaagauaaaaugagcaguccaccaucaucaccccagaaaugcccuucucccauuaaugaacauaauggacuuauaaaaggacaaauugcuggugguauaaacacaggaucagcaaaaaucaagucugggaaggggaaaggugguacacaaguugauacagaaauugaagaaaaagaugaagaaacuaaagcauuugaagcacuucuuuccaacauugucaaaccaguggccuccgacauccaggcaaggacaguaguacuuaccuggucaccaccuuccagccucauuaauggugaaacagaugaaaguaguguaccagagcucuaugguuaugaaguucugaucucaaguacuggaaaagaugggaaauacaaaaguguauauguaggagaagaaacaaauaucacuuuaaaugaucucaagccagccauggauuaccaugcaaaaguccaggcagaauauaauucuauaaagggaacuccuucagaggcugaaaucuuuaccaccuugagcugugaaccugauauaccuaauccaccaaggauagccaaucggaccaaaaauucacucacuuugcaauggaaggcaccuagugacaaugguucuaaaauccaaaacuuuguauuagaaugggaugaaggaaaaggaaauggagaauuuugucaguguuacaugggcucacagaaacaauuuaaaauuacuaaacuuucaccagcaaugggcuguaaauucagacuaucggccagaaaugacuaugguacaagugguuuuagugaagaagucuuauauuacaccucaggcugugcuccuucuaugccagcaaguccuguauuaaccaaggcuggaauuacuugguuauccuuacaauggaguaagcccucaggaacaccaucagaugaaggaauuucuuacauuuuagagauggaggaagaaacuucaggauaugguuuuaagccuaaauaugauggagaagaucuugcuuacacagugaaaaaucucagacguaguacuaaguauaaauuuaagguuauugcuuacaacucagaagguaaaaguaauccaagugaaguaguagaauuuacuacuugcccugauaaaccaggcauaccuguaaagccuucagugaaaggaaagauacauucacacaguuuuaaaauaaccugggauccaccaaaagacaauggcggagcaaccaucaauaaauauguaguggagauggcagaagguucuaacggaaacaaaugggaaaugauauacaguggugcuaccagggaacaucuuugugaucgacugaauccaggcuguuucuaucguuuacgaguuuacugcaucagugauggaggacagagugcggucucugaaucuuuacuugugcagacuccagcugugccuccuggcccaugccucccucccagauuacaggguagacccaaagcaaaagaaauacaguuacgauggggacccccucugguugaugguggaucacccauuuccuguuacaguguggaaaugucuccuauagaaaaagaugaaccuagagaaguuuaccaagguucugaaguagaauguacagugagcagccuucuuccuggaaagacauacagcuucagacuacgugcagcuaacaaaaugggguuuggaccauuuucagaaaaaugugauauuacuacagccccugggccaccagaucagugcaagcccccucaagugacauguagaucugcaacuugugcacaagugaauugggagguuccuuugaguaauggaacagaugucacugaauaucgacuggaguggggaggaguugaaggaaguaugcagauauguuacugugggccuggucucaguuaugaaauaaaaggacuuucaccagcaacuaccuauuauugcaggguccaggcucugaguguugugggugcaggcccuuucagugaaguaguagccugugugacuccaccaucaguuccuggcauugugaccugucuucaagaaauaagcgaugaugagauagaaaauccccauuauucaccuucuacaugccuugcaauaagcugggaaaagccuugugaucaugguucggaaauccuugccuacagcauagacuuuggagauaaacaaucccuaacagugggaaagguuacaagcuauauuaucaacaauuugcaaccagauacaacauacagaauacgaauucaagccuugaauagccuuggagcugguccuuucagccauaugauaaaauuaaaaacuaagccucucccuccugauccaccucgucuggaauguguugccuuuagccaccagaaccuuaagcugaaauggggagaaggaacuccaaagacauugucaaccgauucuauucaguaccaccuucagauggaggauaagaauggacgguuuguaucccuauacagaggaccaugucauacauacaaaguacaaagacuuaaugagucaacauccuauaaauucuguauucaagcuuguaaugaagcuggggaagguccccucucccaagaauauauuuucacuacuccaaaaucugucccagcugccuugaaagcccccaaaauagagaaaguaaaugaucacauuugugaaauuacaugggaguguuuacagccaaugaaaggugauccaguuauuuacagucuucaaguuauguugggaaaagauucagaauucaaacagauuuacaagggucccgacucuuccuuccgguauuccagccuucagcugaacugugaauaucgcuuccguguaugugccauucgccagugccaagacucucugggacaccaggaccucguaggucccuacagcaccacagugcucuucaucucucagaggacugaaccaccagccagcaccaacagagacacuguggaaagcacaaggacccgacgggcacugagugacgagcagugugcugccgucauccuugugcuguuugcuuucuuuuccauuuugauugccuuuaucauucaguacuuuguaaucaaguga

SEQ ID NO: 1590 - RNA, 3429 nt, Artificial Sequence
  derived and/or modified sequence opt1 from fibronectin__Homo_sapiens__EAX08809
augagcggccccgcccaggugcccaugaugucccccaacgggagcgucccgcccaucuacgugccgcccggcuacgcgccccaggugaucgaggacaacgggguccgccgggugguggucgugccccaggcccccgaguuccaccccggcucccacaccgugcugcaccgcagcccccacccgccccuccccggguucauccccguccccaccaugaugccgcccccgccccggcacauguacucccccgugacgggcgccggcgacaugaccacccaguacaugccccaguaccagagcucccagguguacggggacgucgacgcccacagcacccacggccgcuccaacuuccgggacgagcgcagcuccaagacguacgagcggcugcagaagaagcugaaggaccgccaggggacccagaaggacaagaugagcuccccgcccagcagcccccagaagugccccucccccaucaacgagcacaacggccucaucaaggggcagaucgccggcggcaucaacaccggguccgccaagaucaagagcggcaaggggaagggcggcacccagguggacacggagaucgaggagaaggacgaggagaccaaggcguucgaggcccugcuguccaacaucgugaagcccgucgccagcgacauccaggcccggaccguggugcucaccuggagcccgcccuccagccugaucaacggggagacggacgaguccagcguccccgagcuguacggcuacgaggugcucaucuccagcaccgggaaggacggcaaguacaaguccguguacgucggggaggagaccaacaucacccugaacgaccugaagccggcgauggacuaccacgccaaggugcaggccgaguacaacagcaucaagggcacgcccuccgaggccgagaucuucaccacccucagcugcgagcccgacauccccaacccgccccgcaucgccaaccggaccaagaacucccugacgcugcaguggaaggcgcccagcgacaacggcuccaagauccagaacuucgugcucgagugggacgaggggaagggcaacggggaguucugccagugcuacaugggcagccagaagcaguucaagaucaccaagcugucccccgccauggggugcaaguuccgccugagcgcccggaacgacuacggcaccuccggcuucagcgaggagguccucuacuacaccuccgggugcgccccgagcaugcccgccagccccgugcugacgaaggcgggcaucaccuggcugucccuccaguggagcaagcccuccgggaccccgagcgacgagggcaucuccuacauccuggagauggaggaggagaccagcggguacggcuucaagcccaaguacgacggcgaggaccuggccuacacggucaagaaccuccgccgguccaccaaguacaaguucaaggugaucgccuacaacagcgaggggaaguccaaccccagcgagguggucgaguucacgaccugccccgacaagccgggcauccccgugaagcccuccgugaaggggaagauccacagccacuccuucaagaucaccugggacccgcccaaggacaacggcggcgccaccaucaacaaguacgucguggagauggccgaggggagcaacggcaacaagugggagaugaucuacuccggggcgacccgcgagcaccugugcgaccggcugaaccccggcugcuucuaccgccuccggguguacugcaucagcgacgggggccaguccgccgucagcgagagccugcuggugcagacccccgccgugcccccgggccccugccugcccccgcgccuccaggggcggcccaaggccaaggagauccagcugcgcuggggcccgccccucgucgacgggggcucccccaucagcugcuacuccguggagaugagccccaucgagaaggacgagccccgcgagguguaccagggguccgaggucgagugcacggugagcucccugcugcccggcaagaccuacagcuuccggcuccgcgccgcgaacaagaugggcuucgggccguucuccgagaagugcgacaucaccaccgcccccggcccgcccgaccagugcaagccgccccaggugaccugccggagcgccacgugcgcccaggucaacugggaggugccccuguccaacgggaccgacgugaccgaguaccgccuggaguggggcggggucgagggcagcaugcagaucugcuacugcggccccgggcucuccuacgagaucaagggccugagccccgcgaccacguacuacugccgggugcaggcccuguccguggucggggccggccccuucagcgaggugguggccugcgucaccccgcccuccgugcccgggaucgugaccugccuccaggagaucagcgacgacgagaucgagaacccccacuacucccccuccacgugccuggccaucagcugggagaagcccugcgaccacggcagcgagauccuggcguacagcaucgacuucggcgacaagcagucccucaccgucgggaaggugaccagcuacaucaucaacaaccugcagccggacaccaccuaccgcauccggauccaggcccugaacucccucggcgccgggcccuucagccacaugaucaagcugaagacgaagccccugcccccggacccgccccgccuggagugcguggccuucucccaccagaaccucaagcugaaguggggcgagggcacccccaagacccugagcaccgacuccauccaguaccaccuccagauggaggacaagaacgggcgguucgucagccuguaccgcggccccugccacacguacaaggugcagcggcugaacgaguccaccagcuacaaguucugcauccaggccugcaacgaggcgggggagggcccccucucccaggaguacaucuucaccacccccaagagcgugccggccgcccugaaggcccccaagaucgagaaggucaacgaccacaucugcgagaucacgugggagugccugcagcccaugaagggggaccccgugaucuacucccuccaggugaugcugggcaaggacagcgaguucaagcagaucuacaagggcccggacuccagcuuccgcuacuccagccugcagcucaacugcgaguaccgguuccgcgucugcgccauccggcagugccaggacagccuggggcaccaggaccuggugggccccuacuccaccaccguccucuucaucagccagcgcaccgagccgcccgcguccacgaaccgggacaccguggagagcacccgcacccggcgcgcccuguccgacgagcagugcgccgccgugauccugguccucuucgcguucuucagcauccugaucgccuucaucauccaguacuucgugaucaaguga

SEQ ID NO: 1591 - RNA, 3429 nt, Artificial Sequence
  derived and/or modified sequence opt2 from fibronectin__Homo_sapiens__EAX08809
auguccggccccgcccagguccccaugaugucccccaacggcuccgucccccccaucuacgucccccccggcuacgccccccaggucaucgaggacaacggcguccgccgcgucgucgucgucccccaggcccccgaguuccaccccggcucccacaccguccuccaccgcuccccccaccccccccuccccggcuucauccccguccccaccaugaugcccccccccccccgccacauguacucccccgucaccggcgccggcgacaugaccacccaguacaugccccaguaccaguccucccaggucuacggcgacgucgacgcccacuccacccacggccgcuccaacuuccgcgacgagcgcuccuccaagaccuacgagcgccuccagaagaagcucaaggaccgccagggcacccagaaggacaagauguccuccccccccuccuccccccagaagugccccucccccaucaacgagcacaacggccucaucaagggccagaucgccggcggcaucaacaccggcuccgccaagaucaaguccggcaagggcaagggcggcacccaggucgacaccgagaucgaggagaaggacgaggagaccaaggccuucgaggcccuccucuccaacaucgucaagcccgucgccuccgacauccaggcccgcaccgucguccucaccugguccccccccuccucccucaucaacggcgagaccgacgaguccuccguccccgagcucuacggcuacgagguccucaucuccuccaccggcaaggacggcaaguacaaguccgucuacgucggcgaggagaccaacaucacccucaacgaccucaagcccgccauggacuaccacgccaagguccaggccgaguacaacuccaucaagggcacccccuccgaggccgagaucuucaccacccucuccugcgagcccgacauccccaaccccccccgcaucgccaaccgcaccaagaacucccucacccuccaguggaaggcccccuccgacaacggcuccaagauccagaacuucguccucgagugggacgagggcaagggcaacggcgaguucugccagugcuacaugggcucccagaagcaguucaagaucaccaagcucucccccgccaugggcugcaaguuccgccucuccgcccgcaacgacuacggcaccuccggcuucuccgaggagguccucuacuacaccuccggcugcgcccccuccaugcccgccucccccguccucaccaaggccggcaucaccuggcucucccuccagugguccaagcccuccggcacccccuccgacgagggcaucuccuacauccucgagauggaggaggagaccuccggcuacggcuucaagcccaaguacgacggcgaggaccucgccuacaccgucaagaaccuccgccgcuccaccaaguacaaguucaaggucaucgccuacaacuccgagggcaaguccaaccccuccgaggucgucgaguucaccaccugccccgacaagcccggcauccccgucaagcccuccgucaagggcaagauccacucccacuccuucaagaucaccugggacccccccaaggacaacggcggcgccaccaucaacaaguacgucgucgagauggccgagggcuccaacggcaacaagugggagaugaucuacuccggcgccacccgcgagcaccucugcgaccgccucaaccccggcugcuucuaccgccuccgcgucuacugcaucuccgacggcggccaguccgccgucuccgagucccuccucguccagacccccgccgucccccccggccccugccuccccccccgccuccagggccgccccaaggccaaggagauccagcuccgcuggggccccccccucgucgacggcggcucccccaucuccugcuacuccgucgagaugucccccaucgagaaggacgagccccgcgaggucuaccagggcuccgaggucgagugcaccgucuccucccuccuccccggcaagaccuacuccuuccgccuccgcgccgccaacaagaugggcuucggccccuucuccgagaagugcgacaucaccaccgcccccggcccccccgaccagugcaagcccccccaggucaccugccgcuccgccaccugcgcccaggucaacugggaggucccccucuccaacggcaccgacgucaccgaguaccgccucgaguggggcggcgucgagggcuccaugcagaucugcuacugcggccccggccucuccuacgagaucaagggccucucccccgccaccaccuacuacugccgcguccaggcccucuccgucgucggcgccggccccuucuccgaggucgucgccugcgucaccccccccuccguccccggcaucgucaccugccuccaggagaucuccgacgacgagaucgagaacccccacuacucccccuccaccugccucgccaucuccugggagaagcccugcgaccacggcuccgagauccucgccuacuccaucgacuucggcgacaagcagucccucaccgucggcaaggucaccuccuacaucaucaacaaccuccagcccgacaccaccuaccgcauccgcauccaggcccucaacucccucggcgccggccccuucucccacaugaucaagcucaagaccaagccccucccccccgaccccccccgccucgagugcgucgccuucucccaccagaaccucaagcucaaguggggcgagggcacccccaagacccucuccaccgacuccauccaguaccaccuccagauggaggacaagaacggccgcuucgucucccucuaccgcggccccugccacaccuacaagguccagcgccucaacgaguccaccuccuacaaguucugcauccaggccugcaacgaggccggcgagggcccccucucccaggaguacaucuucaccacccccaaguccguccccgccgcccucaaggcccccaagaucgagaaggucaacgaccacaucugcgagaucaccugggagugccuccagcccaugaagggcgaccccgucaucuacucccuccaggucaugcucggcaaggacuccgaguucaagcagaucuacaagggccccgacuccuccuuccgcuacuccucccuccagcucaacugcgaguaccgcuuccgcgucugcgccauccgccagugccaggacucccucggccaccaggaccucgucggccccuacuccaccaccguccucuucaucucccagcgcaccgagccccccgccuccaccaaccgcgacaccgucgaguccacccgcacccgccgcgcccucuccgacgagcagugcgccgccgucauccucguccucuucgccuucuucuccauccucaucgccuucaucauccaguacuucgucaucaaguga

SEQ ID NO: 1592 - RNA, 3429 nt, Artificial Sequence
  derived and/or modified sequence opt3 from fibronectin__Homo_sapiens__EAX08809
augagcggccccgcccaggugccuaugauguccccaaacgggucugucccgcccaucuacguuccuccaggauaugcuccccaagugauugaggacaaugguguaagaaggguggucgugguuccucaggcaccagaguuccaccccggcucacauaccgugcugcaccggaguccucauccaccgcuccccggguuuauaccugucccaacaaugaugcccccuccaccccgccacauguacagcccggugacuggagccggcgauaugacgacccaguauaugccucaguaccaauccucucagguauauggugacguugaugcgcauucgacacacgggcgaucaaacuuccgugacgaaagaagcaguaagacuuacgaaaggcuucagaaaaagcugaaagaucggcagggaacccaaaaggacaaaauguccucucccccaagcuccccucagaagugccccucaccaaucaaugagcacaacggcuugauuaagggccagaucgcugggggaauuaauacagguagugccaaaaucaagagcggcaaagggaagggaggcacccagguggauacugaaauagaggagaaagacgaagagacaaaggcauuugaagccuuacugucuaacaucgucaagcccguggcuuccgauauucaagcacgcaccgugguccuaacguggucaccuccaagcagucucaucaauggugagacugacgagucuuccguuccggaacuguauggguacgaggugcuuauuagcucgaccggaaaagauggcaaguacaaaucuguauaugugggcgaagagacaaacaucacucugaaugacuugaagcccgccauggauuaccaugcuaaaguccaggccgaauauaacuccauaaaggggaccccuucagaggcggagauuuucacaacccucaguugugaaccagacauccccaauccuccaagaauugcaaacaggacgaaaaauagccugacucugcaguggaaggcccccuccgacaacggaucuaagauccaaaauuuugugcucgagugggaugaagguaaaggcaacggggaguucugccaguguuacaugggaagccagaagcaguuuaaaaucacaaaguuaucaccggcuaugggcugcaaauuccggcugagugcccgcaacgacuaugguaccuccggguuuagcgaagagguucuuuacuauacuucuggcugugcaccuucaaugccagcuagucccguguugacaaaggccggaauuaccuggcugagccuacaaugguccaagccuucuggcacgcccucggaugaggggauaagcuacauccucgaaauggaggaagagaccuccggauacgguuucaaaccaaaguaugacggcgaagaucuggcguacacagucaaaaaucuucgaagaucaacuaaguauaaauuuaaggugauugccuacaacagugaggggaagucuaauccuagcgagguaguugaguucaccacaugccccgacaaaccaggaaucccggugaagccuuccgucaaaggcaagauacacucacauagcuuuaaaauuacuugggaucccccaaaggacaacgguggggcaaccaucaauaaguauguggucgaaauggcugaaggcucuaacggaaauaaaugggagaugaucuacuccggcgccacaagggagcaccugugugaucgguugaaccccgggugcuucuaucgucuccgcguguacuguauuagugacggaggucagagcgcuguuucugaaucccuguuagugcagaccccugccguaccacccggcccuugccugccgccaagacuccaggggaggcccaaggcaaaagagauccaacuucgguggggaccuccacuggucgauggcgguucacccauuaguuguuacagcguggaaaugucgccuauagagaaggacgaaccgcgagagguuuaucagggguccgagguggaaugcacugucucuagcuugcuacccggcaaaacguacucauuccgccugagagccgcuaauaagaugggauuuggcccauucagugagaaaugcgacaucacaaccgcgccugggcccccagaucaguguaagccuccccaggugacuugcagguccgcaaccugugcccaaguaaacugggaagugccacucucuaauggaacagacguuaccgaguaucggcuggaauggggcggugucgaggggagcaugcagauuugcuacuguggaccgggccuuuccuaugagaucaagggucugagcccugcuacuacauacuauugccgcgugcaggccuugucaguggucggcgcagggcccuuuagugaaguuguggccugugugacgccacccucuguaccuggaaucgugaccugccuccaggagauuuccgaugacgaaauagagaacccacacuacagccccucgacuugucuggcuaucucaugggaaaaaccuugcgaucauggcucugagauuuuagccuacaguaucgacuucggggauaagcaaucccugacagucggaaaaguuaccagcuauauuaucaauaaccuacagccggacacaacuuacagaauaaggauccaggcacucaauucucugggcgcggguccauuuagccacaugauuaagcugaaaaccaagcccuugccucccgauccaccucgucuggaguguguggcuuucucccaucaaaaccucaagcugaaauggggagaagggacgcccaagacccuuucaacagacaguauccaguaucaccuucagauggaggauaaaaacggccgguuugucagcuuguaccgagguccaugccauacuuauaaggugcagagacucaaugaaucuaccuccuacaaauucugcauucaagccuguaacgaggcaggcgaggggccucugucacaggaauauaucuuuacaacuccgaagaguguucccgccgcuuuaaaggccccaaaaauagagaaggugaaugaccacauuugcgaaaucaccugggagugucugcagccuaugaaaggagaucccguaauuuacagccuacaggucaugcucggcaaggacuccgaguucaaacaaaucuacaaggggccagacucuucguuuagguauagcucacugcagcuuaacugcgaauaccgcuuccgggugugugcaauaagacagugccaggauuccuugggacaccaagaccuggugggcccuuauaguacgacaguccucuuuaucucucagaggaccgagcccccggcuagcacuaaucgcgauacaguugaauccacccgaacucggcgugcccugucagacgagcagugugcggccgugauuuuaguacuguucgcuuucuuuucuauccuuauugcauucaucauacaauacuuugugauuaaguga

SEQ ID NO: 1593 - RNA, 3429 nt, Artificial Sequence
  derived and/or modified sequence opt4 from fibronectin__Homo_sapiens__EAX08809
augagcggccccgcccaggugcccaugaugagccccaacggcagcgugccccccaucuacgugccccccggcuacgccccccaggugaucgaggacaacggcgugagaagaguggugguggugccccaggcccccgaguuccaccccggcagccacaccgugcugcacagaagcccccaccccccccugcccggcuucauccccgugcccaccaugaugccccccccccccagacacauguacagccccgugaccggcgccggcgacaugaccacccaguacaugccccaguaccagagcagccagguguacggcgacguggacgcccacagcacccacggcagaagcaacuucagagacgagagaagcagcaagaccuacgagagacugcagaagaagcugaaggacagacagggcacccagaaggacaagaugagcagcccccccagcagcccccagaagugccccagccccaucaacgagcacaacggccugaucaagggccagaucgccggcggcaucaacaccggcagcgccaagaucaagagcggcaagggcaagggcggcacccagguggacaccgagaucgaggagaaggacgaggagaccaaggccuucgaggcccugcugagcaacaucgugaagcccguggccagcgacauccaggccagaaccguggugcugaccuggagcccccccagcagccugaucaacggcgagaccgacgagagcagcgugcccgagcuguacggcuacgaggugcugaucagcagcaccggcaaggacggcaaguacaagagcguguacgugggcgaggagaccaacaucacccugaacgaccugaagcccgccauggacuaccacgccaaggugcaggccgaguacaacagcaucaagggcacccccagcgaggccgagaucuucaccacccugagcugcgagcccgacauccccaacccccccagaaucgccaacagaaccaagaacagccugacccugcaguggaaggcccccagcgacaacggcagcaagauccagaacuucgugcuggagugggacgagggcaagggcaacggcgaguucugccagugcuacaugggcagccagaagcaguucaagaucaccaagcugagccccgccaugggcugcaaguucagacugagcgccagaaacgacuacggcaccagcggcuucagcgaggaggugcuguacuacaccagcggcugcgcccccagcaugcccgccagccccgugcugaccaaggccggcaucaccuggcugagccugcaguggagcaagcccagcggcacccccagcgacgagggcaucagcuacauccuggagauggaggaggagaccagcggcuacggcuucaagcccaaguacgacggcgaggaccuggccuacaccgugaagaaccugagaagaagcaccaaguacaaguucaaggugaucgccuacaacagcgagggcaagagcaaccccagcgaggugguggaguucaccaccugccccgacaagcccggcauccccgugaagcccagcgugaagggcaagauccacagccacagcuucaagaucaccugggacccccccaaggacaacggcggcgccaccaucaacaaguacgugguggagauggccgagggcagcaacggcaacaagugggagaugaucuacagcggcgccaccagagagcaccugugcgacagacugaaccccggcugcuucuacagacugagaguguacugcaucagcgacggcggccagagcgccgugagcgagagccugcuggugcagacccccgccgugccccccggccccugccugccccccagacugcagggcagacccaaggccaaggagauccagcugagauggggccccccccugguggacggcggcagccccaucagcugcuacagcguggagaugagccccaucgagaaggacgagcccagagagguguaccagggcagcgagguggagugcaccgugagcagccugcugcccggcaagaccuacagcuucagacugagagccgccaacaagaugggcuucggccccuucagcgagaagugcgacaucaccaccgcccccggcccccccgaccagugcaagcccccccaggugaccugcagaagcgccaccugcgcccaggugaacugggaggugccccugagcaacggcaccgacgugaccgaguacagacuggaguggggcggcguggagggcagcaugcagaucugcuacugcggccccggccugagcuacgagaucaagggccugagccccgccaccaccuacuacugcagagugcaggcccugagcguggugggcgccggccccuucagcgaggugguggccugcgugaccccccccagcgugcccggcaucgugaccugccugcaggagaucagcgacgacgagaucgagaacccccacuacagccccagcaccugccuggccaucagcugggagaagcccugcgaccacggcagcgagauccuggccuacagcaucgacuucggcgacaagcagagccugaccgugggcaaggugaccagcuacaucaucaacaaccugcagcccgacaccaccuacagaaucagaauccaggcccugaacagccugggcgccggccccuucagccacaugaucaagcugaagaccaagccccugccccccgacccccccagacuggagugcguggccuucagccaccagaaccugaagcugaaguggggcgagggcacccccaagacccugagcaccgacagcauccaguaccaccugcagauggaggacaagaacggcagauucgugagccuguacagaggccccugccacaccuacaaggugcagagacugaacgagagcaccagcuacaaguucugcauccaggccugcaacgaggccggcgagggcccccugagccaggaguacaucuucaccacccccaagagcgugcccgccgcccugaaggcccccaagaucgagaaggugaacgaccacaucugcgagaucaccugggagugccugcagcccaugaagggcgaccccgugaucuacagccugcaggugaugcugggcaaggacagcgaguucaagcagaucuacaagggccccgacagcagcuucagauacagcagccugcagcugaacugcgaguacagauucagagugugcgccaucagacagugccaggacagccugggccaccaggaccuggugggccccuacagcaccaccgugcuguucaucagccagagaaccgagccccccgccagcaccaacagagacaccguggagagcaccagaaccagaagagcccugagcgacgagcagugcgccgccgugauccuggugcuguucgccuucuucagcauccugaucgccuucaucauccaguacuucgugaucaaguga

SEQ ID NO: 1594 - RNA, 3429 nt, Artificial Sequence
  derived and/or modified sequence opt5 from fibronectin__Homo_sapiens__EAX08809
augagcggccccgcccaggugccuaugauguccccgaacgggucugugcccccuaucuacguucccccuggauaugcuccccaagugauugaggacaauggcgugagacgggucgugguugugccucaggccccggaguuccaccccgggagccauaccguccugcaccgcuccccucaucccccucuccccggauuuaucccggugccuacaaugaugcccccuccucccagacacauguacucucccguuacgggcgcgggggauaugaccacacaguauaugccgcaguaccaaagcucccagguguauggagacgucgaugcucauucuacccacggccggagcaacuuccgcgacgaaagauccagcaagacauacgaacggcugcagaaaaagcucaaagaucgccagggcacccaaaaggacaaaaugucuuccccucccagcucuccccagaagugcccuucccccauuaaugagcacaacgggcugaucaagggacagauugccggcgggaucaauacaggaagcgccaaaaucaagucuggcaaagggaagggaggcacccagguggauacggaaauugaggagaaagacgaagagaccaaggcuuuugaagcccuccuguccaacaucgugaagccggucgcuagcgauauucaagccagaacaguugugcuuaccugguccccucccucuagccugaucaauggcgagacagacgaguccagcgugccugaacucuauggguacgagguccugauuucuuccaccggaaaagauggcaaguacaaaagcguguauguuggggaagagacgaacaucacacugaaugaccucaagcccgcgauggauuaccaugccaaagugcaggcugaauauaacucuauuaagggaaccccuagcgaggccgagaucuucacaacccuguccugugaacccgacaucccgaauccuccccggauugcuaaccgcaccaaaaauucucuuacacugcaguggaaggcccccagcgacaacggcuccaagauccaaaauuuuguccucgagugggaugaagggaaaggaaacggcgaguucugccaguguuacaugggcagccagaagcaguuuaaaauuacgaagcugucuccugcgauggggugcaaauucagacuuuccgcccggaacgacuauggaaccagcggcuuuucugaagaggugcuguacuauacauccgggugugcuccgagcaugcccgccuccccuguucucaccaaggcuggaaucacauggcugucucugcaauggagcaagcccuccggcaccccuucugaugaggggauuagcuacauccucgaaauggaggaagagacguccggcuacggauucaaacccaaguaugacggcgaagaucuggccuacacagugaaaaaucuucgcagaagcaccaaguauaaauuuaaggucaucgccuacaacucugaggggaaguccaauccuagcgagguggucgaguucaccacaugccccgacaaaccgggcauuccugugaagcccucuguuaaaggaaagauccacucccauagcuuuaaaauuaccugggauccucccaaggacaacgggggagcuacaaucaauaaguauguggucgaaauggcggaaggcucuaacgggaauaaaugggagaugauuuacagcggcgccacgcgggagcaccugugugaucgccucaacccgggaugcuucuauagacugcggguguacuguaucuccgacggcgggcagagcgcuguuucugaaucccuucuggugcagaccccugccgugcccccuggacccugccuucccccuagacugcagggccgcccgaaggccaaagagauccaacugcggugggggcccccucucgucgauggaggcagccccauuuccuguuacucuguggaaaugagcccuaucgagaaggacgaacccagagagguuuaucagggguccgaggucgaaugcacagugucuagccugcuuccuggcaaaaccuacuccuuccgccugcgggcugccaauaagaugggauuuggcccguucucugagaaaugcgacauuacaaccgcgcccgggccucccgaucaguguaagccuccccaggugacgugcagaagcgcuaccugugcccaagucaacugggaagugccgcucuccaauggaacagacguuaccgaguaucgccuggaauggggcgggguggagggaagcaugcagaucugcuacuguggcccugggcuuucuuaugagauuaagggccugucccccgccacaaccuacuauugccggguccaggcucucagcgugguuggagccggccccuuuucugaaguggucgcuugugugacgccucccuccguuccugggaucgugacaugccugcaggagauuagcgaugacgaaaucgagaacccgcacuacucucccuccaccugucuggccaucagcugggaaaaaccuugcgaucauggauccgagauucucgcguacagcaucgacuucggcgauaagcaaucucugacagucgggaaagugaccagcuauauuaucaauaaccuucagcccgacaccacauaccgcauuagaauccaggcccucaauucccugggagcuggcccuuuuucucacaugaucaagcugaaaacgaagccccugccgccugaucccccucggcuugaguguguggccuucagccaucaaaaccucaagcugaaauggggcgaagggacccccaagacacuguccaccgacucuauucaguaucaccuccagauggaggauaaaaacggaagauuugucagccuguaccgcggcccuugccauacauauaagguucagcggcuuaaugaauccaccucuuacaaauucugcauccaggcuuguaacgaggccggggagggaccccugagccaagaauauauuuuuacgacaccgaaguccgugccugcggcccucaaggcucccaaaaucgagaaggugaaugaccacauuugcgaaaucaccugggagugucugcagcccaugaaaggcgauccugucaucuacagccuucaggugaugcuggggaaggacucugaguucaaacaaauuuacaagggaccggacuccagcuuuagauauucuucccuccagcugaacugcgaauaccgguuccgcguuugugccaucagacagugccaggauagccugggccaccaagaccucgugggccccuauuccaccacaguccuguuuauuucucagcggaccgagccucccgcuagcacaaauagagauacgguggaauccacccgcacacggagagcccuuagcgacgagcagugugccgcuguuauccugguccucuucgcguucuuuucuauucugaucgccuucaucauucaauacuuugucaucaaguga

SEQ ID NO: 1595 - protein, 339 aa, Artificial Sequence
  fibronectin__Homo_sapiens__A6NH44
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 1596 - RNA, 1020 nt, Artificial Sequence
  fibronectin__Homo_sapiens__EAW49214
augccacccucaaagccucauccaccugucgugggcaaagugacucaucacagcauugaauuauacugggaucuggaaaagaaagccaaacgccaaggaccucaagagcagugguucagguucucgauugaagaagaagaccccaaaaugcacacuuaugguaucauuuauacgggauaugcaacgaagcauguuguugaaggucuggaaccaaggacgcuguacagauuucgccugaaggucaccagccccucuggggagugugaguacagcccacucgucucagugucuacaaccagagagcccauaaguagugagcacuugcaccgggcugucagugugaaugaugaagauuugcugguccgaauacuucaaggaggccguguuaagguugauguucccaauaaguuuggcuuuaccgcucugaugguugcugcccagaaaggauacaccaggcuugugaaaauccuaguuucuaauggcacagacgugaaucugaagaauggaaguggcaaggacagucuaaugcuggcgugcuaugcgggacaccuagauguugugaaauaucuccgaagacauggcgcuucuuggcaggcuagagaccugggaggcuguacagcucugcacugggcugcagauggaggccacugcagugugauugaguggaugauaaaggauggcugugagguagacgucguggacacugguucaggauggaccccacucaugagagucucugcggugucgggaaaucagaggguggccucucuucuaauugaugcuggggccaaugugaaugugaaggacagaaauggaaagacgccccuuaugguggcuguguuaaauaaucaugaagaguuaguucaguuacuucuugacaaaggggcagaugcaaguguaaaaaaugaguucggcaaagguguccuagaaauggccagaguuuuugacagacagaguguagucuccuuauuagaagaaaggaaaaaaaagcagaggccaaagaagucuugugucugcuga

SEQ ID NO: 1597 - RNA, 1020 nt, Artificial Sequence
  derived and/or modified sequence opt1 from fibronectin__Homo_sapiens__EAW49214
augcccccgagcaagccccacccgcccguggucggcaaggugacccaccacagcaucgagcuguacugggaccucgagaagaaggccaagcgccaggggccccaggagcagugguuccgguucagcaucgaggaggaggaccccaagaugcacaccuacggcaucaucuacacgggguacgccaccaagcacguggucgagggccuggagccccgcacccuguaccgguuccgccucaaggugaccucccccagcggggagugcgaguacuccccgcuggugagcgucuccacgacccgggagcccaucagcuccgagcaccuccaccgcgcggugagcgugaacgacgaggaccugcugguccggauccugcagggcggccgcgugaagguggacguccccaacaaguucggguucaccgcccucaugguggccgcccagaagggcuacacccggcuggugaagauccuggucuccaacgggacggacgugaaccucaagaacggcagcgggaaggacucccugaugcuggccugcuacgcgggccaccucgacguggucaaguaccugcgccggcacggcgccagcuggcaggcccgcgaccucgggggcugcaccgcccugcacugggcggccgacgggggccacugcuccgugaucgaguggaugaucaaggacggcugcgagguggacgucguggacaccgggagcggcuggacgccccugaugcggguguccgccgucagcgggaaccagcgcguggccucccugcucaucgacgccggcgcgaacgucaacgugaaggaccggaacgggaagaccccgcugaugguggccguccugaacaaccacgaggagcucgugcagcugcugcucgacaagggcgccgacgccagcgugaagaacgaguucggcaaggggguccuggagauggcccgcguguucgaccggcagagcguggucucccugcucgaggagcgcaagaagaagcagcggcccaagaaguccugcgugugcuga

SEQ ID NO: 1598 - RNA, 1020 nt, Artificial Sequence
  derived and/or modified sequence opt2 from fibronectin__Homo_sapiens__EAW49214
augccccccuccaagccccacccccccgucgucggcaaggucacccaccacuccaucgagcucuacugggaccucgagaagaaggccaagcgccagggcccccaggagcagugguuccgcuucuccaucgaggaggaggaccccaagaugcacaccuacggcaucaucuacaccggcuacgccaccaagcacgucgucgagggccucgagccccgcacccucuaccgcuuccgccucaaggucaccucccccuccggcgagugcgaguacuccccccucgucuccgucuccaccacccgcgagcccaucuccuccgagcaccuccaccgcgccgucuccgucaacgacgaggaccuccucguccgcauccuccagggcggccgcgucaaggucgacguccccaacaaguucggcuucaccgcccucauggucgccgcccagaagggcuacacccgccucgucaagauccucgucuccaacggcaccgacgucaaccucaagaacggcuccggcaaggacucccucaugcucgccugcuacgccggccaccucgacgucgucaaguaccuccgccgccacggcgccuccuggcaggcccgcgaccucggcggcugcaccgcccuccacugggccgccgacggcggccacugcuccgucaucgaguggaugaucaaggacggcugcgaggucgacgucgucgacaccggcuccggcuggaccccccucaugcgcgucuccgccgucuccggcaaccagcgcgucgccucccuccucaucgacgccggcgccaacgucaacgucaaggaccgcaacggcaagaccccccucauggucgccguccucaacaaccacgaggagcucguccagcuccuccucgacaagggcgccgacgccuccgucaagaacgaguucggcaagggcguccucgagauggcccgcgucuucgaccgccaguccgucgucucccuccucgaggagcgcaagaagaagcagcgccccaagaaguccugcgucugcuga

SEQ ID NO: 1599 - RNA, 1020 nt, Artificial Sequence
  derived and/or modified sequence opt3 from fibronectin__Homo_sapiens__EAW49214
augcccccuagcaagccacacccgcccguggucggcaaaguuacccaucacuccaucgagcuguacugggaccucgaaaagaaagccaagagacaggggccucaagagcagugguucagguuuucuauugaagaggaagauccaaaaaugcauacauauggaauaaucuacacugguuaugcuacgaagcacgugguagagggccuugagccccggacccuguaccgcuuccgauugaaggugacaucaccuaguggggaaugcgaguauagcccauuagucuccgugucuacuacccgugaacccauuucgucagagcaucugcacagagcaguuagcgugaacgacgaggaucuacucgucaggauccugcagggaggccgggugaaaguagacguuccuaauaaguuugguuucacagcccuuaugguggcggcucagaaaggguacacccgccuggucaagauuuuggugaguaacggaacugaugugaaucucaaaaacggcuccggcaaggacucucugaugcuggccuguuaugcagggcaccucgaugucguuaaguacuuaagaaggcauggagccagcuggcaagcucgggaccuggguggcugcacagcacuucacugggccgcugaugggggacauuguuccgugaucgaauggaugauaaaagacggcugcgagguagauguggucgacaccgguucaggguggacgccauugaugcgcgugagugccguuagcggaaaucagcgaguggcgucucugcuaaucgaugcaggcgccaacgucaaugugaaggacagaaacggcaaaacuccgcucaugguagcuguucugaauaaccacgaggaacuugugcagcuguugcucgacaagggggccgaugcauccgucaaaaaugaauuuggaaagggugugcuggagauggcuagggucuucgaccggcagucagugguuagcuuacuggaggaacguaaaaagaagcaacgccccaaaaagaguugugugugcuga

SEQ ID NO: 1600 - RNA, 1020 nt, Artificial Sequence
  derived and/or modified sequence opt4 from fibronectin__Homo_sapiens__EAW49214
augccccccagcaagccccacccccccguggugggcaaggugacccaccacagcaucgagcuguacugggaccuggagaagaaggccaagagacagggcccccaggagcagugguucagauucagcaucgaggaggaggaccccaagaugcacaccuacggcaucaucuacaccggcuacgccaccaagcacgugguggagggccuggagcccagaacccuguacagauucagacugaaggugaccagccccagcggcgagugcgaguacagcccccuggugagcgugagcaccaccagagagcccaucagcagcgagcaccugcacagagccgugagcgugaacgacgaggaccugcuggugagaauccugcagggcggcagagugaagguggacgugcccaacaaguucggcuucaccgcccugaugguggccgcccagaagggcuacaccagacuggugaagauccuggugagcaacggcaccgacgugaaccugaagaacggcagcggcaaggacagccugaugcuggccugcuacgccggccaccuggacguggugaaguaccugagaagacacggcgccagcuggcaggccagagaccugggcggcugcaccgcccugcacugggccgccgacggcggccacugcagcgugaucgaguggaugaucaaggacggcugcgagguggacgugguggacaccggcagcggcuggaccccccugaugagagugagcgccgugagcggcaaccagagaguggccagccugcugaucgacgccggcgccaacgugaacgugaaggacagaaacggcaagaccccccugaugguggccgugcugaacaaccacgaggagcuggugcagcugcugcuggacaagggcgccgacgccagcgugaagaacgaguucggcaagggcgugcuggagauggccagaguguucgacagacagagcguggugagccugcuggaggagagaaagaagaagcagagacccaagaagagcugcgugugcuga

SEQ ID NO: 1601 - RNA, 1020 nt, Artificial Sequence
  derived and/or modified sequence opt5 from fibronectin__Homo_sapiens__EAW49214
augcccccuagcaagccgcaucccccuguggucggcaaaguuacccaccacuccaucgagcuguacugggaccucgaaaagaaagccaagagacaggggccccaagagcagugguuccgguuuucuauugaagaggaagauccuaaaaugcauacauauggaaucauuuacacgggcuaugcuaccaagcacgugguggaggggcuggagccccgcacacuuuacagauuccggcugaaggucaccagcccuuccggagaaugcgaguauucuccgcucgugagcguuuccacaacccgcgaacccaucucuagcgagcaucugcacagagccguguccgucaacgacgaggaucuucuggugcggauucuccagggcgggcgcguuaaaguggacgucccuaauaaguuuggauucacagcgcugaugguggcugcccagaaaggcuacaccagacuggugaagauccucgucagcaacggcacggauguuaaucugaaaaacgggucuggaaaggacucccuuaugcuggccuguuaugcuggccaccucgauguggugaaguaccugcggcgccauggggccagcuggcaagcuagagaccuuggaggcugcaccgcccugcacugggcggccgaugggggacauuguucugucaucgaauggaugauuaaagacggcugcgagguggauguuguggacacaggcuccggguggacaccccucaugcgggucagcgcugugucuggaaaucagcgcguugccucccugcugaucgaugcuggcgccaacgugaaugucaaggacagaaacgggaaaaccccucucaugguggcgguccugaauaaccacgaggaacuugugcagcugcuccuggacaagggagccgaugcuagcguuaaaaaugaauuuggcaagggggugcuugagauggcccgggucuucgaccgccaguccgugguuucucugcucgaggaacggaaaaagaagcaaagacccaaaaagagcugugugugcuga

SEQ ID NO: 1602 - protein, 1049 aa, Artificial Sequence [sequence omitted]

SEQ ID NO: 1603 - RNA, 3150 nt, Artificial Sequence
  fibronectin__Homo_sapiens__BAF84259
auggggagccggacgccagaguccccucuccacgccgugcagcugcgcuggggcccccggcgccgacccccgcugcugccgcugcuguugcugcugcugccgccgccacccagggucgggggcuucaacuuagacgcggaggccccagcaguacucucggggcccccgggcuccuucuucggauucucaguggaguuuuaccggccgggaacagacggggucagugugcuggugggagcacccaaggcuaauaccagccagccaggagugcugcaggguggugcugucuaccucuguccuuggggugccagccccacucagugcacccccauugaauuugacagcaaaggcucucggcuccuggaguccucacuguccagcucagagggagaggagccuguggaguacaaguccuugcagugguucggggcaacaguucgagcccauggcuccuccaucuuggcaugcgcuccacuguacagcuggcgcacagagaaggagccacugagcgaccccgugggcaccugcuaccucuccacagauaacuucacccgaauucuggaguaugcacccugccgcucagauuucagcugggcagcaggacaggguuacugccaaggaggcuucagugccgaguucaccaagacuggccgugugguuuuagguggaccaggaagcuauuucuggcaaggccagauccugucugccacucaggagcagauugcagaaucuuauuaccccgaguaccugaucaaccugguucaggggcagcugcagacucgccaggccaguuccaucuaugaugacagcuaccuaggauacucuguggcuguuggugaauucaguggugaugacacagaagacuuuguugcuggugugcccaaagggaaccucacuuacggcuaugucaccauccuuaauggcucagacauucgaucccucuacaacuucucaggggaacagauggccuccuacuuugccuaugcaguggccgccacagacgucaauggggacgggcuggaugacuugcuggugggggcaccccugcucauggaucggaccccugacgggcggccucaggaggugggcagggucuacgucuaccugcagcacccagccggcauagaguccacgcccacccuuacccucacuggccaugaugaguuuggccgauuuggcagcuccuugaccccccugggggaccuggaccaggauggcuacaaugauguggccaucggggcucccuuugguggggagacccagcagggaguaguguuuguauuuccugggggcccaggagggcugggcucuaagccuucccagguucugcagccccugugggcagccagccacaccccagacuucuuuggcucugcccuucgaggaggccgagaccuggauggcaauggauauccugaucugauugugggguccuuugguguggacaaggcugugguauacaggggccgccccaucguguccgcuagugccucccucaccaucuuccccgccauguucaacccagaggagcggagcugcagcuuagaggggaacccuguggccugcaucaaccuuagcuucugccucaaugcuucuggaaaacacguugcugacuccauugguuucacaguggaacuucagcuggacuggcagaagcagaagggagggguacggcgggcacuguuccuggccuccaggcaggcaacccugacccagacccugcucauccagaauggggcucgagaggauugcagagagaugaagaucuaccucaggaacgagucagaauuucgagacaaacucucgccgauucacaucgcucucaacuucuccuuggacccccaagccccaguggacagccacggccucaggccagcccuacauuaucagagcaagagccggauagaggacaaggcucagaucuugcugggcuguggagaagacaacaucugugugccugaccugcagcuggaaguguuuggggagcagaaccauguguaccugggugacaagaaugcccugaaccucacuuuccaugcccagaaugugggugaggguggcgccuaugaggcugagcuucgggucaccgccccuccagaggcugaguacucaggacucgucagacacccagggaacuucuccagccugagcugugacuacuuugccgugaaccagagccgccugcuggugugugaccugggcaaccccaugaaggcaggagccagucugugggguggccuucgguuuacagucccucaucuccgggacacuaagaaaaccauccaguuugacuuccagauccucagcaagaaucucaacaacucgcaaagcgacgugguuuccuuucggcucuccguggaggcucaggcccaggucacccugaacggugucuccaagccugaggcagugcuauucccaguaagcgacuggcauccccgagaccagccucaggaggaggaggaccugggaccugcuguccaccaugucuaugagcucaucaaccaaggccccagcuccauuagccagggugugcuggaacucagcuguccccaggcucuggaaggucagcagcuccuauaugugaccagaguuacgggacucaacugcaccaccaaucaccccauuaacccaaagggccuggaguuggaucccgaggguucccugcaccaccagcaaaaacgggaagcuccaagccgcagcucugcuuccucgggaccucagauccugaaaugcccggaggcugaguguuucaggcugcgcugugagcucgggccccugcaccaacaagagagccaaagucugcaguugcauuuccgagucugggccaagacuuucuugcagcgggagcaccagccauuuagccugcagugugaggcuguguacaaagcccugaagaugcccuaccgaauccugccucggcagcugccccaaaaagagcgucagguggccacagcugugcaauggaccaaggcagaaggcagcuauggcgucccacuguggaucaucauccuagccauccuguuuggccuccugcuccuaggucuacucaucuacauccucuacaagcuuggauucuucaaacgcucccucccauauggcaccgccauggaaaaagcucagcucaagccuccagccaccucugaugccuga

SEQ ID NO: 1604 - RNA, 3150 nt, Artificial Sequence
  derived and/or modified sequence opt1 from fibronectin__Homo_sapiens__BAF84259
augggcagccgcacccccgaguccccgcugcacgccgugcagcuccggugggggccccgccggcgccccccccugcugccgcuccugcugcuccugcugcccccccccccgcgggucggcggguucaaccucgacgccgaggcgcccgccgugcugagcggcccccccggguccuucuucggcuucagcguggaguucuaccgcccgggcaccgacggggucuccgugcuggugggcgcccccaaggccaacacgagccagcccgggguccuccagggcggggccguguaccugugccccuggggcgcguccccgacccagugcacccccaucgaguucgacagcaagggcucccggcugcucgagagcucccugagcuccagcgagggggaggagcccguggaguacaagucccugcagugguucggcgccaccguccgcgcccacgggagcuccauccucgccugcgcgccccuguacagcuggcggacggagaaggagccgcuguccgaccccgugggcaccugcuaccucagcaccgacaacuucacccgcauccuggaguacgcccccugccggagcgacuucuccugggccgccggccagggguacugccagggcggguucagcgccgaguucacgaagaccggccgcgugguccuggggggccccggcuccuacuucuggcaggggcagauccucagcgcgacccaggagcagaucgccgaguccuacuacccggaguaccugaucaaccuggugcagggccagcuccagacccggcaggccagcuccaucuacgacgacagcuaccugggguacuccguggccgucggcgaguucagcggggacgacacggaggacuucguggccggcgugcccaagggcaaccugaccuacggguacgucaccauccucaacggcuccgacauccgcagccuguacaacuucuccggggagcagauggcgagcuacuucgccuacgccguggccgccaccgacgugaacggcgacgggcuggacgaccuccuggucggcgcgccccugcucauggaccggacgcccgacggccgcccgcaggagguggggcggguguacgucuaccugcagcaccccgccggcaucgaguccacccccacccugacccucacggggcacgacgaguucggccgcuucggcagcucccugaccccgcugggggaccucgaccaggacggcuacaacgacguggccaucggggcccccuucggcggggagacccagcagggcgucguguucguguuccccggcgggcccggcgggcugggcagcaagccgucccagguccugcagccccucugggccgcgagccacacccccgacuucuucgggagcgcccugcggggcggccgcgaccuggacgggaacggcuaccccgaccucaucgugggguccuucggcguggacaaggccgucguguaccgggggcgcccgaucgugagcgccuccgcgagccugacgaucuuccccgccauguucaaccccgaggagcgcuccugcagccuggagggcaaccccgucgccugcaucaaccuguccuucugccucaacgccagcggcaagcacguggccgacuccaucggguucaccguggagcugcagcuggacuggcagaagcagaagggcgggguccggcgcgcgcucuuccuggccagccggcaggccacccugacccagacgcuccugauccagaacggcgcccgcgaggacugccgggagaugaagaucuaccugcgcaacgaguccgaguuccgggacaagcucagcccgauccacaucgcccugaacuucucccuggacccccaggcgcccguggacagccacgggcuccgccccgcccugcacuaccaguccaagagccggaucgaggacaaggcccagauccugcucggcugcggcgaggacaacaucugcgugccggaccugcagcuggaggucuucggggagcagaaccacguguaccucggcgacaagaacgcccugaaccugaccuuccacgcccagaacgugggggagggcggcgcguacgaggccgagcuccgcgucaccgccccccccgaggccgaguacuccgggcuggugcggcaccccggcaacuucagcagccuguccugcgacuacuucgcggugaaccagagccgccuccuggucugcgaccuggggaacccgaugaaggccggcgccucccucugggggggccugcgguucaccgugccccaccugcgcgacacgaagaagaccauccaguucgacuuccagauccucagcaagaaccugaacaacucccagagcgacguggucuccuuccggcugagcguggaggcccaggcccaggugacccucaacggcgucuccaagcccgaggcggugcuguuccccgugagcgacuggcacccgcgcgaccagccccaggaggaggaggaccuggggcccgccguccaccacguguacgagcucaucaaccagggcccguccagcaucucccagggggugcuggagcugagcugcccccaggcccucgagggccagcagcugcuguacgucacccgggugacggggcucaacugcaccaccaaccaccccaucaaccccaagggccuggagcuggacccggagggcucccuccaccaccagcagaagcgcgaggcccccagccgguccagcgccuccagcgggccccagauccugaagugccccgaggcggagugcuuccgccugcgcugcgagcucggcccgcugcaccagcaggagagccagucccugcagcuccacuuccgggugugggccaagaccuuccugcagcgcgagcaccagcccuucagccugcagugcgaggccgucuacaaggcccucaagaugcccuaccggauccugccccgccagcugccgcagaaggagcggcagguggccaccgcggugcaguggacgaaggccgagggguccuacggcgucccccucuggaucaucauccuggccauccuguucgggcuccugcugcucggccugcugaucuacauccucuacaagcugggcuucuucaagcgcagccugcccuacgggaccgccauggagaaggcgcagcucaagcccccggccaccuccgacgccuga

SEQ ID NO: 1605 - RNA, 3150 nt, Artificial Sequence
  derived and/or modified sequence opt2 from fibronectin__Homo_sapiens__BAF84259
augggcucccgcacccccgaguccccccuccacgccguccagcuccgcuggggcccccgccgccgccccccccuccucccccuccuccuccuccuccuccccccccccccccgcgucggcggcuucaaccucgacgccgaggcccccgccguccucuccggcccccccggcuccuucuucggcuucuccgucgaguucuaccgccccggcaccgacggcgucuccguccucgucggcgcccccaaggccaacaccucccagcccggcguccuccagggcggcgccgucuaccucugccccuggggcgccucccccacccagugcacccccaucgaguucgacuccaagggcucccgccuccucgaguccucccucuccuccuccgagggcgaggagcccgucgaguacaagucccuccagugguucggcgccaccguccgcgcccacggcuccuccauccucgccugcgccccccucuacuccuggcgcaccgagaaggagccccucuccgaccccgucggcaccugcuaccucuccaccgacaacuucacccgcauccucgaguacgcccccugccgcuccgacuucuccugggccgccggccagggcuacugccagggcggcuucuccgccgaguucaccaagaccggccgcgucguccucggcggccccggcuccuacuucuggcagggccagauccucuccgccacccaggagcagaucgccgaguccuacuaccccgaguaccucaucaaccucguccagggccagcuccagacccgccaggccuccuccaucuacgacgacuccuaccucggcuacuccgucgccgucggcgaguucuccggcgacgacaccgaggacuucgucgccggcguccccaagggcaaccucaccuacggcuacgucaccauccucaacggcuccgacauccgcucccucuacaacuucuccggcgagcagauggccuccuacuucgccuacgccgucgccgccaccgacgucaacggcgacggccucgacgaccuccucgucggcgccccccuccucauggaccgcacccccgacggccgcccccaggaggucggccgcgucuacgucuaccuccagcaccccgccggcaucgaguccacccccacccucacccucaccggccacgacgaguucggccgcuucggcuccucccucaccccccucggcgaccucgaccaggacggcuacaacgacgucgccaucggcgcccccuucggcggcgagacccagcagggcgucgucuucgucuuccccggcggccccggcggccucggcuccaagcccucccagguccuccagccccucugggccgccucccacacccccgacuucuucggcuccgcccuccgcggcggccgcgaccucgacggcaacggcuaccccgaccucaucgucggcuccuucggcgucgacaaggccgucgucuaccgcggccgccccaucgucuccgccuccgccucccucaccaucuuccccgccauguucaaccccgaggagcgcuccugcucccucgagggcaaccccgucgccugcaucaaccucuccuucugccucaacgccuccggcaagcacgucgccgacuccaucggcuucaccgucgagcuccagcucgacuggcagaagcagaagggcggcguccgccgcgcccucuuccucgccucccgccaggccacccucacccagacccuccucauccagaacggcgcccgcgaggacugccgcgagaugaagaucuaccuccgcaacgaguccgaguuccgcgacaagcucucccccauccacaucgcccucaacuucucccucgacccccaggcccccgucgacucccacggccuccgccccgcccuccacuaccaguccaagucccgcaucgaggacaaggcccagauccuccucggcugcggcgaggacaacaucugcguccccgaccuccagcucgaggucuucggcgagcagaaccacgucuaccucggcgacaagaacgcccucaaccucaccuuccacgcccagaacgucggcgagggcggcgccuacgaggccgagcuccgcgucaccgccccccccgaggccgaguacuccggccucguccgccaccccggcaacuucuccucccucuccugcgacuacuucgccgucaaccagucccgccuccucgucugcgaccucggcaaccccaugaaggccggcgccucccucuggggcggccuccgcuucaccgucccccaccuccgcgacaccaagaagaccauccaguucgacuuccagauccucuccaagaaccucaacaacucccaguccgacgucgucuccuuccgccucuccgucgaggcccaggcccaggucacccucaacggcgucuccaagcccgaggccguccucuuccccgucuccgacuggcacccccgcgaccagccccaggaggaggaggaccucggccccgccguccaccacgucuacgagcucaucaaccagggccccuccuccaucucccagggcguccucgagcucuccugcccccaggcccucgagggccagcagcuccucuacgucacccgcgucaccggccucaacugcaccaccaaccaccccaucaaccccaagggccucgagcucgaccccgagggcucccuccaccaccagcagaagcgcgaggcccccucccgcuccuccgccuccuccggcccccagauccucaagugccccgaggccgagugcuuccgccuccgcugcgagcucggcccccuccaccagcaggagucccagucccuccagcuccacuuccgcgucugggccaagaccuuccuccagcgcgagcaccagcccuucucccuccagugcgaggccgucuacaaggcccucaagaugcccuaccgcauccucccccgccagcucccccagaaggagcgccaggucgccaccgccguccaguggaccaaggccgagggcuccuacggcgucccccucuggaucaucauccucgccauccucuucggccuccuccuccucggccuccucaucuacauccucuacaagcucggcuucuucaagcgcucccuccccuacggcaccgccauggagaaggcccagcucaagccccccgccaccuccgacgccuga

SEQ ID NO: 1606 - RNA, 3150 nt, Artificial Sequence
  derived and/or modified sequence opt3 from fibronectin__Homo_sapiens__BAF84259
augggcagcagaacccccgaguccccucugcacgccgugcagcucaggugggggccacggcgccgaccgccccuucugccuuuguuacugcuacuccugccacccccuccacgugucggagguuucaaccuugacgcugaagcacccgccguucugucuggcccuccagggucauuuuucggauuuaguguggaguucuacagaccgggcacagaugguguaagcguguuggucggggcgcccaaggcuaauacuucccaaccuggagugcuccagggcggcgccguuuaucugugcccauggggagcaucucccacgcaguguaccccuaucgaauuugacucgaaaggaucaaggcugcucgagagcaguuuauccucuagcgaaggugaggagccaguggaauacaagucccugcagugguucggcgccacaguccgggcucaugggucaaguauucuugcaugcgcccccuuguauagcuggcgcacugagaaagaaccgcugucugauccugugggaaccuguuaccuauccacagacaacuuuaccagaauacucgaguaugcucccugcaggucagauuucagcugggccgcgggccaagguuacugucaagggggauuuagugcagaguucacuaagacaggccggguaguucugggcgggccaggaucuuauuuuuggcagggucagauccuuuccgccacccaggaacagauugcugagagcuacuacccugaauaucugaucaauuuggugcagggccagcuccaaacgcgccaggccucgucuauuuacgacgauuccuaucugggguacucagucgcagugggagaguucaguggcgacgauacugaagacuuuguggcugguguccccaaagggaacuuaaccuauggcuacguuacaauccugaauggaagcgauauacgaucccucuauaacuucucuggcgagcagauggccagcuacuucgcguacgccguggcagcuacugacguaaauggggauggacuugacgaccuguuggugggugccccacuacugauggauagaacccccgacggcaggccucaagaggucgggcggguguauguuuaccuccagcacccagcuggaaucgaaucaacaccgacccugacgcuuacuggccaugaugaguuuggucguuucgggaguucccugacacccuugggcgaccucgaucaggacggauauaacgauguggccauuggcgcaccuuuugggggagaaacccagcaaggugucguguucguauuuccaggcgggcccggaggccuggguagcaagccuucucagguuuuacagccacugugggccgcuucacacacucccgacuucuuugggagugcgcuacgcggcggaagagaucucgacggcaauggguacccggaucugaucguggggagcuucggcgucgacaaggcaguggucuauaggggucggccuauuguguccgccucugcuucgcuuacaaucuuuccagccauguucaaccccgaggaacgaagcugcuccuuggaggggaauccuguugcauguauaaaccugucauuuugccucaaugccaguggaaaacauguggcugacucuauuggcuucaccguagagcugcagcuugauuggcaaaagcagaaagguggcguccgcagagcccuguuuuuggcaagcaggcaggcgacgcucacccagacacuguuaauccaaaacggggcucgggaagacugucgcgagaugaagauuuaccugagaaaugaauccgaguucagggauaaacuaucacccauccacaucgcccucaacuucagccuggacccacaggcaccuguggauucucacggacuucgucccgccuugcauuaucaguccaagagucggauugaagacaaggcucagauacugcucggcugcggggaggauaacaucuguguuccagaccugcaauuagagguguuuggagaacagaaucacgucuaccugggcgauaaaaacgcccuuaauuugacuuuccaugcacagaacgugggugaagggggagcuuacgaggccgagcuccgaguaaccgcgccgccugaggccgaauauagcggccuggugagacaccccgguaauuuuucuucccuaucaugcgacuacuucgcuguuaaccaaaguaggcugcucgucugcgaucugggcaauccaaugaaggcaggggccagccuuuggggaggcuugcgcuuuacagugccccacuugcgggacacuaaaaagaccauucaguucgauuuucagaucuuaucgaaaaaccucaauaacucccagucugacguggucagcuucagacugucaguugaggcucaagcccaggugacacuuaauggggugaguaagccugaagcaguacuguuuccagucuccgacuggcaucccagggaucagccucaggaggaagaggacuugggaccggcggugcaccauguuuaugagcucauaaaccaaggcccaucuagcauuucccagggugugcuggaacuaucauguccccaggcccuggaggggcagcaacuccuguacgucacccgcgugacuggacuuaauugcacgacaaaccacccuaucaauccaaaaggcuuggaacuggaucccgaggguagcuuacaucaccagcagaagcgagaagcuccuagucggucuuccgccagcucgggcccgcaaauccucaagugucccgaggcagagugcuuccgucugagaugugaacuugggccacugcaccagcaggagucacagucucuacaacuccauuuuaggguuugggcuaaaaccuuccugcagcgcgaacaccagccuuuuaguuugcagugcgaggccguguauaaggcacugaaaaugcccuaccggauuuuaccaagacaacucccucagaaggaaaggcagguagccacugcuguccaguggaccaaagcggagggauccuauggcgugccccuguggaucauuauacuugccauccuguucggguugcuccugcuaggacugcuuauuuacauccucuacaagcugggcuucuuuaagcgaagccugccauaugguacagcaauggagaaagcucaacugaagccgccugccaccucugacgccuga

SEQ ID NO: 1607 - RNA, 3150 nt, Artificial Sequence
  derived and/or modified sequence opt4 from fibronectin__Homo_sapiens__BAF84259
augggcagcagaacccccgagagcccccugcacgccgugcagcugagauggggccccagaagaagacccccccugcugccccugcugcugcugcugcugccccccccccccagagugggcggcuucaaccuggacgccgaggcccccgccgugcugagcggcccccccggcagcuucuucggcuucagcguggaguucuacagacccggcaccgacggcgugagcgugcuggugggcgcccccaaggccaacaccagccagcccggcgugcugcagggcggcgccguguaccugugccccuggggcgccagccccacccagugcacccccaucgaguucgacagcaagggcagcagacugcuggagagcagccugagcagcagcgagggcgaggagcccguggaguacaagagccugcagugguucggcgccaccgugagagcccacggcagcagcauccuggccugcgccccccuguacagcuggagaaccgagaaggagccccugagcgaccccgugggcaccugcuaccugagcaccgacaacuucaccagaauccuggaguacgcccccugcagaagcgacuucagcugggccgccggccagggcuacugccagggcggcuucagcgccgaguucaccaagaccggcagaguggugcugggcggccccggcagcuacuucuggcagggccagauccugagcgccacccaggagcagaucgccgagagcuacuaccccgaguaccugaucaaccuggugcagggccagcugcagaccagacaggccagcagcaucuacgacgacagcuaccugggcuacagcguggccgugggcgaguucagcggcgacgacaccgaggacuucguggccggcgugcccaagggcaaccugaccuacggcuacgugaccauccugaacggcagcgacaucagaagccuguacaacuucagcggcgagcagauggccagcuacuucgccuacgccguggccgccaccgacgugaacggcgacggccuggacgaccugcuggugggcgccccccugcugauggacagaacccccgacggcagaccccaggaggugggcagaguguacguguaccugcagcaccccgccggcaucgagagcacccccacccugacccugaccggccacgacgaguucggcagauucggcagcagccugaccccccugggcgaccuggaccaggacggcuacaacgacguggccaucggcgcccccuucggcggcgagacccagcagggcgugguguucguguuccccggcggccccggcggccugggcagcaagcccagccaggugcugcagccccugugggccgccagccacacccccgacuucuucggcagcgcccugagaggcggcagagaccuggacggcaacggcuaccccgaccugaucgugggcagcuucggcguggacaaggccgugguguacagaggcagacccaucgugagcgccagcgccagccugaccaucuuccccgccauguucaaccccgaggagagaagcugcagccuggagggcaaccccguggccugcaucaaccugagcuucugccugaacgccagcggcaagcacguggccgacagcaucggcuucaccguggagcugcagcuggacuggcagaagcagaagggcggcgugagaagagcccuguuccuggccagcagacaggccacccugacccagacccugcugauccagaacggcgccagagaggacugcagagagaugaagaucuaccugagaaacgagagcgaguucagagacaagcugagccccauccacaucgcccugaacuucagccuggacccccaggcccccguggacagccacggccugagacccgcccugcacuaccagagcaagagcagaaucgaggacaaggcccagauccugcugggcugcggcgaggacaacaucugcgugcccgaccugcagcuggagguguucggcgagcagaaccacguguaccugggcgacaagaacgcccugaaccugaccuuccacgcccagaacgugggcgagggcggcgccuacgaggccgagcugagagugaccgccccccccgaggccgaguacagcggccuggugagacaccccggcaacuucagcagccugagcugcgacuacuucgccgugaaccagagcagacugcuggugugcgaccugggcaaccccaugaaggccggcgccagccuguggggcggccugagauucaccgugccccaccugagagacaccaagaagaccauccaguucgacuuccagauccugagcaagaaccugaacaacagccagagcgacguggugagcuucagacugagcguggaggcccaggcccaggugacccugaacggcgugagcaagcccgaggccgugcuguuccccgugagcgacuggcaccccagagaccagccccaggaggaggaggaccugggccccgccgugcaccacguguacgagcugaucaaccagggccccagcagcaucagccagggcgugcuggagcugagcugcccccaggcccuggagggccagcagcugcuguacgugaccagagugaccggccugaacugcaccaccaaccaccccaucaaccccaagggccuggagcuggaccccgagggcagccugcaccaccagcagaagagagaggcccccagcagaagcagcgccagcagcggcccccagauccugaagugccccgaggccgagugcuucagacugagaugcgagcugggcccccugcaccagcaggagagccagagccugcagcugcacuucagagugugggccaagaccuuccugcagagagagcaccagcccuucagccugcagugcgaggccguguacaaggcccugaagaugcccuacagaauccugcccagacagcugccccagaaggagagacagguggccaccgccgugcaguggaccaaggccgagggcagcuacggcgugccccuguggaucaucauccuggccauccuguucggccugcugcugcugggccugcugaucuacauccuguacaagcugggcuucuucaagagaagccugcccuacggcaccgccauggagaaggcccagcugaagccccccgccaccagcgacgccuga

SEQ ID NO: 1608 - RNA, 3150 nt, Artificial Sequence
  derived and/or modified sequence opt5 from fibronectin__Homo_sapiens__BAF84259
augggcagcagaacccccgaguccccucugcacgccgugcagcuccggugggggccgcgcagacggcccccucugcuuccccugcuccugcuucugcucccucccccuccgcgcgucggaggcuucaaccuggacgcugaagcccccgcgguucugucugggccucccgggagcuuuuucggcuuuuccguggaguucuacagaccugggacagauggagugucuguccucgugggcgcucccaaggccaauacgagccaaccgggcguucugcagggaggagccguguaucuuugcccuuggggcgcuucccccacccaguguacaccuaucgaauuugacucuaaagggagccggcugcucgaguccagccugucuuccagcgaaggagaggagcccgucgaauacaagucucuucagugguucggcgccaccgugcgcgcucauggguccagcauucuggccugcgcgccccucuauucuuggagaacagagaaagaaccucuguccgauccgguuggaaccuguuaccugagcacagacaacuuuacccggauccucgaguaugcccccugccgcuccgauuucucuugggcugccggccaaggcuacugucaagggggauuuagcgcugaguucacgaagaccggcagagugguccuugggggaccuggcuccuauuuuuggcaggggcagauucugagcgccacacaggaacagaucgcggagucuuacuaccccgaauaucugauuaaucucgugcagggacagcugcaaacccggcaggccuccagcaucuacgacgauucuuaucuuggcuacagcguggcugucggcgaguucuccggggacgauacagaagacuuuguugccggagugccuaaaggcaaccugaccuauggguacgugacgauccucaauggaucugauauucgcagccuguauaacuucuccggcgagcagauggcuagcuacuucgccuacgccgucgcugcgacagacgugaauggggauggccuggacgaccuccugguuggagccccgcuucugauggauagaaccccggacggccggccucaagagguggggcgcgucuauguguaccuccagcaccccgcuggaaucgaaucuacaccuacccugacccuuacaggccaugaugaguuugggagauucggauccagccugacgccccucggcgaccuggaucaggacggguauaacgauguugccauuggcgccccuuuuggaggcgaaacccagcaagggguggucuucguguuucccggaggccccgggggacugggcucuaagccuucccagguccuccagccccugugggcugccagccacacacccgacuucuuuggguccgcgcuucggggcggaagagaucuggacggcaauggguacccugaucucaucgugggaucuuucggcguugacaaggcuguggucuaucgcgggcggccgauugugagcgccuccgccucucugaccaucuuucccgcuauguucaacccugaggaaagaagcugcucccuggagggaaaucccguugccuguauuaaccuuagcuuuugccucaaugcuucuggcaaacauguggccgacuccaucggguucacagucgagcugcagcuggauuggcaaaagcagaaaggcggagugcgccgggcgcucuuucuggccagcagacaggcuacccuuacgcagacacugcucauccaaaacggcgcccgcgaagacugucgggagaugaagauuuaccugagaaaugaaucugaguuccgcgauaaacuguccccuauccacauugcucuuaacuucagccucgacccccaggccccuguggauucucacgggcugcggcccgcgcugcauuaucagagcaaguccagaaucgaagacaaggcccagauucuccugggaugcggcgaggauaacaucuguguuccggaccuucaacuggaggucuuuggggaacagaaucacguguaccucggagauaaaaacgcucugaaucugaccuuccaugcccagaacgugggcgagggcggggcuuacgaagccgagcuucgcgucaccgccccucccgaggcugaauauagcggacucgugcggcacccuggcaauuuuucuucccugagcugcgacuacuucgcgguuaaccaauccagacugcucgugugcgaucuggggaaucccaugaaggccggagcuucucuuuggggcgggcugcgguuuacagucccgcaccuccgcgacaccaaaaagacaauccaguucgauuuucagauucugagcaaaaaccugaauaacucccagucugacgugguuagcuucagacuuuccguggaggcccaagcccaggucacgcucaauggagugucuaagccugaagcuguucuguuucccgugagcgacuggcauccucgggaucagccccaggaggaagaggaccugggccccgccguccaccauguguaugagcucaucaaccaaggcccuuccagcauuucucagggggugcuggaacuuuccuguccgcaggcgcuggagggacagcaacuccuguacgucaccagaguuacaggccugaauugcaccacaaaccaccccaucaauccuaaagggcuugaacuggaucccgagggaagccuccaucaccagcagaagcgcgaagcuccuucucgguccagcgccucuuccggcccccaaauucugaaguguccugaggccgagugcuucagacuccgcugugaacuggggccgcuucaccagcaggagagccagucccugcaacuccauuuuagagugugggcuaaaaccuuccugcagcgggaacaccagcccuuuagccugcagugcgaggccguguauaaggcgcuuaaaaugccuuaccgcauccugcccagacaacucccucagaaggaacggcaggucgcuacggccgugcaguggaccaaagccgagggaucuuauggcguuccccuguggaucauuauccucgcuauucuguucggccuucugcuccuggggcugcuuaucuacauucuguacaagcucggauucuuuaagcgcagccugccguauggcacagccauggagaaagcucaacucaagccucccgccaccuccgacgcguga

SEQ ID NO: 1609 - protein, 1049 aa, Artificial Sequence [sequence omitted]

SEQ ID NO: 1610 - RNA, 3150 nt, Artificial Sequence
  fibronectin__Homo_sapiens__BAG35324
auggggagccggacgccagaguccccucuccacgccgugcagcugcgcuggggcccccggcgccgacccccgcugcugccgcugcuguugcugcugcugccgccgccacccagggucgggggcuucaacuuagacgcggaggccccagcaguacucucggggcccccgggcuccuucuucggauucucaguggaguuuuaccggccgggaacagacggggucagugugcuggugggagcacccaaggcuaauaccagccagccaggagugcugcaggguggugcugucuaccucuguccuuggggugccagccccacacagugcacccccauugaauuugacagcaaaggcucucggcuccuggaguccucacuguccagcucagagggagaggagccuguggaguacaaguccuugcagugguucggggcaacaguucgagcccauggcuccuccaucuuggcaugcgcuccacuguacagcuggcgcacagagaaggagccacugagcgaccccgugggcaccugcuaccucuccacagauaacuucacccgaauucuggaguaugcacccugccgcucagauuucagcugggcagcaggacaggguuacugccaaggaggcuucagugccgaguucaccaagacuggccgugugguuuuagguggaccaggaagcuauuucuggcaaggccagauccugucugccacucaggagcagauugcagaaucuuauuaccccgaguaccugaucaaccugguucaggggcagcugcagacucgccaggccaguuccaucuaugaugacagcuaccuaggauacucuguggcuguuggugaauucaguggugaugacacagaagacuuuguugcuggugugcccaaagggaaccucacuuacggcuaugucaccauccuuaauggcucagacauucgaucccucuacaacuucucaggggaacagauggccuccuacuuuggcuaugcaguggccgccacagacgucaauggggacgggcuggaugacuugcuggugggggcaccccugcucauggaucggaccccugacgggcggccucagggggugggcagggucuacgucuaccugcagcacccagccggcauagagcccacgcccacccuuacccucacuggccaugaugaguuuggccgauuuggcagcuccuugaccccccugggggaccuggaccaggauggcuacaaugauguggccaucggggcucccuuugguggggagacccagcagggaguaguguuuguauuuccugggggcccaggagggcugggcucuaagcuuucccagguucugcagccccugugggcagccagccacaccccagacuucuuuggcucugcccuucgaggaggccgagaccuggauggcaauggauauccugaucugauugugggguccuuugguguggacaaggcugugguauacaggggccgccccaucguguccgcuagugccucccucaccaucuuccccgccauguucaacccagaggagcggagcugcagcuuagaggggaacccuguggccugcaucaaccuuagcuucugccucaaugcuucuggaaaacacguugcugacuccauugguuucacaguggaacuucagcuggacuggcagaagcagaagggagggguacggcgggcacuguuccuggccuccaggcaggcaacccugacccagacccugcucauccagaauggggcucgagaggauugcagagagaugaagaucuaccucaggaacgagucagaauuucgagacaaacucucgccgauucacaucgcucucaacuucuccuuggacccccaagccccaguggacagccacggccucaggccagcccuacauuaucagagcaagagccggauagaggacaaggcucagaucuugcuggacuguggagaagacaacaucugugugccugaccugcagcuggaaguguuuggggagcagaaccauguguaccugggugacaagaaugcccugaaccucacuuuccaugcccagaaugugggugaggguggcgccuaugaggcugagcuucgggucaccgccccuccagaggcugaguacucaggacucgucagacacccagggaacuucuccagccugagcugugacuacuuugccgugaaccagagccgccugcuggugugugaccugggcaaccccaugaaggcaggagccagucugugggguggccuucgguuuacagucccucaucuccgggacacuaagaaaaccauccaguuugacuuccagauccucagcaagaaucucaacaacucgcaaagcgacgugguuuccuuucggcucuccguggaggcucaggcccaggucacccugaacggugucuccaagccugaggcagugcuauucccaguaagcgacuggcauccccgagaccagccucagaaggaggaggaccugggaccugcuguccaccaugucuaugagcucaucaaccaaggccccagcuccauuagccagggugugcuggaacucagcuguccccaggcucuggaaggucagcagcuccuauaugugaccagaguuacgggacucaacugcaccaccaaucaccccauuaacccaaagggccuggaguuggaucccgaggguucccugcaccaccagcaaaaacgggaagcuccaagccgcagcucugcuuccucgggaccucagauccugaaaugcccggaggcugaguguuucaggcugcgcugugagcucgggccccugcaccaacaagagagccaaagucugcaguugcauuuccgagucugggccaagacuuucuugcagcgggagcaccagccauuuagccugcagugugaggcuguguacaaagcccugaagaugcccuaccgaauccugccucggcagcugccccaaaaagagcgucagguggccacagcugugcaauggaccaaggcagaaggcagcuauggcgucccacuguggaucaucauccuagccauccuguuuggccuccugcuccuaggucuacucaucuacauccucuacaagcuuggauucuucaaacgcucccucccauauggcaccgccauggaaaaagcucagcucaagccuccagccaccucugaugccuga

SEQ ID NO: 1611 - RNA, 3150 nt, Artificial Sequence
  derived and/or modified sequence opt1 from fibronectin__Homo_sapiens__BAG35324
augggcagccgcacccccgaguccccgcugcacgccgugcagcuccggugggggccccgccggcgcccgccccugcugccccuccugcugcuccugcugcccccgccgccccgggucggcggguucaaccucgacgccgaggcgcccgccgugcugagcggcccgcccggguccuucuucggcuucagcguggaguucuaccgccccggcaccgacggggucuccgugcuggugggcgcccccaaggccaacacgagccagcccgggguccuccagggcggggccguguaccugugccccuggggcgcgucccccacccagugcacccccaucgaguucgacagcaagggcucccggcugcucgagagcucccugagcuccagcgagggggaggagcccguggaguacaagucccugcagugguucggcgccaccguccgcgcccacgggagcuccauccucgccugcgcgccccuguacagcuggcggacggagaaggagccgcuguccgaccccguggggaccugcuaccucagcaccgacaacuucacccgcauccuggaguacgcccccugccggagcgacuucuccugggccgccggccagggcuacugccagggcggguucagcgccgaguucacgaagaccggccgcgugguccucgggggccccggcuccuacuucuggcaggggcagauccugagcgcgacccaggagcagaucgccgaguccuacuacccggaguaccugaucaaccuggugcagggccagcuccagacccggcaggccagcuccaucuacgacgacagcuaccugggguacuccguggccgucggcgaguucagcggggacgacacggaggacuucguggccggcgugcccaagggcaaccugaccuacggguacgucaccauccucaacggcuccgacauccgcagccuguacaacuucuccggggagcagauggcgagcuacuucggcuacgccguggccgccaccgacgugaacggggacggccuggacgaccuccuggucggcgcgccccugcucauggaccggacgcccgacgggcgcccgcagggcguggggcggguguacgucuaccugcagcaccccgccggcaucgagcccaccccgacccugacccucacgggccacgacgaguucgggcgcuucggcuccagccugacgccccugggggaccucgaccaggacggcuacaacgacguggccaucggggcccccuucggcggcgagacccagcagggggucguguucguguuccccggcgggccgggcgggcugggcuccaagcugagccagguccuccagccccugugggccgccucccacacccccgacuucuucggcagcgcgcugcgcgggggccgggaccucgacgggaacggcuaccccgaccugaucguggggagcuucggcguggacaaggccgucguguaccggggccgcccgaucguguccgccagcgccucccugaccaucuuccccgcgauguucaaccccgaggagcgcagcugcucccuggaggggaaccccgucgccugcaucaaccucagcuucugccugaacgccuccggcaagcacguggccgacagcaucggguucaccguggagcugcagcucgacuggcagaagcagaagggcgggguccggcgcgcccuguuccuggcgucccggcaggccacccucacccagacgcugcugauccagaacggcgcccgcgaggacugccgggagaugaagaucuaccuccgcaacgagagcgaguuccgggacaagcuguccccgauccacaucgcccugaacuucagccucgacccccaggcccccguggacucccacggccugcgccccgcgcugcacuaccagagcaagucccggaucgaggacaaggcccagauccuccuggacugcggggaggacaacaucugcgugccggaccugcagcucgaggucuucggcgagcagaaccacguguaccugggggacaagaacgcccugaaccucaccuuccacgcccagaacgugggcgagggcggggccuacgaggcggagcugcgcgucaccgccccgcccgaggccgaguacagcggccuggugcggcaccccgggaacuucuccagccucagcugcgacuacuucgccgugaaccagucccgccugcuggucugcgaccucggcaaccccaugaaggcgggggccagccuguggggcggccugcgguucaccgugccccaccuccgcgacacgaagaagaccauccaguucgacuuccagauccuguccaagaaccugaacaacagccaguccgacguggucagcuuccggcucuccguggaggcccaggcccaggugacccugaacggggucagcaagcccgaggccgugcuguuccccguguccgacuggcacccgcgcgaccagccccagaaggaggaggaccucggccccgcgguccaccacguguacgagcugaucaaccaggggccgagcuccaucagccagggcgugcuggagcucuccugcccccaggcccuggaggggcagcagcugcucuacgucacccgggugacgggccugaacugcaccaccaaccaccccaucaaccccaagggccuggagcucgacccggaggggagccugcaccaccagcagaagcgcgaggcccccucccggagcuccgccagcuccggcccccagauccugaagugccccgaggccgagugcuuccgccuccgcugcgagcuggggccgcugcaccagcaggagagccagagccuccagcugcacuuccgggugugggcgaagaccuuccugcagcgcgagcaccagcccuucucccuccagugcgaggccgucuacaaggcccugaagaugcccuaccggauccugccccgccagcucccgcagaaggagcgccagguggccaccgccgugcaguggacgaaggcggagggcagcuacggggucccccuguggaucaucauccuggccauccucuucggccugcugcuccugggccugcucaucuacauccuguacaagcugggguucuucaagcggucccuccccuacggcaccgccauggagaaggcccagcugaagcccccggcgaccagcgacgccuga

SEQ ID NO: 1612 - RNA, 3150 nt, Artificial Sequence
  derived and/or modified sequence opt2 from fibronectin__Homo_sapiens__BAG35324
augggcucccgcacccccgaguccccccuccacgccguccagcuccgcuggggcccccgccgccgccccccccuccucccccuccuccuccuccuccuccccccccccccccgcgucggcggcuucaaccucgacgccgaggcccccgccguccucuccggcccccccggcuccuucuucggcuucuccgucgaguucuaccgccccggcaccgacggcgucuccguccucgucggcgcccccaaggccaacaccucccagcccggcguccuccagggcggcgccgucuaccucugccccuggggcgccucccccacccagugcacccccaucgaguucgacuccaagggcucccgccuccucgaguccucccucuccuccuccgagggcgaggagcccgucgaguacaagucccuccagugguucggcgccaccguccgcgcccacggcuccuccauccucgccugcgccccccucuacuccuggcgcaccgagaaggagccccucuccgaccccgucggcaccugcuaccucuccaccgacaacuucacccgcauccucgaguacgcccccugccgcuccgacuucuccugggccgccggccagggcuacugccagggcggcuucuccgccgaguucaccaagaccggccgcgucguccucggcggccccggcuccuacuucuggcagggccagauccucuccgccacccaggagcagaucgccgaguccuacuaccccgaguaccucaucaaccucguccagggccagcuccagacccgccaggccuccuccaucuacgacgacuccuaccucggcuacuccgucgccgucggcgaguucuccggcgacgacaccgaggacuucgucgccggcguccccaagggcaaccucaccuacggcuacgucaccauccucaacggcuccgacauccgcucccucuacaacuucuccggcgagcagauggccuccuacuucggcuacgccgucgccgccaccgacgucaacggcgacggccucgacgaccuccucgucggcgccccccuccucauggaccgcacccccgacggccgcccccagggcgucggccgcgucuacgucuaccuccagcaccccgccggcaucgagcccacccccacccucacccucaccggccacgacgaguucggccgcuucggcuccucccucaccccccucggcgaccucgaccaggacggcuacaacgacgucgccaucggcgcccccuucggcggcgagacccagcagggcgucgucuucgucuuccccggcggccccggcggccucggcuccaagcucucccagguccuccagccccucugggccgccucccacacccccgacuucuucggcuccgcccuccgcggcggccgcgaccucgacggcaacggcuaccccgaccucaucgucggcuccuucggcgucgacaaggccgucgucuaccgcggccgccccaucgucuccgccuccgccucccucaccaucuuccccgccauguucaaccccgaggagcgcuccugcucccucgagggcaaccccgucgccugcaucaaccucuccuucugccucaacgccuccggcaagcacgucgccgacuccaucggcuucaccgucgagcuccagcucgacuggcagaagcagaagggcggcguccgccgcgcccucuuccucgccucccgccaggccacccucacccagacccuccucauccagaacggcgcccgcgaggacugccgcgagaugaagaucuaccuccgcaacgaguccgaguuccgcgacaagcucucccccauccacaucgcccucaacuucucccucgacccccaggcccccgucgacucccacggccuccgccccgcccuccacuaccaguccaagucccgcaucgaggacaaggcccagauccuccucgacugcggcgaggacaacaucugcguccccgaccuccagcucgaggucuucggcgagcagaaccacgucuaccucggcgacaagaacgcccucaaccucaccuuccacgcccagaacgucggcgagggcggcgccuacgaggccgagcuccgcgucaccgccccccccgaggccgaguacuccggccucguccgccaccccggcaacuucuccucccucuccugcgacuacuucgccgucaaccagucccgccuccucgucugcgaccucggcaaccccaugaaggccggcgccucccucuggggcggccuccgcuucaccgucccccaccuccgcgacaccaagaagaccauccaguucgacuuccagauccucuccaagaaccucaacaacucccaguccgacgucgucuccuuccgccucuccgucgaggcccaggcccaggucacccucaacggcgucuccaagcccgaggccguccucuuccccgucuccgacuggcacccccgcgaccagccccagaaggaggaggaccucggccccgccguccaccacgucuacgagcucaucaaccagggccccuccuccaucucccagggcguccucgagcucuccugcccccaggcccucgagggccagcagcuccucuacgucacccgcgucaccggccucaacugcaccaccaaccaccccaucaaccccaagggccucgagcucgaccccgagggcucccuccaccaccagcagaagcgcgaggcccccucccgcuccuccgccuccuccggcccccagauccucaagugccccgaggccgagugcuuccgccuccgcugcgagcucggcccccuccaccagcaggagucccagucccuccagcuccacuuccgcgucugggccaagaccuuccuccagcgcgagcaccagcccuucucccuccagugcgaggccgucuacaaggcccucaagaugcccuaccgcauccucccccgccagcucccccagaaggagcgccaggucgccaccgccguccaguggaccaaggccgagggcuccuacggcgucccccucuggaucaucauccucgccauccucuucggccuccuccuccucggccuccucaucuacauccucuacaagcucggcuucuucaagcgcucccuccccuacggcaccgccauggagaaggcccagcucaagccccccgccaccuccgacgccuga

SEQ ID NO: 1613 - RNA, 3150 nt, Artificial Sequence
  derived and/or modified sequence opt3 from fibronectin__Homo_sapiens__BAG35324
augggcagcagaacccccgaguccccucugcacgccgugcagcucaggugggggccacggcgccgaccgccccuucugccuuuguuacugcuacuccugccacccccuccacgugucggagguuucaaccuugacgcugaagcacccgccguucugucuggcccuccagggucauuuuucggauuuaguguggaguucuacagaccgggcacagaugguguaagcguguuggucggggcgcccaaggcuaauacuucccaaccuggagugcuccagggcggcgccguuuaucugugcccauggggagcaucucccacgcaguguaccccuaucgaauuugacucgaaagggucaaggcugcucgagagcaguuuauccucuagcgaaggugaggagccaguggaauacaagucccugcagugguucggcgccacaguccgggcucaugggucaaguauucuugcaugcgcccccuuguauagcuggcgcacugagaaagaaccgcugucugauccugugggaaccuguuaccuauccacagacaacuuuaccagaauacucgaguaugcucccugcaggucagauuucagcugggccgcgggccaagguuacugucaagggggauuuagugcagaguucacuaagacaggccggguaguucugggcgggccaggaucuuauuuuuggcagggucagauccuuuccgccacccaggaacagauugcugagagcuacuacccugaauaucugaucaauuuggugcagggccagcuccaaacgcgccaggccucgucuauuuacgacgauuccuaucugggguacucagucgcagugggagaguucaguggcgacgauacugaagacuuuguggcugguguccccaaagggaacuuaaccuauggcuacguuacaauccugaauggaagcgauauacgaucccucuauaacuucucuggcgagcagauggccagcuacuucggguacgcgguggccgcaacugacguaaauggagauggucuugacgaccuguuggugggcgcuccacuacugauggauagaacccccgacgggaggccucaaggagucggccggguguauguuuaccuccagcacccagccgguaucgagccgacacccacccugacgcuuacugggcaugaugaauuuggccguuucggaucaagucugacaccuuugggcgaccucgaucaggacggguauaacgauguggcuauuggagccccauuugguggcgagacccagcaaggggucguguucguauuucccggaggcccuggugggcugggcuccaaguuaagccagguucugcagccacuaugggcagccucucacacucccgacuucuuuggaucagcucuccgcggcgggagagaucuggacggaaauggcuacccggaucuuaucguggguaguuucggggucgacaaggcgguggucuauaggggacggccuauugugagcgcauccgccucuuugacaaucuuuccagcuauguucaaccccgaagaacgaucgugcagccuggaaggcaauccuguugccuguauaaaccucuccuuuugccugaaugcaucagguaaacauguggccgacaguauuggcuucaccguagagcuucagcuggauuggcaaaagcagaaagggggaguccgcagagcuuuguuucucgccucuaggcaggcaacgcugacccagacauuacugauccaaaacggcgcgcgggaggacugucgcgaaaugaagauuuaccuaagaaaugagagcgaguucagggauaaacucucccccauccacaucgcucugaacuucucacuugacccacaggccccuguggauagccacggguugcgucccgcacugcauuaucagucuaagucccggauugaggacaaggcccagauacuccuggauugcggagaagacaacaucuguguuccagauuuacaacuggagguguuuggcgagcagaaucacgucuaccuuggugacaaaaacgcuuugaaucucacuuuccaugcccagaacgugggggaaggaggcgcauacgaggcugaacugcgaguaaccgccccgccugaggcggaguauaguggucuagugagacaccccggcaauuuuagcucucuguccugcgauuacuucgccguuaaccaaucaaggcuccuggucugcgaccuugggaauccaaugaaggcuggagcaaguuuguggggcgggcugcgcuuuacagugccccacuuacgggauacuaaaaagaccauucaguucgacuuucagauccucagcaaaaaccugaauaacucgcaguccgacguggucucuuucagacuuagcguugaagcccaagcucaggugacacugaauggagugucaaagccugaggccguauuguuuccagucagugauuggcaucccagggaccagccucagaaagaagaggaucucggcccggcagugcaccauguuuaugaacugauaaaccaagguccauccucuauuagccagggggugcuagagcuguccuguccccaggcgcucgagggacagcaacugcuuuacgucacccgcgugacuggcuugaauugcacgacaaaccacccuaucaauccaaagggucuggaauuagaccccgagggcucacuccaucaccagcagaagcgagaagccccuagccggaguucugcuuccagcgggccgcaaauccugaaaugucccgaggccgaaugcuuccgucuuagaugugagcugggaccacuacaccagcaggagucgcagucacuccaacugcauuuuaggguuugggcaaagaccuucuugcagcgcgaacaccagccuuuuucucugcagugcgaggcuguguauaaagccuuaaagaugcccuaccggauucucccaagacaacugccucagaaagaaaggcagguagcaacugccguccaguggaccaaggcugagggcaguuauggggugccccuuuggaucauuauacuggcgaucuuguucggacuccugcuacugggccuucucauuuacauccuguacaaguuggguuucuuuaaacgaucccugccauaugggacagccauggaaaaggcacaauuaaaaccgccugcuaccagcgaugccuga

SEQ ID NO: 1614 - RNA, 3150 nt, Artificial Sequence
  derived and/or modified sequence opt4 from fibronectin__Homo_sapiens__BAG35324
augggcagcagaacccccgagagcccccugcacgccgugcagcugagauggggccccagaagaagacccccccugcugccccugcugcugcugcugcugccccccccccccagagugggcggcuucaaccuggacgccgaggcccccgccgugcugagcggcccccccggcagcuucuucggcuucagcguggaguucuacagacccggcaccgacggcgugagcgugcuggugggcgcccccaaggccaacaccagccagcccggcgugcugcagggcggcgccguguaccugugccccuggggcgccagccccacccagugcacccccaucgaguucgacagcaagggcagcagacugcuggagagcagccugagcagcagcgagggcgaggagcccguggaguacaagagccugcagugguucggcgccaccgugagagcccacggcagcagcauccuggccugcgccccccuguacagcuggagaaccgagaaggagccccugagcgaccccgugggcaccugcuaccugagcaccgacaacuucaccagaauccuggaguacgcccccugcagaagcgacuucagcugggccgccggccagggcuacugccagggcggcuucagcgccgaguucaccaagaccggcagaguggugcugggcggccccggcagcuacuucuggcagggccagauccugagcgccacccaggagcagaucgccgagagcuacuaccccgaguaccugaucaaccuggugcagggccagcugcagaccagacaggccagcagcaucuacgacgacagcuaccugggcuacagcguggccgugggcgaguucagcggcgacgacaccgaggacuucguggccggcgugcccaagggcaaccugaccuacggcuacgugaccauccugaacggcagcgacaucagaagccuguacaacuucagcggcgagcagauggccagcuacuucggcuacgccguggccgccaccgacgugaacggcgacggccuggacgaccugcuggugggcgccccccugcugauggacagaacccccgacggcagaccccagggcgugggcagaguguacguguaccugcagcaccccgccggcaucgagcccacccccacccugacccugaccggccacgacgaguucggcagauucggcagcagccugaccccccugggcgaccuggaccaggacggcuacaacgacguggccaucggcgcccccuucggcggcgagacccagcagggcgugguguucguguuccccggcggccccggcggccugggcagcaagcugagccaggugcugcagccccugugggccgccagccacacccccgacuucuucggcagcgcccugagaggcggcagagaccuggacggcaacggcuaccccgaccugaucgugggcagcuucggcguggacaaggccgugguguacagaggcagacccaucgugagcgccagcgccagccugaccaucuuccccgccauguucaaccccgaggagagaagcugcagccuggagggcaaccccguggccugcaucaaccugagcuucugccugaacgccagcggcaagcacguggccgacagcaucggcuucaccguggagcugcagcuggacuggcagaagcagaagggcggcgugagaagagcccuguuccuggccagcagacaggccacccugacccagacccugcugauccagaacggcgccagagaggacugcagagagaugaagaucuaccugagaaacgagagcgaguucagagacaagcugagccccauccacaucgcccugaacuucagccuggacccccaggcccccguggacagccacggccugagacccgcccugcacuaccagagcaagagcagaaucgaggacaaggcccagauccugcuggacugcggcgaggacaacaucugcgugcccgaccugcagcuggagguguucggcgagcagaaccacguguaccugggcgacaagaacgcccugaaccugaccuuccacgcccagaacgugggcgagggcggcgccuacgaggccgagcugagagugaccgccccccccgaggccgaguacagcggccuggugagacaccccggcaacuucagcagccugagcugcgacuacuucgccgugaaccagagcagacugcuggugugcgaccugggcaaccccaugaaggccggcgccagccuguggggcggccugagauucaccgugccccaccugagagacaccaagaagaccauccaguucgacuuccagauccugagcaagaaccugaacaacagccagagcgacguggugagcuucagacugagcguggaggcccaggcccaggugacccugaacggcgugagcaagcccgaggccgugcuguuccccgugagcgacuggcaccccagagaccagccccagaaggaggaggaccugggccccgccgugcaccacguguacgagcugaucaaccagggccccagcagcaucagccagggcgugcuggagcugagcugcccccaggcccuggagggccagcagcugcuguacgugaccagagugaccggccugaacugcaccaccaaccaccccaucaaccccaagggccuggagcuggaccccgagggcagccugcaccaccagcagaagagagaggcccccagcagaagcagcgccagcagcggcccccagauccugaagugccccgaggccgagugcuucagacugagaugcgagcugggcccccugcaccagcaggagagccagagccugcagcugcacuucagagugugggccaagaccuuccugcagagagagcaccagcccuucagccugcagugcgaggccguguacaaggcccugaagaugcccuacagaauccugcccagacagcugccccagaaggagagacagguggccaccgccgugcaguggaccaaggccgagggcagcuacggcgugccccuguggaucaucauccuggccauccuguucggccugcugcugcugggccugcugaucuacauccuguacaagcugggcuucuucaagagaagccugcccuacggcaccgccauggagaaggcccagcugaagccccccgccaccagcgacgccuga

SEQ ID NO: 1615 - RNA, 3150 nt, Artificial Sequence
  derived and/or modified sequence opt5 from fibronectin__Homo_sapiens__BAG35324
augggcagcagaacccccgaguccccucugcacgccgugcagcuccggugggggccgcgcagacggcccccucugcuuccccugcuccugcuucugcucccucccccuccgcgcgucggaggcuucaaccuggacgcugaagcccccgcgguucugucugggccucccgggagcuuuuucggcuuuuccguggaguucuacagaccugggacagauggagugucuguccucgugggcgcucccaaggccaauacgagccaaccgggcguucugcaagggggagccguguaucuuugcccuuggggcgcuucccccacccaguguacaccuaucgaauuugacucuaaagggagccggcugcucgaguccagccugucuuccagcgaaggagaggagcccgucgaauacaagucucuucagugguucggcgccaccgugcgcgcucauggguccagcauucuggccugcgcgccccucuauucuuggagaacagagaaagaaccucuguccgauccgguuggaaccuguuaccugagcacagacaacuuuacccggauccucgaguaugcccccugccgcuccgauuucucuugggcugccggccagggcuacugucaagggggauuuagcgcugaguucacgaagaccggcagagugguccuugggggaccuggcuccuauuuuuggcaggggcagauucugagcgccacacaggaacagaucgcggagucuuacuaccccgaauaucugauuaaucucgugcagggacagcugcaaacccggcaggccuccagcaucuacgacgauucuuaucuuggcuacagcguggcugucggcgaguucuccggggacgauacagaagacuuuguugccggagugccuaaaggcaaccugaccuauggguacgugacgauccucaauggaucugauauucgcagccuguauaacuucuccggcgagcagauggcuagcuacuucggguacgccgucgccgcuacagacgugaauggcgauggacuggacgaccuccugguuggcgcgccccuucugauggauagaaccccggacgggcggccucaaggagugggccgcgucuauguguaccuccagcaccccgccgggaucgagccuacacccacccugacccuuacaggacaugaugaauuuggcagauucgggucuucccugacgccucucggcgaccuggaucaggacggauauaacgauguugcuauuggcgcccccuuugggggagagacccagcaaggcguggucuucguguuuccugggggaccgggcgggcugggcagcaagcucucucagguccugcagccccuuugggccgcuucccacacacccgacuucuuuggaagcgcccugcggggcgggagagaucucgacggaaauggcuacccugaucugaucgugggguccuucggaguugacaaggcgguggucuaucgcggccggccgauugugucugcuagcgccucccugaccaucuuucccgccauguucaacccugaagagagaucuugcagccuugaagggaaucccguugcuuguauuaaccucuccuuuugccugaaugccagcggcaaacauguggcugacucuaucggauucacagucgagcugcagcucgauuggcaaaagcagaaaggcggggugcgccgggcccuguuucuugcguccagacaggccacccugacgcagacacuccugauccaaaacggagcucgcgaggacugucgggaaaugaagauuuaccugagaaaugagagcgaguuccgcgauaaacuuucuccuauccacauugcccucaacuucucccuggacccccaggcuccuguggauagccacggccugcggcccgcccuccauuaucagucuaagagcagaaucgaagacaaggcgcagauucugcuugauugcggggaagacaacaucuguguuccggaucugcaacucgaggucuuuggagagcagaaucacguguaccugggcgacaaaaacgcccugaaucuuaccuuccaugcucagaacgugggcgaagggggagccuacgaggcugaacuccgcgucaccgccccucccgaggccgaguauuccggccuggugcggcacccugggaauuuuagcucucuguccugcgauuacuucgcuguuaaccaaagcagacuccuggugugcgaccuuggaaaucccaugaaggcgggcgccucccuguggggaggacuccgguuuacagucccgcaucugcgcgauaccaaaaagacaauccaguucgacuuucagauucugucuaaaaaccuuaauaacagccaguccgacgugguuucuuucagacucagcguggaagcucaagcccaggucacgcugaauggcguguccaagccugaggccguucuguuucccgugucugauuggcacccucgggaccagccccagaaagaagaggaucucggccccgcuguccaccauguguaugaacugaucaaccaagggccuagcuccauuagccagggagugcuugagcugucuuguccgcaggcccucgagggccagcaacugcuguacgucaccagaguuacagggcuuaauugcaccacaaaccaccccaucaauccuaagggacuggaacucgaccccgagggcucccugcaucaccagcagaagcgcgaagcgccuagccggucuuccgcuagcucugggccccaaauucucaaauguccugaggccgaaugcuucagacugcgcugugagcuuggaccgcugcaccagcaggagucccagagccuccaacugcauuuuagagugugggccaagaccuuccugcagcgggaacaccagcccuuuucccuucagugcgaggcuguguauaaagcccugaagaugccuuaccgcauccuccccagacaacugccucagaaagaacggcaggucgcgacggcugugcaguggaccaaggccgagggcagcuauggcguuccccucuggaucauuauccuggccauucuuuucgggcugcuccugcugggacuucugaucuacauucucuacaagcugggcuucuuuaaacgcucucucccguaugggacagcuauggaaaaggcccaacugaaaccucccgcuaccagcgaugccuga

SEQ ID NO: 1616 - protein, 466 aa, Artificial Sequence
  fibronectin__Homo_sapiens__B3KXM5
MLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTRRPTTTVRTTTRTTTTTTPKPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPI

SEQ ID NO: 1617 - RNA, 1401 nt, Artificial Sequence
  fibronectin__Homo_sapiens__BAG54537
augcuguccuugcgccagaggaugaugcaugccagauuccguaacccucucucccgacagccugccagacccucuuacagacaagguuauaauggcagaccaaauguagaagggaaaguccuuccugguaguaauggaaaaccgaauggacagagaauuaucaauggcccucaaggaacaaaguggguuguggaccuugaucguggguuaguauugaaugcagaaggaagguaccuccaagauucacauggaaauccucuucggauuaaacuaggaggagauggucgaaccauuguagaucuggaagggacccccguggugaguccugacggccucccacucuuugggcaggggcgacauggcacaccucuggccaaugcccaagauaagccaauuuugagucuuggaggaaagccgcuggugggcuuggaggucaucaaaaaaaccacccaucccccuaccacuaccaugcagcccaccacuacuacgacgccccugccuaccacuacaaccccgaggcccaccacugccaccacccgccgcacgaccaccaggcguccaacaaccacaguccgaaccacuacgcggacaaccaccaccaccacccccaaacccaccacucccauccccaccugucccccugggaccuuggaacggcacgacgaugauggcaaccugauaaugagcuccaaugggaucccagagugcuacgcugaagaagaugaguucucaggcuuggagacugacacugcaguaccuacggaagaggccuacguuauauaugaugaagauuaugaauuugagacgucaaggccaccaaccaccacugagccuucgaccacugcuaccacaccgagggugaucccagaggaaggcgccaucaguuccuuuccugaagaagaauuugaucuggcuggaaggaaacgauuuguugcuccuuacgugacguaccuaaauaaagacccaucagccccgugcucucugacugaugcacuggaucacuuccaaguggacagccuggaugaaaucauccccaaugaccugaagaagagugaccugccuccccagcaugcuccccgcaacaucaccgugguggccguggaagguugccacucauuugucauuguggacugggacaaagccaccccaggagauguggucacagguuacuugguuuacagugcauccuaugaagacuucaucaggaacaagugguccacucaagcuucaucaguaacucacuugcccauugagaaccuaaagcccaacacgagguauuauuuuaaagugcaagcacaaaauccucauggcuacggaccuaucagcccuucggucucauuugucaccgaaucagauaauccucugcuuguugugaggcccccaggcggugagccuaucuag

SEQ ID NO: 1618 - RNA, 1401 nt, Artificial Sequence
  derived and/or modified sequence opt1 from fibronectin__Homo_sapiens__BAG54537
augcugagccuccgccagcggaugaugcacgcccgcuuccggaacccccugucccgccagccggcccggcccagcuaccgccagggcuacaacgggcggcccaacguggagggcaagguccugcccggguccaacggcaagccgaacgggcagcgcaucaucaacggcccccagggcaccaagugggugguggaccucgaccgggggcugguccugaacgcggagggccgcuaccuccaggacagccacgggaacccccugcggaucaagcugggcggggacggccgcaccaucguggaccucgagggcacgcccguggucuccccggacgggcugccccuguucggccaggggcggcacggcacgccccucgccaacgcccaggacaagcccauccugagccugggcgggaagccgcucgugggccuggaggugaucaagaagaccacccacccgcccaccaccaccaugcagcccaccacgaccaccacgccccugcccaccaccaccacgccccgccccaccaccgccaccacccggcgcacgaccacccggcgcccgaccacgaccguccggaccaccacgcgcaccaccaccacgaccacccccaagcccaccacgcccaucccgaccugcccgcccgggacccucgagcggcacgacgacgacggcaaccugaucauguccagcaacgggauccccgagugcuacgccgaggaggacgaguucuccggccuggagaccgacaccgcggugcccacggaggaggccuacgugaucuacgacgaggacuacgaguucgagaccagccgcccgcccaccaccacggagcccuccaccaccgccaccacgccccgcgucauccccgaggagggcgccaucagcuccuuccccgaggaggaguucgaccucgcggggcggaagcgcuucguggccccguacgugaccuaccugaacaaggaccccagcgcccccugcucccugaccgacgcccucgaccacuuccaggucgacagccuggacgagaucauccccaacgaccugaagaaguccgaccucccgccccagcacgcgccccggaacaucaccgugguggccgucgagggcugccacagcuucgugaucguggacugggacaaggccacgcccggggacgucgugaccggcuaccugguguacuccgccagcuacgaggacuucauccgcaacaaguggagcacccaggccuccagcgucacccaccucccgaucgagaaccugaagcccaacacgcgguacuacuucaaggugcaggcccagaacccccacggguacggccccaucuccccgagcgucuccuucgugaccgagagcgacaacccccugcuggugguccgcccgcccggcggggagcccaucuga

SEQ ID NO: 1619 - RNA, 1401 nt, Artificial Sequence
  derived and/or modified sequence opt2 from fibronectin__Homo_sapiens__BAG54537
augcucucccuccgccagcgcaugaugcacgcccgcuuccgcaacccccucucccgccagcccgcccgccccuccuaccgccagggcuacaacggccgccccaacgucgagggcaagguccuccccggcuccaacggcaagcccaacggccagcgcaucaucaacggcccccagggcaccaagugggucgucgaccucgaccgcggccucguccucaacgccgagggccgcuaccuccaggacucccacggcaacccccuccgcaucaagcucggcggcgacggccgcaccaucgucgaccucgagggcacccccgucgucucccccgacggccucccccucuucggccagggccgccacggcaccccccucgccaacgcccaggacaagcccauccucucccucggcggcaagccccucgucggccucgaggucaucaagaagaccacccacccccccaccaccaccaugcagcccaccaccaccaccaccccccuccccaccaccaccaccccccgccccaccaccgccaccacccgccgcaccaccacccgccgccccaccaccaccguccgcaccaccacccgcaccaccaccaccaccacccccaagcccaccacccccauccccaccugcccccccggcacccucgagcgccacgacgacgacggcaaccucaucauguccuccaacggcauccccgagugcuacgccgaggaggacgaguucuccggccucgagaccgacaccgccguccccaccgaggaggccuacgucaucuacgacgaggacuacgaguucgagaccucccgcccccccaccaccaccgagcccuccaccaccgccaccaccccccgcgucauccccgaggagggcgccaucuccuccuuccccgaggaggaguucgaccucgccggccgcaagcgcuucgucgcccccuacgucaccuaccucaacaaggaccccuccgcccccugcucccucaccgacgcccucgaccacuuccaggucgacucccucgacgagaucauccccaacgaccucaagaaguccgaccuccccccccagcacgccccccgcaacaucaccgucgucgccgucgagggcugccacuccuucgucaucgucgacugggacaaggccacccccggcgacgucgucaccggcuaccucgucuacuccgccuccuacgaggacuucauccgcaacaagugguccacccaggccuccuccgucacccaccuccccaucgagaaccucaagcccaacacccgcuacuacuucaagguccaggcccagaacccccacggcuacggccccaucucccccuccgucuccuucgucaccgaguccgacaacccccuccucgucguccgcccccccggcggcgagcccaucuga

SEQ ID NO: 1620 - RNA, 1401 nt, Artificial Sequence
  derived and/or modified sequence opt3 from fibronectin__Homo_sapiens__BAG54537
augcugagccucagacagaggaugaugcacgcccgguuccgcaacccccuuucccgacaaccugcucguccaucuuacagacagggcuauaaugggaggccgaacguggagggaaagguccugcccgguucaaauggcaaaccuaacgggcagcggaucauuaauggaccacagggcaccaaguggguuguggacuuggaucgcgguuuaguacugaacgcagaagggagauaccuacaagacagucauggaaauccccucaggauaaaacugggcggcgaugggcggacaaucguggaccuugagggaacuccugucgugagcccagauggucugcccuuguuuggccaggggcgccacggaacgccucucgccaacgcgcaggacaagccaauucugucccugggcgguaaaccgcucguuggguuagaagugaucaagaagaccacacaucccccuacuaccacaaugcagccaaccacuacaaccacgccccugccuacuaccacaacuccacgacccaccacagcuaccacgagaaggacuacaacccggcguccgacuacaaccguccgcacgaccacaagaacuaccacaacuaccacaccuaaacccaccacuccaauuccuacgugucccccaggaacacuugagaggcacgaugacgauggcaauuugaucaugucuucgaacggcauacccgaaugcuaugccgaggaggacgaguucucagggcuggaaaccgauacugcagugccuaccgaagaggccuacguaaucuaugacgaggauuacgaauuugagacaagccggccaccgaccacuacagaacccaguacgaccgcuacuacaccucgaguuauuccagaggaaggagcaaucuccucuuuccccgaggaggaauuugaccuagccggucgcaagagauucguggcuccuuaugucaccuaccucaauaaagacccaagcgcccccugcucccugacagaugcgcuugaccauuuucaaguggauucacuggacgagauuaucccgaacgauuugaagaaaagugaccucccuccacagcacgcacccaggaauauaacuguggucgccguugaaggcugucacagcuucgugauuguagauugggacaaggcuaccccuggggauguggucacgggauaccugguguauucugccuccuacgaggacuuuauccggaacaaguggucaacccaggcaagcaguguuacacauuuacccauugaaaaucugaaaccaaacacucgcuauuacuucaaggugcaggcucaaaacccucacggcuauggucccaucucuccauccgucagcuuugugaccgagucggauaauccgcuccuuguaguuagaccucccgggggcgagccaaucuga

SEQ ID NO: 1621 - RNA, 1401 nt, Artificial Sequence
  derived and/or modified sequence opt4 from fibronectin__Homo_sapiens__BAG54537
augcugagccugagacagagaaugaugcacgccagauucagaaacccccugagcagacagcccgccagacccagcuacagacagggcuacaacggcagacccaacguggagggcaaggugcugcccggcagcaacggcaagcccaacggccagagaaucaucaacggcccccagggcaccaagugggugguggaccuggacagaggccuggugcugaacgccgagggcagauaccugcaggacagccacggcaacccccugagaaucaagcugggcggcgacggcagaaccaucguggaccuggagggcacccccguggugagccccgacggccugccccuguucggccagggcagacacggcaccccccuggccaacgcccaggacaagcccauccugagccugggcggcaagccccuggugggccuggaggugaucaagaagaccacccacccccccaccaccaccaugcagcccaccaccaccaccaccccccugcccaccaccaccacccccagacccaccaccgccaccaccagaagaaccaccaccagaagacccaccaccaccgugagaaccaccaccagaaccaccaccaccaccacccccaagcccaccacccccauccccaccugcccccccggcacccuggagagacacgacgacgacggcaaccugaucaugagcagcaacggcauccccgagugcuacgccgaggaggacgaguucagcggccuggagaccgacaccgccgugcccaccgaggaggccuacgugaucuacgacgaggacuacgaguucgagaccagcagaccccccaccaccaccgagcccagcaccaccgccaccacccccagagugauccccgaggagggcgccaucagcagcuuccccgaggaggaguucgaccuggccggcagaaagagauucguggcccccuacgugaccuaccugaacaaggaccccagcgcccccugcagccugaccgacgcccuggaccacuuccagguggacagccuggacgagaucauccccaacgaccugaagaagagcgaccugcccccccagcacgcccccagaaacaucaccgugguggccguggagggcugccacagcuucgugaucguggacugggacaaggccacccccggcgacguggugaccggcuaccugguguacagcgccagcuacgaggacuucaucagaaacaaguggagcacccaggccagcagcgugacccaccugcccaucgagaaccugaagcccaacaccagauacuacuucaaggugcaggcccagaacccccacggcuacggccccaucagccccagcgugagcuucgugaccgagagcgacaacccccugcugguggugagaccccccggcggcgagcccaucuga

SEQ ID NO: 1622 - RNA, 1401 nt, Artificial Sequence
  derived and/or modified sequence opt5 from fibronectin__Homo_sapiens__BAG54537
augcugagccucagacagcggaugaugcacgcccgcuucagaaacccccugucccggcaaccugcucgcccgucuuacagacagggcuauaaugggcggcccaacguggagggaaagguccuuccuggcagcaaugggaaacccaacggacagcgcaucauuaauggcccucaggggaccaaguggguuguggaccuggauagaggacucgugcugaacgccgaaggccgguaccuucaagacucccauggcaauccccugcgcaucaaacucgggggagauggcagaacaauugucgaccuggaggggacgccugugguuucuccggauggacugccccucuuuggccaggggcggcacggaaccccucuggcgaacgcucaggacaagcccauccuuagccugggcggcaaaccucucguggggcuggaagucauuaagaagacaacccaucccccgacaaccacaaugcagccuaccacgaccacaacaccccuuccuaccaccacgacaccccgccccaccacagccaccaccagacggacaacgacccgcagaccuacaaccacagugcggaccacgacaagaaccaccacaaccacaacgccgaaacccaccacaccuauccccacaugcccucccggaacccuggagcgccacgaugacgauggcaaucucaucauguccucuaacgggauuccggaauguuaugccgaggaggacgaguucagcggacuggaaaccgauacggcuguuccuaccgaagaggccuacgugaucuaugacgaggauuacgaauuugagacaucccggcccccuaccacaaccgaacccagcacgacagcuaccacaccuagagucauucccgaggaaggcgccaucucuuccuucccggaggaggaauuugaccuggcggggcgcaagcgguucguggccccuuaugugaccuaccucaauaaagaccccagcgcucccugcucucugaccgaugcccuugaccauuuucaagucgauucccuggacgagauuaucccuaacgaucucaagaaaagcgaccugccgccccagcacgcuccuagaaauauuacaguuguggccguggaaggaugucacucuuucgucaucguggauugggacaaggcgacgcccggcgauguugugaccggcuaccuugucuauuccgccagcuacgaggacuuuauccgcaacaagugguccacacaggcuucuagcgugacccaucugccuauugaaaaucucaaacccaacacacgguauuacuucaagguucaggcccaaaacccucacggguauggacccaucuccccgagcgugucuuuugucaccgaguccgauaauccucugcugguggucagacccccuggcggggagcccauuuga

SEQ ID NO: 1623 - protein, 156 aa, Artificial Sequence
  fibronectin__Homo_sapiens__B4DIC5
MEEQRNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPGERGTH

SEQ ID NO: 1624 - RNA, 471 nt, Artificial Sequence
  fibronectin__Homo_sapiens__BAG58437
auggaagaacagaggaaugaagaaauucagagcuuuaucuacucccugaaacagaugcugcugaacguggaggcgaacucggcgaaggugcaggaggaccucgaagcagaguuccagucccucuucucccuccuggaggagcugaaagaaggcaugcuuaugaagauaaaacaggaccgugccagccgcaccuacgagcugcagaaccagcuggcugccugcacgcgggcccuggagagcuccgaggagcuucuggagacagccaaccagacucugcaggccauggacagcgaggacuuuccucaggcugccaagcaaaucaaagauggagugaccauggccccugccuuccggcuaucauugaaagcgaaggucagugacaacaugagucaccucaugguggacuucgcgcaagagcggcagaugcuacaggcacucaaguuccugccuggugagaggggcacgcacuag

SEQ ID NO: 1625 - RNA, 471 nt, Artificial Sequence
  derived and/or modified sequence opt1 from fibronectin__Homo_sapiens__BAG58437
auggaggagcagcgcaacgaggagauccagagcuucaucuacucccugaagcagaugcuccugaacguggaggccaacagcgccaagguccaggaggaccuggaggcggaguuccagucccucuucagccugcuggaggagcucaaggagggcaugcugaugaagaucaagcaggaccgggccucccgcaccuacgagcugcagaaccagcucgccgccugcacccgggcccuggagagcuccgaggagcugcucgagacggcgaaccagacccugcaggccauggacagcgaggacuucccccaggccgccaagcagaucaaggacggggugaccauggcgccggccuuccgccugucccucaaggccaaggugagcgacaacaugucccaccugauggucgacuucgcccaggagcggcagaugcugcaggcccucaaguuccugcccggcgagcgcgggacccacuga

SEQ ID NO: 1626 - RNA, 471 nt, Artificial Sequence
  derived and/or modified sequence opt2 from fibronectin__Homo_sapiens__BAG58437
auggaggagcagcgcaacgaggagauccaguccuucaucuacucccucaagcagaugcuccucaacgucgaggccaacuccgccaagguccaggaggaccucgaggccgaguuccagucccucuucucccuccucgaggagcucaaggagggcaugcucaugaagaucaagcaggaccgcgccucccgcaccuacgagcuccagaaccagcucgccgccugcacccgcgcccucgaguccuccgaggagcuccucgagaccgccaaccagacccuccaggccauggacuccgaggacuucccccaggccgccaagcagaucaaggacggcgucaccauggcccccgccuuccgccucucccucaaggccaaggucuccgacaacaugucccaccucauggucgacuucgcccaggagcgccagaugcuccaggcccucaaguuccuccccggcgagcgcggcacccacuga

SEQ ID NO: 1627 - RNA, 471 nt, Artificial Sequence
  derived and/or modified sequence opt3 from fibronectin__Homo_sapiens__BAG58437
auggaggaacagagaaacgaggaaauccagagcuucauuuacucccugaagcaaaugcuccuuaauguggaggccaacucugcuaaaguccaggaagaccuggaggcagaguuucagucauuguucaguuuacuggaggaacuaaaggaaggcaugcucaugaaaauaaagcaagauagggccagccggaccuaugagcugcagaaucagcuugcggcuugcacacgcgcccuggaguccucugaagaguugcucgaaacugcaaaccagacgcugcaagccauggacucggaggauuuuccccaggcugcaaaacagaucaaggacgggguuaccauggccccugcuuuccgacugucacucaaggccaaagugagcgauaauaugagucacuuaaugguagacuuugcgcaggaacgucaaaugcugcaggcacuuaaguucuugccaggagagagagguacacauuga

SEQ ID NO: 1628 - RNA, 471 nt, Artificial Sequence
  derived and/or modified sequence opt4 from fibronectin__Homo_sapiens__BAG58437
auggaggagcagagaaacgaggagauccagagcuucaucuacagccugaagcagaugcugcugaacguggaggccaacagcgccaaggugcaggaggaccuggaggccgaguuccagagccuguucagccugcuggaggagcugaaggagggcaugcugaugaagaucaagcaggacagagccagcagaaccuacgagcugcagaaccagcuggccgccugcaccagagcccuggagagcagcgaggagcugcuggagaccgccaaccagacccugcaggccauggacagcgaggacuucccccaggccgccaagcagaucaaggacggcgugaccauggcccccgccuucagacugagccugaaggccaaggugagcgacaacaugagccaccugaugguggacuucgcccaggagagacagaugcugcaggcccugaaguuccugcccggcgagagaggcacccacuga

SEQ ID NO: 1629 - RNA, 471 nt, Artificial Sequence
  derived and/or modified sequence opt5 from fibronectin__Homo_sapiens__BAG58437
auggaggaacagagaaacgaggaaauccagagcuucauuuacucccugaagcaaaugcuccugaauguggaggccaacucugcuaaaguccaggaagaccuugaggccgaguuucagagccuguucucccuccuggaagaacuuaaggaaggcaugcugaugaaaaucaagcaagaucgggcgucucgcaccuaugagcuccagaaucagcuggcugccugcacaagagcccuggagagcuccgaggagcuccuggaaacggcuaaccagacccuucaagccauggacucugaggauuuuccccaggcugccaaacagauuaaggacgggguuacaauggcgccugccuuccggcugagccucaaggcuaaaguguccgauaauaugagccaccugaugguggacuuugcccaggaacgccaaaugcuucaggcucugaaguuccucccgggagagagaggcacccauuga

SEQ ID NO: 1630 - protein, 306 aa, Artificial Sequence
  fibronectin__Homo_sapiens__B4DN21
MIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1631 - RNA, 921 nt, Artificial Sequence
  fibronectin__Homo_sapiens__BAH14721
augaucuuugaggaacaugguuuuaggcggaccacaccgcccacaacggccacccccauaaggcauaggccaagaccauacccgccgaauguaggacaagaagcucucucucagacaaccaucucaugggccccauuccaggacacuucugaguacaucauuucaugucauccuguuggcacugaugaagaacccuuacaguucaggguuccuggaacuucuaccagugccacucugacaggccucaccagaggugccaccuacaacaucauaguggaggcacugaaagaccagcagaggcauaagguucgggaagagguuguuaccgugggcaacucugucaacgaaggcuugaaccaaccuacggaugacucgugcuuugaccccuacacaguuucccauuaugccguuggagaugagugggaacgaaugucugaaucaggcuuuaaacuguugugccagugcuuaggcuuuggaaguggucauuucagaugugauucaucuagauggugccaugacaauggugugaacuacaagauuggagagaagugggaccgucagggagaaaauggccagaugaugagcugcacaugucuugggaacggaaaaggagaauucaagugugacccucaugaggcaacguguuaugaugaugggaagacauaccacguaggagaacaguggcagaaggaauaucucggugccauuugcuccugcacaugcuuuggaggccagcggggcuggcgcugugacaacugccgcagaccugggggugaacccagucccgaaggcacuacuggccaguccuacaaccaguauucucagagauaccaucagagaacaaacacuaauguuaauugcccaauugagugcuucaugccuuuagauguacaggcugacagagaagauucccgagaguaa

SEQ ID NO: 1632 - RNA, 921 nt, Artificial Sequence
  derived and/or modified sequence opt1 from fibronectin__Homo_sapiens__BAH14721
augaucuucgaggagcacggcuuccgccggaccacgcccccgaccaccgccacccccauccgccaccggccccgccccuacccgcccaacguggggcaggaggcccugagccagaccacgaucuccugggcgcccuuccaggacaccagcgaguacaucaucuccugccaccccgucggcaccgacgaggagccgcuccaguuccgggugcccgggaccagcacguccgccacccugaccggccugacccgcggggccacguacaacaucaucguggaggcccucaaggaccagcagcggcacaagguccgcgaggagguggugaccgucggcaacagcgugaacgagggccugaaccagcccaccgacgacuccugcuucgaccccuacaccgugagccacuacgccgucggggacgagugggagcggauguccgagagcggcuucaagcugcucugccagugccugggguucggcuccgggcacuuccgcugcgacagcucccgguggugccacgacaacggcgugaacuacaagaucggcgagaagugggaccgccagggggagaacggccagaugaugagcugcacgugccuggggaacggcaagggcgaguucaagugcgacccgcacgaggcgaccugcuacgacgacgggaagaccuaccacgugggcgagcaguggcagaaggaguaccucggggccaucugcuccugcacgugcuucggcgggcagcggggcuggcgcugcgacaacugccggcgccccggcggggagcccagccccgagggcaccaccgggcaguccuacaaccaguacagccagcgguaccaccagcgcaccaacaccaacgucaacugcccgaucgagugcuucaugccccuggacgugcaggccgaccgggaggacucccgcgaguga

SEQ ID NO: 1633 - RNA, 921 nt, Artificial Sequence
  derived and/or modified sequence opt2 from fibronectin__Homo_sapiens__BAH14721
augaucuucgaggagcacggcuuccgccgcaccaccccccccaccaccgccacccccauccgccaccgcccccgccccuacccccccaacgucggccaggaggcccucucccagaccaccaucuccugggcccccuuccaggacaccuccgaguacaucaucuccugccaccccgucggcaccgacgaggagccccuccaguuccgcguccccggcaccuccaccuccgccacccucaccggccucacccgcggcgccaccuacaacaucaucgucgaggcccucaaggaccagcagcgccacaagguccgcgaggaggucgucaccgucggcaacuccgucaacgagggccucaaccagcccaccgacgacuccugcuucgaccccuacaccgucucccacuacgccgucggcgacgagugggagcgcauguccgaguccggcuucaagcuccucugccagugccucggcuucggcuccggccacuuccgcugcgacuccucccgcuggugccacgacaacggcgucaacuacaagaucggcgagaagugggaccgccagggcgagaacggccagaugauguccugcaccugccucggcaacggcaagggcgaguucaagugcgacccccacgaggccaccugcuacgacgacggcaagaccuaccacgucggcgagcaguggcagaaggaguaccucggcgccaucugcuccugcaccugcuucggcggccagcgcggcuggcgcugcgacaacugccgccgccccggcggcgagcccucccccgagggcaccaccggccaguccuacaaccaguacucccagcgcuaccaccagcgcaccaacaccaacgucaacugccccaucgagugcuucaugccccucgacguccaggccgaccgcgaggacucccgcgaguga

SEQ ID NO: 1634 - RNA, 921 nt, Artificial Sequence
  derived and/or modified sequence opt3 from fibronectin__Homo_sapiens__BAH14721
augaucuucgaggaacacggcuuuagaaggaccacacccccuacuacggccaccccaauucggcaucgcccgcgacccuacccuccaaacguggggcaggaggcucugagccaaacaacuauauccugggcacccuuccaggacaccucugaauauaucauuucaugccacccugucggaacagaugaggaaccacuccaguuucguguucccgguaccaguacuagcgccacacuuaccggccugacgagaggggcgacuuacaauaucauuguggaggcuuugaaggaccagcaaaggcauaaaguacgggaggaaguggucaccgugggaaacuccguuaaugagggcuuaaaccagccuacagaugacucuuguuucgauccauauacugugucgcacuacgccgucggugacgaaugggagcgcaugucagagagcggguuuaagcugcuaugccagugucucggauucggcaguggccauuuuagaugcgauuccucuagguggugucacgacaauggggugaacuauaaaaucggagaaaagugggaucggcagggugagaauggccaaaugaugagcugcaccugucuggggaacggaaaaggcgaguucaagugcgacccgcacgaagcaacauguuacgaugacgguaagaccuaucauguaggggaacaguggcagaaagaguaccuuggagccauaugcuccuguacgugcuuuggcggccagcgcggguggcgaugcgauaauuguagaaggcccggaggugagccuucaccagaaggcacuacagggcaaaguuacaaccaguauagccagcgguaccaccaacguaccaauacuaacguuaauugccccaucgaguguuucaugccucuggacgugcaggcugaccgcgaagauucuagagaguga

SEQ ID NO: 1635 - RNA, 921 nt, Artificial Sequence
  derived and/or modified sequence opt4 from fibronectin__Homo_sapiens__BAH14721
augaucuucgaggagcacggcuucagaagaaccaccccccccaccaccgccacccccaucagacacagacccagacccuacccccccaacgugggccaggaggcccugagccagaccaccaucagcugggcccccuuccaggacaccagcgaguacaucaucagcugccaccccgugggcaccgacgaggagccccugcaguucagagugcccggcaccagcaccagcgccacccugaccggccugaccagaggcgccaccuacaacaucaucguggaggcccugaaggaccagcagagacacaaggugagagaggagguggugaccgugggcaacagcgugaacgagggccugaaccagcccaccgacgacagcugcuucgaccccuacaccgugagccacuacgccgugggcgacgagugggagagaaugagcgagagcggcuucaagcugcugugccagugccugggcuucggcagcggccacuucagaugcgacagcagcagauggugccacgacaacggcgugaacuacaagaucggcgagaagugggacagacagggcgagaacggccagaugaugagcugcaccugccugggcaacggcaagggcgaguucaagugcgacccccacgaggccaccugcuacgacgacggcaagaccuaccacgugggcgagcaguggcagaaggaguaccugggcgccaucugcagcugcaccugcuucggcggccagagaggcuggagaugcgacaacugcagaagacccggcggcgagcccagccccgagggcaccaccggccagagcuacaaccaguacagccagagauaccaccagagaaccaacaccaacgugaacugccccaucgagugcuucaugccccuggacgugcaggccgacagagaggacagcagagaguga

SEQ ID NO: 1636 - RNA, 921 nt, Artificial Sequence
  derived and/or modified sequence opt5 from fibronectin__Homo_sapiens__BAH14721
augaucuucgaggaacacggcuuuagacggaccacacccccuacgaccgccacaccgauucgccauagaccccggccuuaucccccuaacguggggcaggaggcucugagccaaaccacaaucuccugggcccccuuccaggacaccucugaauacauuaucagcugccacccugucggaacagaugaggaaccgcuccaguuucgcguucccggcaccuccacgucugcgacccugacagggcuuaccagaggagcuacauacaauauuaucguggaggcccugaaggaccagcaacggcauaaagugcgcgaggaagucgugaccguuggcaacagcgugaaugaggggcucaaccagccuacggaugacuccuguuucgaucccuauacagucucucacuacgccgugggagacgaaugggagagaaugagcgaguccggcuuuaagcugcuuugccagugucugggcuucgggagcggacauuuucggugcgauucuucccgcuggugucacgacaauggcguuaacuauaaaaucggggaaaagugggauagacagggagagaauggccaaaugaugagcugcaccugucucgggaacggaaaaggcgaguucaagugcgacccucacgaagcuacauguuacgaugacggcaagaccuaucaugugggggaacaguggcagaaagaguaccugggagccauuugcucuuguaccugcuuuggcgggcagcggggauggcgcugcgauaauuguagacggcccggcggggagccguccccugaaggaacaacgggccaaagcuacaaccaguauucucagcgcuaccaccaaagaaccaauacaaacgucaauugccccaucgaguguuucaugccucuggacgugcaggcugaccgggaagauuccagagaguga

SEQ ID NO: 1637 - protein, 639 aa, Artificial Sequence [sequence omitted]

SEQ ID NO: 1638 - RNA, 1920 nt, Artificial Sequence
  fibronectin__Homo_sapiens__BAG61560
auggaaaaaauucuuuuuuaucuguuucucauuggcauagcagugaaagcucagaucuguccaaagcguugugucugucagauuuugucuccuaaucuugcaacccuuugugccaagaaagggcuuuuauuuguuccaccaaacauugacagaagaacuguggaacugcgguuggcagacaauuuuguuacaaauauuaaaaggaaagauuuugccaauaugaccagcuugguggaccugacucuauccaggaauacaauaaguuuuauuacaccucaugcuuucgcugaccuacgaaauuugaggucuuugcauuugaauagcaacagauugacuaaaauuacaaaugauauguucaguggucuuuccaaucuucaucauuugauacugaacaacaaucagcugacuuuaauuuccucuacagcguuugaugaugucuucgcccuugaggagcuggaucuguccuauaauaaucuagaaaccauuccuugggaugcuguugagaagaugguuagcuugcauacccuuaguuuggaucacaauaugauugauaacauuccuaaggggaccuucucccauuugcacaagaugacucgguuagaugugacaucaaauaaauugcagaagcuaccaccugacccucucuuucagcgagcucagguacuagcaaccucaggaaucauaagcccaucuacuuuugcauuaaguuuugguggaaaccccuugcauugcaauugugaauuguugugguugaggcgucuguccagagaauaugacuuagagaccugugcuucuccuccacuuuuaacuggccgcuacuuuuggucaauuccugaagaagaguuuuugugugagccuccucucauuacucgucauacacaugagaugagaguccuggagggacaaagggcaacacugaggugcaaagccaggggagacccugagccugcaauucacuggauuucuccugaagggaagcuuauuucaaaugcaacaagaucucugguguaugauaacggaacacuugacauucuuaucacaacuguaaaggauacaggugcuuuuaccugcauugcuuccaauccugcuggggaagcaacacaaauaguggaucuucauauaauuaagcucccucacuuacuaaauaguacaaaccauauccaugagccugauccugguucuucagauaucucaacuucuaccaagucagguucuaauacaagcaguaguaaugauggcaucacuucccucacugccacaagagucguggguugcauccaguuuacuacggaacaggauuaugugcguugccauuucaugcagucccaguuuuugggaggcaccaugauuauuauuauugguggaaucauuguagcaucugugcugguauucaucauuauucugaugauccgguauaagguuugcaacaauaaugggcaacacaaggucaccaagguuagcaauguuuauucccaaacuaacggggcucaaauacaaggcuguaguguaacgcugccccaguccguguccaaacaagcugugggacacgaagagaaugcccaguguuguaaagcuaccagugacaaugugauucaaucuucagaaacuuguucgagucaggacuccgcuaccacuaccucugcuuugccuccuuccuggacuucaagcacuucugugucccaaaagcagaaaagaaagacuggcacaaagccaaguacagaaccacagaaugaagccgucacaaauguugaaucccaaaacacuaacaggaacaacucaacugccuugcaguuagcuagccguccucccgauucugucacagaggggcccacgucuaaaagagcacauauaaagccaaaugcuuugcugacuaauguugaccagauuguccaggaaacacagaggcuggaguuaaucuga

SEQ ID NO: 1639 - RNA, 1920 nt, Artificial Sequence
  derived and/or modified sequence opt1 from fibronectin__Homo_sapiens__BAG61560
auggagaagauccuguucuaccucuuccugaucggcaucgccgugaaggcccagaucugccccaagcgcugcgucugccagauccugagcccgaaccucgcgacccugugcgccaagaaggggcuccuguucgugccgcccaacaucgaccggcgcaccguggagcugcggcuggccgacaacuucgucacgaacaucaagcgcaaggacuucgccaacaugaccucccucguggaccugacccugagccggaacaccaucuccuucaucacgccccacgccuucgcggaccuccgcaaccugcggagccugcaccucaacuccaaccgccugaccaagaucaccaacgacauguucagcggccuguccaaccuccaccaccugauccugaacaacaaccagcucacccugaucagcuccacggccuucgacgacguguucgcccuggaggagcucgaccugagcuacaacaaccuggagaccauccccugggacgccgucgagaagauggugucccuccacacccugagccuggaccacaacaugaucgacaacauccccaaggggaccuucucccaccuccacaagaugacgcggcuggacgugaccagcaacaagcugcagaagcucccgcccgacccccuguuccagcgcgcgcagguccuggccaccuccggcaucaucagccccuccaccuucgcccucagcuucgggggcaacccccugcacugcaacugcgagcugcucuggcugcggcgccugucccgggaguacgaccucgagacgugcgccagcccgccccugcugaccggccgcuacuucuggagcauccccgaggaggaguuccucugcgagccgccccugaucacccggcacacccacgagaugcgcgugcuggaggggcagcgggccacgcuccgcugcaaggcgcggggcgaccccgagcccgccauccacuggaucucccccgaggggaagcugaucagcaacgccacccgcucccugguguacgacaacggcacccuggacauccucaucaccacggucaaggacaccggggccuucacgugcaucgccagcaaccccgcgggcgaggccacccagaucguggaccugcacaucaucaagcugccgcaccuccugaacuccaccaaccacauccacgagcccgaccccggcagcuccgacaucagcaccuccaccaagagcggguccaacaccagcuccagcaacgacggcaucacgucccugaccgccacccggguggucgggugcauccaguucaccacggagcaggacuacgugcgcugccacuucaugcagagccaguuccucggcggcaccaugaucaucaucaucgggggcaucaucguggccuccguccugguguucaucaucauccugaugauccgcuacaaggugugcaacaacaacgggcagcacaaggucaccaaggugagcaacguguacucccagaccaacggcgcccagauccaggggugcagcgucacccucccccagagcguguccaagcaggcggucggccacgaggagaacgcccagugcugcaaggccacgagcgacaacgugauccaguccagcgagaccugcuccagccaggacuccgccaccaccacgagcgcccugccgcccuccuggaccagcuccaccagcgugucccagaagcagaagcggaagaccggcacgaagcccagcaccgagccccagaacgaggcggucaccaacguggagucccagaacaccaaccgcaacaacagcacggcccugcagcucgccucccggccgcccgacagcgugaccgaggggcccaccagcaagcgcgcccacaucaagccgaacgcgcugcugaccaacgucgaccagaucgugcaggagacgcagcggcucgagcugaucuga

SEQ ID NO: 1640 - RNA, 1920 nt, Artificial Sequence
  derived and/or modified sequence opt2 from fibronectin__Homo_sapiens__BAG61560
auggagaagauccucuucuaccucuuccucaucggcaucgccgucaaggcccagaucugccccaagcgcugcgucugccagauccucucccccaaccucgccacccucugcgccaagaagggccuccucuucgucccccccaacaucgaccgccgcaccgucgagcuccgccucgccgacaacuucgucaccaacaucaagcgcaaggacuucgccaacaugaccucccucgucgaccucacccucucccgcaacaccaucuccuucaucaccccccacgccuucgccgaccuccgcaaccuccgcucccuccaccucaacuccaaccgccucaccaagaucaccaacgacauguucuccggccucuccaaccuccaccaccucauccucaacaacaaccagcucacccucaucuccuccaccgccuucgacgacgucuucgcccucgaggagcucgaccucuccuacaacaaccucgagaccauccccugggacgccgucgagaagauggucucccuccacacccucucccucgaccacaacaugaucgacaacauccccaagggcaccuucucccaccuccacaagaugacccgccucgacgucaccuccaacaagcuccagaagcucccccccgacccccucuuccagcgcgcccagguccucgccaccuccggcaucaucucccccuccaccuucgcccucuccuucggcggcaacccccuccacugcaacugcgagcuccucuggcuccgccgccucucccgcgaguacgaccucgagaccugcgccucccccccccuccucaccggccgcuacuucugguccauccccgaggaggaguuccucugcgagcccccccucaucacccgccacacccacgagaugcgcguccucgagggccagcgcgccacccuccgcugcaaggcccgcggcgaccccgagcccgccauccacuggaucucccccgagggcaagcucaucuccaacgccacccgcucccucgucuacgacaacggcacccucgacauccucaucaccaccgucaaggacaccggcgccuucaccugcaucgccuccaaccccgccggcgaggccacccagaucgucgaccuccacaucaucaagcucccccaccuccucaacuccaccaaccacauccacgagcccgaccccggcuccuccgacaucuccaccuccaccaaguccggcuccaacaccuccuccuccaacgacggcaucaccucccucaccgccacccgcgucgucggcugcauccaguucaccaccgagcaggacuacguccgcugccacuucaugcagucccaguuccucggcggcaccaugaucaucaucaucggcggcaucaucgucgccuccguccucgucuucaucaucauccucaugauccgcuacaaggucugcaacaacaacggccagcacaaggucaccaaggucuccaacgucuacucccagaccaacggcgcccagauccagggcugcuccgucacccucccccaguccgucuccaagcaggccgucggccacgaggagaacgcccagugcugcaaggccaccuccgacaacgucauccaguccuccgagaccugcuccucccaggacuccgccaccaccaccuccgcccucccccccuccuggaccuccuccaccuccgucucccagaagcagaagcgcaagaccggcaccaagcccuccaccgagccccagaacgaggccgucaccaacgucgagucccagaacaccaaccgcaacaacuccaccgcccuccagcucgccucccgcccccccgacuccgucaccgagggccccaccuccaagcgcgcccacaucaagcccaacgcccuccucaccaacgucgaccagaucguccaggagacccagcgccucgagcucaucuga

SEQ ID NO: 1641 - RNA, 1920 nt, Artificial Sequence
  derived and/or modified sequence opt3 from fibronectin__Homo_sapiens__BAG61560
auggagaagauccuguucuaccucuuucuuauuggcauagccgugaaagcucagaucugccccaagagaugugucugccaaauucugagcccuaacuuggcaaccuuaugugccaaaaaggggcugcuauucguuccaccgaauaucgacaggcggacaguggaacuccgccuggcggauaacuuuguaacuaauauuaaacgaaaggacuucgcuaacaugacgucccuuguggaucugaccuugucucguaauacaaucucauuuauaacuccccacgccuucgcagaccucagaaaccugaggagucugcaucucaauagcaaccgguuaaccaagaucacaaaugauauguuuuccggacugucuaaccuucaccauuugauucugaauaacaaucagcuaacccucaucucgucaacugccuucgacgaugucuuugcucuggaggaacuugaccugagcuauaacaauuuggagacaauuccuugggaugcaguggaaaagaugguuagucuccacacccuguccuuagaccauaacaugaucgauaacauaccaaaggguacguucucucaccuucacaaaaugacucgccucgacgugaccagcaauaagcugcagaaacugcccccugauccauuguuucagagagcccaaguccuagcuacauccggcauuaucucacccaguacuuucgcccugagcuuugggggaaacccucuccauugcaauugugagcugcuuuggcugaggcgguugucucgcgaguacgaccucgaaaccugcgcguccccaccgcuguuaacaggccgauauuucuggucaauucccgaggaagaguuccugugugagccuccacuaaucaccagacacacgcaugaaaugagggugcucgagggucagcgggcaacucugcguugcaaggcccgcggggaccccgaaccugcuauccacuggauuagcccagagggaaaacuuauaaguaacgccacaagaucuuugguauacgauaauggcacccuggacauccucauuacuacaguuaaagauaccggcgcauuuacguguaucgcuuccaaccccgccggggaagcgacccagauaguggaccugcacauuaucaaacuuccgcaucuguugaauagcacaaaccacauccaugagccugaucccggaucgucugacauuuccacuucaaccaagagugguagcaauacauccucuagcaacgauggcaucacuucacucaccgccacaagggucguggggugcauucaguucaccacugagcaagacuaugugcggugucacuuuaugcagagucaguuccugggaggcacgaugauaaucauuaucggugggaucauugucgcauccguuuuaguguuuauaaucauucugaugauccgauacaagguaugcaauaacaauggacagcauaaagugacaaaggucagcaacguguauucucaaaccaauggcgcucagauucagggcugcucaguuacucuaccacaaagugugagcaaacaggccgucgggcacgaagagaacgcucaguguugcaaggccaccuccgauaacgugauccagucuucggaaacauguagcucccaagacucagcaaccacuacaagugcccucccucccucuuggacgagcuccaccucaguaagccagaagcagaaacgcaagacuggaacaaaaccaucuaccgagccccagaaugaagcuguuacaaacguggagucccaaaauacuaacagaaauaacaguaccgcgcugcagcuugcaagcaggccuccagauucugucacggaggguccgaccuccaagcgggcccacauaaaacccaaugcuuugcugacaaacguggaccagaucguccaggaaacucaacgccucgagcugauuuga

SEQ ID NO: 1642 - RNA, 1920 nt, Artificial Sequence
  derived and/or modified sequence opt4 from fibronectin__Homo_sapiens__BAG61560
auggagaagauccuguucuaccuguuccugaucggcaucgccgugaaggcccagaucugccccaagagaugcgugugccagauccugagccccaaccuggccacccugugcgccaagaagggccugcuguucgugccccccaacaucgacagaagaaccguggagcugagacuggccgacaacuucgugaccaacaucaagagaaaggacuucgccaacaugaccagccugguggaccugacccugagcagaaacaccaucagcuucaucaccccccacgccuucgccgaccugagaaaccugagaagccugcaccugaacagcaacagacugaccaagaucaccaacgacauguucagcggccugagcaaccugcaccaccugauccugaacaacaaccagcugacccugaucagcagcaccgccuucgacgacguguucgcccuggaggagcuggaccugagcuacaacaaccuggagaccauccccugggacgccguggagaagauggugagccugcacacccugagccuggaccacaacaugaucgacaacauccccaagggcaccuucagccaccugcacaagaugaccagacuggacgugaccagcaacaagcugcagaagcugccccccgacccccuguuccagagagcccaggugcuggccaccagcggcaucaucagccccagcaccuucgcccugagcuucggcggcaacccccugcacugcaacugcgagcugcuguggcugagaagacugagcagagaguacgaccuggagaccugcgccagccccccccugcugaccggcagauacuucuggagcauccccgaggaggaguuccugugcgagcccccccugaucaccagacacacccacgagaugagagugcuggagggccagagagccacccugagaugcaaggccagaggcgaccccgagcccgccauccacuggaucagccccgagggcaagcugaucagcaacgccaccagaagccugguguacgacaacggcacccuggacauccugaucaccaccgugaaggacaccggcgccuucaccugcaucgccagcaaccccgccggcgaggccacccagaucguggaccugcacaucaucaagcugccccaccugcugaacagcaccaaccacauccacgagcccgaccccggcagcagcgacaucagcaccagcaccaagagcggcagcaacaccagcagcagcaacgacggcaucaccagccugaccgccaccagaguggugggcugcauccaguucaccaccgagcaggacuacgugagaugccacuucaugcagagccaguuccugggcggcaccaugaucaucaucaucggcggcaucaucguggccagcgugcugguguucaucaucauccugaugaucagauacaaggugugcaacaacaacggccagcacaaggugaccaaggugagcaacguguacagccagaccaacggcgcccagauccagggcugcagcgugacccugccccagagcgugagcaagcaggccgugggccacgaggagaacgcccagugcugcaaggccaccagcgacaacgugauccagagcagcgagaccugcagcagccaggacagcgccaccaccaccagcgcccugccccccagcuggaccagcagcaccagcgugagccagaagcagaagagaaagaccggcaccaagcccagcaccgagccccagaacgaggccgugaccaacguggagagccagaacaccaacagaaacaacagcaccgcccugcagcuggccagcagaccccccgacagcgugaccgagggccccaccagcaagagagcccacaucaagcccaacgcccugcugaccaacguggaccagaucgugcaggagacccagagacuggagcugaucuga

SEQ ID NO: 1643 - RNA, 1920 nt, Artificial Sequence
  derived and/or modified sequence opt5 from fibronectin__Homo_sapiens__BAG61560
auggagaagauccuguucuaccucuuucugauuggcaucgccgugaaagcucagauuugccccaagagaugugucugccaaauccuuagcccuaaccuggccacccucugugcgaaaaaggggcugcuuuucguuccgcccaauauugaccggcgcacaguggaacugagacucgcugauaacuuugugacgaauaucaaacggaaggacuucgccaacaugaccucccuggucgaucugacacucucucgcaauaccaucagcuuuauuacaccucacgccuucgcugaccugagaaaccuucggucccugcaucucaauucuaaccgccugaccaagaucacaaaugauauguuuagcggacuuuccaaccugcaccaucucauucugaauaacaaucagcugacccucaucucuagcacggccuucgacgauguguuugcucuggaggaacuugaccuguccuauaacaaucucgagaccauucccugggaugccguugagaaaauggugagccugcacacacuuucucuggaccauaacaugaucgauaacauuccuaagggcaccuucucccaccuccacaaaaugacaagacuggacgucaccagcaauaagcugcagaaacugcccccugauccgcuguuucagcgggcgcaagugcuugccacgucugggaucaucucccccagcacauucgcucugucuuuuggaggcaacccucuccauugcaauugugaacugcuuuggcugcgcagacucucccgggaguacgaccuggaaaccugcgccagcccuccccugcucacagggcgcuauuucugguccauucccgaggaagaguuccugugugagccgccucuuaucaccagacacacccaugaaaugcggguucuggagggacagcgcgcuacacucagaugcaaggcccggggcgaccccgaaccugcgauucacuggaucucucccgagggcaagcugauuagcaacgccacgagaucccugguguacgauaaugggacccuugacauccucaucacaaccgucaaagauacaggagcuuuuaccuguauugccagcaaccccgcuggcgaagccacgcagaucguggaccugcacauuaucaagcugccucaucuccucaauucuacaaaccacauucaugagccggaucccggguccagcgacaucucuaccagcaccaaauccggaucuaauacaagcuccagcaacgauggcaucaccucucuuacagccacgcgcguggucgggugcauucaguucaccacagagcaagacuauguucggugucacuuuaugcagucccaguuccugggaggcaccaugaucauuaucauuggcgggaucauuguggcuagcgugcucgucuuuaucaucauucugaugaucagauacaaggugugcaauaacaauggacagcauaaaguuacaaaggugucuaacgucuauucccaaaccaauggcgcgcagauucaggggugcagcgugacgcugccucaauccguuucuaaacaggccgugggacacgaagagaacgcucaguguugcaaggccaccagcgauaacgucauccaguccucugaaacauguagcucccaagacagcgccaccacaaccucugcccuucccccuuccuggacgagcucuacauccgugagccagaagcagaaacgcaagaccggcacaaaacccucuaccgagccgcagaaugaagcugucaccaacguggagagccaaaauacaaaccggaauaacuccacggcgcuccagcuggcuagcagaccucccgauucuguuaccgaggggccuacauccaagcgcgcccacauuaaacccaaugcccugcucaccaacguggaccagaucguccaggaaacacaacggcuggagcuuaucuga

SEQ ID NO: 1644 - protein, 337 aa, Artificial Sequence [sequence omitted]

SEQ ID NO: 1645 - RNA, 1014 nt, Artificial Sequence
  fibronectin__Homo_sapiens__BAG61984
augaucuuugaggaacaugguuuuaggcggaccacaccgcccacaacggccacccccauaaggcauaggccaagaccauacccgccgaauguaggugaggaaauccaaauuggucacauccccagggaagauguagacuaucaccuguacccacacgguccgggacucaauccaaaugccucuacaggacaagaagcucucucucagacaaccaucucaugggccccauuccaggacacuucugaguacaucauuucaugucauccuguuggcacugaugaagaacccuuacaguucaggguuccuggaacuucuaccagugccacucugacaggccucaccagaggugccaccuacaacaucauaguggaggcacugaaagaccagcagaggcauaagguucgggaagagguuguuaccgugggcaacucugucaacgaaggcuugaaccaaccuacggaugacucgugcuuugaccccuacacaguuucccauuaugccguuggagaugagugggaacgaaugucugaaucaggcuuuaaacuguugugccagugcuuaggcuuuggaaguggucauuucagaugugauucaucuagauggugccaugacaauggugugaacuacaagauuggagagaagugggaccgucagggagaaaauggccagaugaugagcugcacaugucuugggaacggaaaaggagaauucaagugugacccucaugaggcaacguguuaugaugaugggaagacauaccacguaggagaacaguggcagaaggaauaucucggugccauuugcuccugcacaugcuuuggaggccagcggggcuggcgcugugacaacugccgcagaccugggggugaacccagucccgaaggcacuacuggccaguccuacaaccaguauucucagagauaccaucagagaacaaacacuaauguuaauugcccaauugagugcuucaugccuuuagauguacaggcugacagagaagauucccgagaguaa

SEQ ID NO: 1646 - RNA, 1014 nt, Artificial Sequence
  derived and/or modified sequence opt1 from fibronectin__Homo_sapiens__BAG61984
augaucuucgaggagcacggcuuccgccggaccacgcccccgaccaccgccacccccauccgccaccggccccgccccuacccgcccaacgugggggaggagauccagaucggccacaucccccgggaggacgucgacuaccaccuguacccccacgggccgggccucaaccccaacgccagcaccgggcaggaggcccugucccagacgaccaucagcugggcccccuuccaggacaccuccgaguacaucaucagcugccaccccgugggcaccgacgaggagccgcugcaguuccgcgugcccggcacguccaccagcgccacccucaccgggcugacgcggggcgccaccuacaacaucaucgucgaggcccugaaggaccagcagcgccacaaggugcgggaggagguggucaccguggggaacuccgugaacgagggccucaaccagcccaccgacgacagcugcuucgaccccuacacggucucccacuacgcggugggggacgagugggagcgcaugagcgaguccggcuucaagcugcugugccagugccucggcuucgggagcggccacuuccggugcgacuccagccgcuggugccacgacaacggggugaacuacaagaucggcgagaagugggaccggcagggcgagaacgggcagaugauguccugcacgugccugggcaacgggaagggcgaguucaagugcgacccgcacgaggcgaccugcuacgacgacgggaagaccuaccacgucggcgagcaguggcagaaggaguaccugggcgccaucugcagcugcacgugcuucgggggccagcgcggguggcggugcgacaacugccgccggcccggcggggagcccucccccgagggcaccaccggccagagcuacaaccaguacucccagcgcuaccaccagcggaccaacaccaacgugaacugcccgaucgagugcuucaugccccucgacgugcaggccgaccgcgaggacagccgggaguga

SEQ ID NO: 1647 - RNA, 1014 nt, Artificial Sequence
  derived and/or modified sequence opt2 from fibronectin__Homo_sapiens__BAG61984
augaucuucgaggagcacggcuuccgccgcaccaccccccccaccaccgccacccccauccgccaccgcccccgccccuacccccccaacgucggcgaggagauccagaucggccacaucccccgcgaggacgucgacuaccaccucuacccccacggccccggccucaaccccaacgccuccaccggccaggaggcccucucccagaccaccaucuccugggcccccuuccaggacaccuccgaguacaucaucuccugccaccccgucggcaccgacgaggagccccuccaguuccgcguccccggcaccuccaccuccgccacccucaccggccucacccgcggcgccaccuacaacaucaucgucgaggcccucaaggaccagcagcgccacaagguccgcgaggaggucgucaccgucggcaacuccgucaacgagggccucaaccagcccaccgacgacuccugcuucgaccccuacaccgucucccacuacgccgucggcgacgagugggagcgcauguccgaguccggcuucaagcuccucugccagugccucggcuucggcuccggccacuuccgcugcgacuccucccgcuggugccacgacaacggcgucaacuacaagaucggcgagaagugggaccgccagggcgagaacggccagaugauguccugcaccugccucggcaacggcaagggcgaguucaagugcgacccccacgaggccaccugcuacgacgacggcaagaccuaccacgucggcgagcaguggcagaaggaguaccucggcgccaucugcuccugcaccugcuucggcggccagcgcggcuggcgcugcgacaacugccgccgccccggcggcgagcccucccccgagggcaccaccggccaguccuacaaccaguacucccagcgcuaccaccagcgcaccaacaccaacgucaacugccccaucgagugcuucaugccccucgacguccaggccgaccgcgaggacucccgcgaguga

SEQ ID NO: 1648 - RNA, 1014 nt, Artificial Sequence
  derived and/or modified sequence opt3 from fibronectin__Homo_sapiens__BAG61984
augaucuucgaggaacacggcuuuagaaggaccacacccccuacuacggccaccccaauucggcaucgcccgcgacccuacccuccaaacgugggggaggaaauacagaucggacacauuccccgugaggacgucgauuaucaucuguacccucacgguccaggccucaaucccaacgcuagcacagggcaagaagcacuuucccagacuaccaucucuugggccccuuuccaggacacaucagaguauauuaucaguugccauccaguuggaaccgaugaggaaccgcugcaguuuagagugcccggcacuagcacauccgcgaccuugacggguuuaacuaggggagcuaccuacaauauaaucguagaggcccugaaggaccaacagcggcacaaagugcgcgaagaggucgugacaguugggaacucugugaaugagggccuaaaccagccuacugaugacucguguuucgauccauauaccgucucacacuacgcagugggcgacgaaugggagagaaugagcgaaaguggguuuaagcuccugugccagugucuuggauucgguuccggccauuuuaggugcgauucuagccgguggugucacgacaaugggguaaacuauaaaauuggagagaagugggaucgccaaggcgaaaauggucagaugauguccugcacaugucuggggaacggaaaaggcgaguucaagugcgacccccaugaggccaccuguuacgaugacggcaagacguaccacguuggggaacaguggcagaaagaguauuugggagcuaucugcucauguacuugcuuugguggccaacgaggguggagaugcgacaauuguaggcggccuggaggcgaaccaagucccgaggguacaaccgggcagagcuacaaccaguauucucaacguuaccaccagcgcacuaauacaaacgugaauugcccgauugaauguuucaugccucucgauguccaggcagacagagaggauuccagggaguga

SEQ ID NO: 1649 - RNA, 1014 nt, Artificial Sequence
  derived and/or modified sequence opt4 from fibronectin__Homo_sapiens__BAG61984
augaucuucgaggagcacggcuucagaagaaccaccccccccaccaccgccacccccaucagacacagacccagacccuacccccccaacgugggcgaggagauccagaucggccacauccccagagaggacguggacuaccaccuguacccccacggccccggccugaaccccaacgccagcaccggccaggaggcccugagccagaccaccaucagcugggcccccuuccaggacaccagcgaguacaucaucagcugccaccccgugggcaccgacgaggagccccugcaguucagagugcccggcaccagcaccagcgccacccugaccggccugaccagaggcgccaccuacaacaucaucguggaggcccugaaggaccagcagagacacaaggugagagaggagguggugaccgugggcaacagcgugaacgagggccugaaccagcccaccgacgacagcugcuucgaccccuacaccgugagccacuacgccgugggcgacgagugggagagaaugagcgagagcggcuucaagcugcugugccagugccugggcuucggcagcggccacuucagaugcgacagcagcagauggugccacgacaacggcgugaacuacaagaucggcgagaagugggacagacagggcgagaacggccagaugaugagcugcaccugccugggcaacggcaagggcgaguucaagugcgacccccacgaggccaccugcuacgacgacggcaagaccuaccacgugggcgagcaguggcagaaggaguaccugggcgccaucugcagcugcaccugcuucggcggccagagaggcuggagaugcgacaacugcagaagacccggcggcgagcccagccccgagggcaccaccggccagagcuacaaccaguacagccagagauaccaccagagaaccaacaccaacgugaacugccccaucgagugcuucaugccccuggacgugcaggccgacagagaggacagcagagaguga

SEQ ID NO: 1650 - RNA, 1014 nt, Artificial Sequence
  derived and/or modified sequence opt5 from fibronectin__Homo_sapiens__BAG61984
augaucuucgaggaacacggcuuuagacggaccacacccccuacgaccgccacaccgauucgccauagaccccggccuuaucccccuaacgugggggaggaaauccagauuggacacaucccccgcgaggacgucgauuaccaucuguacccucacggcccggggcucaaucccaacgcuagcaccggacaagaagcccugucccagacaaccauuucuugggcgccuuuccaggacacaagcgaguauaucaucuccugccaucccguuggcaccgaugaggaaccucuucaguuuagagugcccgggacgucuaccagcgcuacacugaccggacucacacggggcgccaccuacaauauuaucguggaggcccugaaggaccaacagcgccacaaagucagagaagaggugguuacggugggcaacuccgucaaugaggggcuuaaccagccgacagaugacucuuguuucgauccuuauaccgugagccacuacgcuguuggagacgaaugggagcggauguccgaaagcggcuuuaagcugcucugccagugucugggguucggaucuggccauuuucgcugcgauuccagcagauggugucacgacaauggggugaacuauaaaauuggagagaagugggaucggcaaggcgaaaauggccagaugaugucuugcacaugucuggggaacggaaaaggcgaguucaagugcgacccccaugaggccaccuguuacgaugacgggaagaccuaccacgucggagaacaguggcagaaagaguaucucggcgcuaucugcuccuguacaugcuuugggggacaacgcggcuggagaugcgacaauugucggcgcccuggcggggaacccagccccgagggaacgaccggccagucuuacaaccaguauucccaaagauaccaccagcggacaaauaccaacgugaauugcccuauugaauguuucaugccgcuggaugugcaggccgacagagaggauagccgcgaguga

SEQ ID NO: 1651 - protein, 1014 aa, Artificial Sequence [sequence omitted]

SEQ ID NO: 1652 - RNA, 3045 nt, Artificial Sequence
  fibronectin__Homo_sapiens__BAG62013
augcgugucaccugggcuccacccccauccauugauuuaaccaacuuccuggugcguuacucaccugugaaaaaugaggaagauguugcagaguugucaauuucuccuucagacaaugcaguggucuuaacaaaucuccugccugguacagaauauguagugagugucuccagugucuacgaacaacaugagagcacaccucuuagaggaagacagaaaacaggucuugauuccccaacuggcauugacuuuucugauauuacuggcaacucuuuuacugugcacuggauugcuccucgagccaccaucacuggcuacaggauccgccaucaucccgagcacuucagugggagaccucgagaagaucgggugccccacucucggaauuccaucacccucaccaaccucacuccaggcacagaguauguggucagcaucguugcucuuaauggcagagaggaaagucccuuauugauuggccaacaaucaacaguuucugauguuccgagggaccuggaaguuguugcugcgacccccaccagccuacugaucagcugggaugcuccugcugucacagugagauauuacaggaucacuuacggagaaacaggaggaaauagcccuguccaggaguucacugugccugggagcaagucuacagcuaccaucagcggccuuaaaccuggaguugauuauaccaucacuguguaugcugucacuggccguggagacagccccgcaagcagcaagccaauuuccauuaauuaccgaacagaaauugacaaaccaucccagaugcaagugaccgauguucaggacaacagcauuagugucaaguggcugccuucaaguuccccuguuacugguuacagaguaaccaccacucccaaaaauggaccaggaccaacaaaaacuaaaacugcagguccagaucaaacagaaaugacuauugaaggcuugcagcccacaguggaguaugugguuagugucuaugcucagaauccaagcggagagagucagccucugguucagacugcaguaaccacuauuccugcaccaacugaccugaaguucacucaggucacacccacaagccugagcgcccaguggacaccacccaauguucagcucacuggauaucgagugcgggugacccccaaggagaagaccggaccaaugaaagaaaucaaccuugcuccugacagcucauccgugguuguaucaggacuuaugguggccaccaaauaugaagugagugucuaugcucuuaaggacacuuugacaagcagaccagcucaggguguugucaccacucuggagaaugucagcccaccaagaagggcucgugugacagaugcuacugagaccaccaucaccauuagcuggagaaccaagacugagacgaucacuggcuuccaaguugaugccguuccagccaauggccagacuccaauccagagaaccaucaagccagaugucagaagcuacaccaucacagguuuacaaccaggcacugacuacaagaucuaccuguacaccuugaaugacaaugcucggagcuccccuguggucaucgacgccuccacugccauugaugcaccauccaaccugcguuuccuggccaccacacccaauuccuugcugguaucauggcagccgccacgugccaggauuaccggcuacaucaucaaguaugagaagccugggucuccucccagagaaguggucccucggccccgcccuggugucacagaggcuacuauuacuggccuggaaccgggaaccgaauauacaauuuaugucauugcccugaagaauaaucagaagagcgagccccugauuggaaggaaaaagacagacgagcuuccccaacugguaacccuuccacaccccaaucuucauggaccagagaucuuggauguuccuuccacaguucaaaagaccccuuucgucacccacccuggguaugacacuggaaaugguauucagcuuccuggcacuucuggucagcaacccaguguugggcaacaaaugaucuuugaggaacaugguuuuaggcggaccacaccgcccacaacggccacccccauaaggcauaggccaaggccauacccgccgaauguaggugaggaaauccaaauuggucacauccccagggaagauguagacuaucaccuguacccacacgguccgggacucaauccaaaugccucuacaggacaagaagcucucucucagacaaccaucucaugggccccauuccaggacacuucugaguacaucauuucaugucauccuguuggcacugaugaagaacccuuacaguucaggguuccuggaacuucuaccagugccacucugacaggccucaccagaggugccaccuacaacaucauaguggaggcacugaaagaccagcagaggcauaagguucgggaagagguuguuaccgugggcaacucugucaacgaaggcuugaaccaaccuacggaugacucgugcuuugaccccuacacaguuucccauuaugccguuggagaugagugggaacgaaugucugaaucaggcuuuaaacuguugugccagugcuuaggcuuuggaaguggccauuucagaugugauucaucuagauggugccaugacaauggugugaacuacaagauuggagagaagugggaccgucagggagaaaauggccagaugaugagcugcacaugucuugggaacggaaaaggagaauucaagugugacccucaugaggcaacguguuacgaugaugggaagacauaccacguaggagaacaguggcagaaggaauaucucggugccauuugcuccugcacaugcuuuggaggccagcggggcuggcgcugugacaacugccgcagaccugggggugaacccagucccgaaggcacuacuggccaguccuacaaccaguauucucagagauaccaucagagaacaaacacuaauguuaauugcccaauugagugcuucaugccuuuagauguacaggcugacagagaagauucccgagaguaa

SEQ ID NO: 1653 - RNA, 3045 nt, Artificial Sequence
  derived and/or modified sequence opt1 from fibronectin__Homo_sapiens__BAG62013
augcgcgugaccugggcccccccgcccagcaucgaccugaccaacuuccucguccgguacucccccgugaagaacgaggaggacguggccgagcugagcaucucccccagcgacaacgcggucgugcugacgaaccuccugccgggcaccgaguacguggucuccgugagcuccguguacgagcagcacgagagcaccccccugcgcgggcggcagaagaccggccucgacucccccacggggaucgacuucagcgacaucaccggcaacuccuucaccguccacuggaucgccccccgcgccaccaucacgggguaccggauccgccaccacccggagcacuucagcggccggccccgcgaggaccgggugccccacucccgcaacagcaucacccugaccaaccugacccccggcacggaguacguggucuccaucguggcccucaacgggcgggaggagagcccgcugcugaucggccagcaguccaccgugagcgacgucccccgcgaccucgaggugguggccgcgacccccaccucccugcugaucagcugggacgcccccgccgucacggugcgguacuaccgcaucaccuacggggagaccggcgggaacagcccggugcaggaguucaccguccccggcuccaagagcacggccaccaucuccggccucaagcccgggguggacuacaccaucaccguguacgcggucacgggccggggggacagccccgccuccagcaagccgaucuccaucaacuaccgcaccgagaucgacaagcccagccagaugcaggugaccgacguccaggacaacuccaucagcgugaaguggcugcccuccagcucccccgugaccggcuaccgggucacgaccaccccgaagaacggccccgggcccaccaagacgaagaccgccggccccgaccagaccgagaugaccaucgaggggcugcagccgacgguggaguacguggucagcguguacgcccagaaccccuccggcgagagccagccccucgugcagaccgccgucaccaccaucccggcgcccaccgaccugaaguucacgcaggugacccccaccucccugagcgcccaguggacccccccgaacgugcagcucacgggguaccgcguccgggugacccccaaggagaagaccggccccaugaaggagaucaaccuggcccccgacuccagcagcguggucguguccggccugaugguggccaccaaguacgaggucagcguguacgcccucaaggacacgcugaccucccgcccggcgcaggggguggucaccacccuggagaacgugagccccccccggcgcgcccgcgugacggacgccaccgagaccaccaucacgaucuccuggcggaccaagaccgagaccaucacgggcuuccaggucgacgccgugcccgccaacgggcagaccccgauccagcgcaccaucaagcccgacgugcggagcuacaccaucacgggccuccagcccgggaccgacuacaagaucuaccuguacacccugaacgacaacgcgcgcuccagccccgucgugaucgacgccuccaccgccaucgacgccccgagcaaccuccgguuccuggccacgacccccaacucccugcucgugagcuggcagcccccccgcgcgcggaucaccggcuacaucaucaaguacgagaagccgggcucccccccccgcgaggucgugccccggccgcgccccggggugaccgaggccacgaucaccggccuggagcccgggaccgaguacaccaucuacgucaucgcccugaagaacaaccagaagagcgagccgcucaucggccggaagaagacggacgagcugccccagcuggugacccucccccaccccaaccugcacgggccggagauccuggacgugcccuccaccguccagaagacccccuucgugacccaccccggcuacgacacgggcaacgggauccagcucccgggcaccagcgggcagcagcccuccgugggccagcagaugaucuucgaggagcacggcuuccgccggaccaccccccccacgaccgccaccccgauccgccaccggccccgccccuaccccccgaacgucggggaggagauccagaucggccacaucccccgggaggacguggacuaccaccuguacccccacgggcccggccugaacccgaacgcgagcaccgggcaggaggcccucagccagacgaccaucuccugggcccccuuccaggacaccagcgaguacaucaucuccugccaccccgugggcaccgacgaggagccccugcaguuccgcgucccgggcacgagcaccuccgccacccugaccgggcucacgcggggcgccaccuacaacaucaucguggaggcgcugaaggaccagcagcgccacaaggugcgcgaggaggucgugaccguggggaacagcgucaacgagggccugaaccagcccaccgacgacuccugcuucgaccccuacacggugagccacuacgccgugggggacgagugggagcggauguccgagagcggcuucaagcugcucugccagugccugggcuucggguccggccacuuccgcugcgacagcucccgguggugccacgacaacggggucaacuacaagaucggcgagaagugggaccgccagggggagaacggccagaugaugagcugcaccugccugggcaacgggaagggcgaguucaagugcgacccccacgaggccaccugcuacgacgacgggaagaccuaccacgugggcgagcaguggcagaaggaguaccucggggccaucugcuccugcacgugcuucggcggccagcggggguggcgcugcgacaacugccggcgcccgggcggggagcccagccccgagggcaccaccggccaguccuacaaccaguacagccagcgguaccaccagcgcaccaacacgaacgucaacugcccgaucgagugcuucaugccccuggacgugcaggccgaccgggaggacucccgcgaguga

SEQ ID NO: 1654 - RNA, 3045 nt, Artificial Sequence
  derived and/or modified sequence opt2 from fibronectin__Homo_sapiens__BAG62013
augcgcgucaccugggcccccccccccuccaucgaccucaccaacuuccucguccgcuacucccccgucaagaacgaggaggacgucgccgagcucuccaucucccccuccgacaacgccgucguccucaccaaccuccuccccggcaccgaguacgucgucuccgucuccuccgucuacgagcagcacgaguccaccccccuccgcggccgccagaagaccggccucgacucccccaccggcaucgacuucuccgacaucaccggcaacuccuucaccguccacuggaucgccccccgcgccaccaucaccggcuaccgcauccgccaccaccccgagcacuucuccggccgcccccgcgaggaccgcgucccccacucccgcaacuccaucacccucaccaaccucacccccggcaccgaguacgucgucuccaucgucgcccucaacggccgcgaggaguccccccuccucaucggccagcaguccaccgucuccgacgucccccgcgaccucgaggucgucgccgccacccccaccucccuccucaucuccugggacgcccccgccgucaccguccgcuacuaccgcaucaccuacggcgagaccggcggcaacucccccguccaggaguucaccguccccggcuccaaguccaccgccaccaucuccggccucaagcccggcgucgacuacaccaucaccgucuacgccgucaccggccgcggcgacucccccgccuccuccaagcccaucuccaucaacuaccgcaccgagaucgacaagcccucccagaugcaggucaccgacguccaggacaacuccaucuccgucaaguggcuccccuccuccucccccgucaccggcuaccgcgucaccaccacccccaagaacggccccggccccaccaagaccaagaccgccggccccgaccagaccgagaugaccaucgagggccuccagcccaccgucgaguacgucgucuccgucuacgcccagaaccccuccggcgagucccagccccucguccagaccgccgucaccaccauccccgcccccaccgaccucaaguucacccaggucacccccaccucccucuccgcccaguggaccccccccaacguccagcucaccggcuaccgcguccgcgucacccccaaggagaagaccggccccaugaaggagaucaaccucgcccccgacuccuccuccgucgucgucuccggccucauggucgccaccaaguacgaggucuccgucuacgcccucaaggacacccucaccucccgccccgcccagggcgucgucaccacccucgagaacgucucccccccccgccgcgcccgcgucaccgacgccaccgagaccaccaucaccaucuccuggcgcaccaagaccgagaccaucaccggcuuccaggucgacgccguccccgccaacggccagacccccauccagcgcaccaucaagcccgacguccgcuccuacaccaucaccggccuccagcccggcaccgacuacaagaucuaccucuacacccucaacgacaacgcccgcuccucccccgucgucaucgacgccuccaccgccaucgacgcccccuccaaccuccgcuuccucgccaccacccccaacucccuccucgucuccuggcagcccccccgcgcccgcaucaccggcuacaucaucaaguacgagaagcccggcucccccccccgcgaggucgucccccgcccccgccccggcgucaccgaggccaccaucaccggccucgagcccggcaccgaguacaccaucuacgucaucgcccucaagaacaaccagaaguccgagccccucaucggccgcaagaagaccgacgagcucccccagcucgucacccucccccaccccaaccuccacggccccgagauccucgacguccccuccaccguccagaagacccccuucgucacccaccccggcuacgacaccggcaacggcauccagcuccccggcaccuccggccagcagcccuccgucggccagcagaugaucuucgaggagcacggcuuccgccgcaccaccccccccaccaccgccacccccauccgccaccgcccccgccccuacccccccaacgucggcgaggagauccagaucggccacaucccccgcgaggacgucgacuaccaccucuacccccacggccccggccucaaccccaacgccuccaccggccaggaggcccucucccagaccaccaucuccugggcccccuuccaggacaccuccgaguacaucaucuccugccaccccgucggcaccgacgaggagccccuccaguuccgcguccccggcaccuccaccuccgccacccucaccggccucacccgcggcgccaccuacaacaucaucgucgaggcccucaaggaccagcagcgccacaagguccgcgaggaggucgucaccgucggcaacuccgucaacgagggccucaaccagcccaccgacgacuccugcuucgaccccuacaccgucucccacuacgccgucggcgacgagugggagcgcauguccgaguccggcuucaagcuccucugccagugccucggcuucggcuccggccacuuccgcugcgacuccucccgcuggugccacgacaacggcgucaacuacaagaucggcgagaagugggaccgccagggcgagaacggccagaugauguccugcaccugccucggcaacggcaagggcgaguucaagugcgacccccacgaggccaccugcuacgacgacggcaagaccuaccacgucggcgagcaguggcagaaggaguaccucggcgccaucugcuccugcaccugcuucggcggccagcgcggcuggcgcugcgacaacugccgccgccccggcggcgagcccucccccgagggcaccaccggccaguccuacaaccaguacucccagcgcuaccaccagcgcaccaacaccaacgucaacugccccaucgagugcuucaugccccucgacguccaggccgaccgcgaggacucccgcgaguga

SEQ ID NO: 1655 - RNA, 3045 nt, Artificial Sequence
  derived and/or modified sequence opt3 from fibronectin__Homo_sapiens__BAG62013
augagagugaccugggccccgccuccaagcaucgaccugacaaacuuccucgucagguacuccccgguuaagaaugaggaagauguggcugagcuuucuauuucacccagugacaacgcaguagugcugacuaauuuguuaccuggcacggaauaugucgugagcguuuccucuguguacgagcagcacgaaucgaccccacugcgggggcgccagaaaacaggacuagauucacccacugguauagacuuuagcgauaucaccggcaacaguuucacaguccauuggauugccccucgagcgaccaucacuggguaucguauuagacaccauccagagcacuuuuccggaaggccccgggaggaccgcgugccucauucuagaaauagcaucacacucaccaaccugacgccaggcacugaauacguaguuuccauaguggcucuuaaugguagggaggaaucaccgcuguugaucgggcagcagaguaccgucagcgaugugccccgggaccucgagguggucgccgcaacaccuacuucucugcugauuuccugggaugccccagcuguuaccgugcgcuauuaccgaaucacauauggagagaccggcggcaacucacccguacaggaguucacggugccugggagcaagaguacugcaacaauuucuggacucaaaccaggugucgacuacaccaucacuguguacgccguuacaggcagaggggauucccccgcuagcucgaagccgauaucuauuaauuauaggaccgaaaucgacaaaccuucccaaaugcaagugacggauguccaggacaacucaauuagugugaagugguuacccagcuccucuccaguaaccggauaccggguuacaacuaccccuaagaauggccccgguccaacaaaaacuaagaccgccgggcccgaccagacagaaaugaccaucgagggacugcaaccuacuguggaauaugucgugagcgucuacgcgcagaacccaucaggcgagagucagccgcuugugcagacggcaguuacaaccauccccgccccuacugauuugaaauuuacccaagugacaccaaccucccugagcgcucaguggacucccccuaauguacagcuaacaggcuaucguguccgcgugacgccaaaggagaaaaccgggcccaugaaggaaauuaaccucgccccggacucuucaaguguuguggucagcggacugaugguggcaacuaaguacgagguauccguguaugcucuuaaagauacacugaccucuagaccugcccaagguguugucacaacuuuggaaaaugugucgccacccaggcgggcgcgagugaccgacgccacggagaccacaauaacuaucagcuggcgcaccaagacagaaacuauuaccggcuuccaggucgaugcaguuccugcuaacgggcagacgcccauccagagaacaauaaaaccagacgugagguccuacaccauuacuggacuccaaccuggcacagauuacaagaucuaucuguacaccuuaaacgacaaugcccggucaagucccgugguaaucgaugcuucuacugccauugacgcaccaagcaaccugcgcuuucucgccaccacacccaauucccuucuggucucauggcagccucccagagcuaggaucacggguuauauuauaaaauacgagaagccagggucucccccucgugaggugguuccacggccccgaccuggcgugaccgaagcgacuaucacaggauuggagccgggcaccgaauauacaauuuacgucaucgcacuaaagaacaaucagaaaagcgagccacugaucgggagaaagaaaacugaugaacucccccagcuggugacccuuccucacccaaaccugcacggacccgagauuuuggacguuccuuccacggugcaaaagacaccguucguaacccaucccgguuaugacacuggcaaugggauacagcucccaggaaccaguggccagcagccuagcgucggucaacagaugaucuuugaggaacacggguucaggcgcacaacucccccaaccacagccacgccuauucggcauagacccaggccauacccgccuaacgugggcgaggaaauccagauuggacacaucccccgcgaggauguggacuaccaccuguauccacauggccccggguuaaauccuaacgcuucuaccggacaggaggcccugucccaaacuacaauaucaugggcaccauuucaggauaccagugaauacaucauuagcugccaccccgucgguacugacgaggaaccucuacaguuccgaguuccgggcacaucgaccuccgccacgcucacugggcugacccggggagcuacauauaauaucauuguggaggcccuuaaagaucaacagcgucauaagguaagagaagagguggucaccgugggcaacucuguuaaugaggguuugaaccagccaacugacgauagcuguuuugaccccuacacagugucacacuaugcagucggggaugaaugggagaggaugagugaauccggcuucaaacugcucugccagugucugggauucggcucugggcauuuucgcugcgacagcucccgguggugucacgauaauggagugaacuacaagaucggcgagaagugggacagacaaggugaaaacgggcagaugaugucaugcaccugucuuggaaauggcaaaggugaguucaagugcgauccucacgaggcgacauguuaugacgacggcaaaacuuaccauguuggggaacaguggcagaaggaguaccugggagcuauaugcagcuguaccugcuuuggcgggcaaaggggauggcgaugcgauaacugucgccggcccggcggugaaccaaguccugaggggacgacaggacagucuuauaaucaguacucccagagauaucaccaaaggaccaacacuaaugugaacugccccauugaauguuucaugccauuggacguccaggccgaucgugaggacagccgcgaguga

SEQ ID NO: 1656 - RNA, 3045 nt, Artificial Sequence
  derived and/or modified sequence opt4 from fibronectin__Homo_sapiens__BAG62013
augagagugaccugggcccccccccccagcaucgaccugaccaacuuccuggugagauacagccccgugaagaacgaggaggacguggccgagcugagcaucagccccagcgacaacgccguggugcugaccaaccugcugcccggcaccgaguacguggugagcgugagcagcguguacgagcagcacgagagcaccccccugagaggcagacagaagaccggccuggacagccccaccggcaucgacuucagcgacaucaccggcaacagcuucaccgugcacuggaucgcccccagagccaccaucaccggcuacagaaucagacaccaccccgagcacuucagcggcagacccagagaggacagagugccccacagcagaaacagcaucacccugaccaaccugacccccggcaccgaguacguggugagcaucguggcccugaacggcagagaggagagcccccugcugaucggccagcagagcaccgugagcgacgugcccagagaccuggaggugguggccgccacccccaccagccugcugaucagcugggacgcccccgccgugaccgugagauacuacagaaucaccuacggcgagaccggcggcaacagccccgugcaggaguucaccgugcccggcagcaagagcaccgccaccaucagcggccugaagcccggcguggacuacaccaucaccguguacgccgugaccggcagaggcgacagccccgccagcagcaagcccaucagcaucaacuacagaaccgagaucgacaagcccagccagaugcaggugaccgacgugcaggacaacagcaucagcgugaaguggcugcccagcagcagccccgugaccggcuacagagugaccaccacccccaagaacggccccggccccaccaagaccaagaccgccggccccgaccagaccgagaugaccaucgagggccugcagcccaccguggaguacguggugagcguguacgcccagaaccccagcggcgagagccagccccuggugcagaccgccgugaccaccauccccgcccccaccgaccugaaguucacccaggugacccccaccagccugagcgcccaguggaccccccccaacgugcagcugaccggcuacagagugagagugacccccaaggagaagaccggccccaugaaggagaucaaccuggcccccgacagcagcagcgugguggugagcggccugaugguggccaccaaguacgaggugagcguguacgcccugaaggacacccugaccagcagacccgcccagggcguggugaccacccuggagaacgugagcccccccagaagagccagagugaccgacgccaccgagaccaccaucaccaucagcuggagaaccaagaccgagaccaucaccggcuuccagguggacgccgugcccgccaacggccagacccccauccagagaaccaucaagcccgacgugagaagcuacaccaucaccggccugcagcccggcaccgacuacaagaucuaccuguacacccugaacgacaacgccagaagcagccccguggugaucgacgccagcaccgccaucgacgcccccagcaaccugagauuccuggccaccacccccaacagccugcuggugagcuggcagccccccagagccagaaucaccggcuacaucaucaaguacgagaagcccggcagcccccccagagagguggugcccagacccagacccggcgugaccgaggccaccaucaccggccuggagcccggcaccgaguacaccaucuacgugaucgcccugaagaacaaccagaagagcgagccccugaucggcagaaagaagaccgacgagcugccccagcuggugacccugccccaccccaaccugcacggccccgagauccuggacgugcccagcaccgugcagaagacccccuucgugacccaccccggcuacgacaccggcaacggcauccagcugcccggcaccagcggccagcagcccagcgugggccagcagaugaucuucgaggagcacggcuucagaagaaccaccccccccaccaccgccacccccaucagacacagacccagacccuacccccccaacgugggcgaggagauccagaucggccacauccccagagaggacguggacuaccaccuguacccccacggccccggccugaaccccaacgccagcaccggccaggaggcccugagccagaccaccaucagcugggcccccuuccaggacaccagcgaguacaucaucagcugccaccccgugggcaccgacgaggagccccugcaguucagagugcccggcaccagcaccagcgccacccugaccggccugaccagaggcgccaccuacaacaucaucguggaggcccugaaggaccagcagagacacaaggugagagaggagguggugaccgugggcaacagcgugaacgagggccugaaccagcccaccgacgacagcugcuucgaccccuacaccgugagccacuacgccgugggcgacgagugggagagaaugagcgagagcggcuucaagcugcugugccagugccugggcuucggcagcggccacuucagaugcgacagcagcagauggugccacgacaacggcgugaacuacaagaucggcgagaagugggacagacagggcgagaacggccagaugaugagcugcaccugccugggcaacggcaagggcgaguucaagugcgacccccacgaggccaccugcuacgacgacggcaagaccuaccacgugggcgagcaguggcagaaggaguaccugggcgccaucugcagcugcaccugcuucggcggccagagaggcuggagaugcgacaacugcagaagacccggcggcgagcccagccccgagggcaccaccggccagagcuacaaccaguacagccagagauaccaccagagaaccaacaccaacgugaacugccccaucgagugcuucaugccccuggacgugcaggccgacagagaggacagcagagaguga

SEQ ID NO: 1657 - RNA, 3045 nt, Artificial Sequence
  derived and/or modified sequence opt5 from fibronectin__Homo_sapiens__BAG62013
augagagugaccugggcucccccuccgagcaucgaccugacaaacuuccucguccgguacucccccguuaagaaugaggaagauguggccgagcugucuauuagcccuuccgacaacgccgugguccuuacgaaucugcuccccggcaccgaauaugugguuucugugagcuccgucuacgagcagcacgaaucuacaccucugcgcgggagacagaaaaccggacuugauagccccacaggcaucgacuuuuccgauauuaccgggaacagcuucacagugcauuggaucgcgccucgggcuaccauuacgggauaucgcaucagacaccauccggagcacuuuucuggccggccccgcgaggacagaguuccucauucccggaauagcaucacccugacaaaccucacccccgggacagaauacguggucucuauuguggcccugaauggacgcgaggaauccccucugcucaucggccaacagagcaccgugucugauguccccagagaccuggagguuguggccgcuacgccgacaucccuucugauuagcugggaugccccugcugugaccguccgguauuaccgcaucacauauggcgagaccgggggaaacucccccgugcaggaguucaccguuccuggcucuaagagcacagccacgauuuccgggcucaaacccggaguggacuacaccaucacagucuacgcggugaccggcagaggggauagccccgccucuuccaagccuauuagcaucaauuaucggacagaaaucgacaaaccgucucaaaugcagguuaccgaugugcaggacaacagcauuuccgucaaguggcugcccucuagcuccccugugacgggauaccgcgucacaaccacccccaagaauggcccuggccccacaaaaaccaagacagcugggccggaccagacggaaaugaccaucgagggacuucaaccuacaguggaauauguugugagcgucuacgcccagaaccccucuggcgagucccagccucuggugcagaccgcuguuacaaccauucccgccccuacggaucucaaauuuacccaagugacacccaccagccugucugcgcaguggacaccgccuaauguccagcugaccggguauagagugcgggugacgcccaaggagaaaacaggacccaugaaggaaaucaaccucgccccugacuccagcuccguugucgugucuggccugaugguggcuaccaaguacgaggucagcguguaugcccuuaaagauacacugaccuccagaccggcucaagggguugugaccacacucgaaaaugucucucccccucgccgggccagagugacggacgccaccgagacaaccauuacaaucagcuggcgcaccaagacggaaacaaucaccggauuccagguugaugcugugcccgcgaacggccagaccccuauucagcggacaaucaaacccgacgucagauccuacaccauuacaggccugcaaccugggacggauuacaagaucuaucuuuacacccugaacgacaaugcccgcagcucucccgugguuauugaugcuuccacagccaucgacgccccgagcaaccuccgguuucuggcuaccacaccuaauucucugcucguguccuggcagcccccuagagcccgcaucaccggauauauuaucaaauacgagaagcccggcagcccgccucgggaggucgugcccagaccucgccccggggugacggaagcgaccauuacaggacuggagcccggcaccgaauauacaaucuacgucauugcucuuaaaaacaaucagaagucugagccucugaucgggcggaagaaaaccgaugaacucccgcagcugguuacacuuccccacccuaaccugcacggccccgagauucucgacgugccuagcaccgugcaaaagacgcccuucgucacacauccuggauaugacaccggcaaugggauccagcugccgggaaccuccggccagcagcccagcguggggcaacagaugaucuuugaggaacacggauucagacggacaaccccucccacgacagccaccccuauucgccauagaccccggccguacccucccaacguuggcgaggaaauccagauugggcacauccccagagaggauguggacuaccaccuguauccucauggccccggacucaauccuaacgccucuacaggccaggaggcucugucccaaaccacaauuagcugggccccguuucaggauaccuccgaauacaucaucucuugccaccccgucgggacggacgaggaaccucuucaguuccgcgugcccggaaccagcacauccgcuacccugacaggccucaccagaggggccacguauaauauuaucguugaggcgcugaaagaucaacagcggcauaaggugcgcgaagaggucgugacaguuggaaacucugugaaugagggccugaaccagccuaccgacgauagcuguuuugaccccuacacagucucccacuaugccgugggggaugaaugggagagaaugucugaaagcggcuucaaacuucucugccagugucugggauucggcuccgggcauuuucggugcgacagcucucgcuggugucacgauaauggagugaacuacaagauuggcgagaagugggacagacaaggggaaaacggacagaugauguccugcaccugucugggcaaugggaaaggcgaguucaagugcgauccgcacgaggcuaccuguuaugacgacggaaaaacauaccaugucggcgaacaguggcagaaggaguaccucggggccaucugcagcuguacgugcuuuggaggccaacggggguggcgcugcgauaacuguagacggccuggaggcgaacccucuccugagggcaccacagggcaguccuauaaucaguacagccagcgcuaucaccaaagaaccaacacaaauguuaacugccccauugaauguuucaugccucuggacgugcaggcugaucgggaggacucucgcgaguga

SEQ ID NO: 1658 - protein, 894 aa, Artificial Sequence [sequence omitted]

SEQ ID NO: 1659 - RNA, 2685 nt, Artificial Sequence
  fibronectin__Homo_sapiens__BAG62178
augcgugucaccugggcuccacccccauccauugauuuaaccaacuuccuggugcguuacucaccugugaaaaaugaggaagauguugcagaguugucaauuucuccuucagacaaugcaguggucuuaacaaaucuccugccugguacagaauauguagugagugucuccagugucuacgaacaacaugagagcacaccucuuagaggaagacagaaaacaggucuugauuccccaacuggcauugacuuuucugauauuacugccaacucuuuuacugugcacuggauugcuccucgagccaccaucacuggcuacaggauccgccaucaucccgagcacuucagugggagaccucgagaagaucgggugccccacucucggaauuccaucacccucaccaaccucacuccaggcacagaguauguggucagcaucguugcucuuaauggcagagaggaaagucccuuauugauuggccaacaaucaacaguuucugauguuccgagggaccuggaaguuguugcugcgacccccaccagccuacugaucagcugggaugcuccugcugucacagugagauauuacaggaucacuuacggagaaacaggaggaaauagcccuguccaggaguucacugugccugggagcaagucuacagcuaccaucagcggccuuaaaccuggaguugauuauaccaucacuguguaugcugucacuggccguggagacagccccgcaagcagcaagccaauuuccauuaauuaccgaacagaaauugacaaaccaucccagaugcaagugaccgauguucaggacaacagcauuagugucaaguggcugccuucaaguuccccuguuacugguuacagaguaaccaccacucccaaaaauggaccaggaccaacaaaaacuaaaacugcagguccagaucaaacagaaaugacuauugaaggcuugcaucccacaguggaguaugugguuagugucuaugcucagaauccaagcggagagagucagccucugguucagacugcaguaaccacuauuccugcaccaacugaccugaaguucacucaggucacacccacaagccugagcgcccaguggacaccacccaauguucagcucacuggauaucgagugcgggugacccccaaggagaagaccggaccaaugaaagaaaucaaccuugcuccugacagcucauccgugguuguaucaggacuuaugguggccaccaaauaugaagugagugucuaugcucuuaaggacacuuugacaagcagaccagcucaggguguugucaccacucuggagaaugucagcccaccaagaagggcucgugugacagaugcuacugagaccaccaucaccauuagcuggagaaccaagacugagacgaucacuggcuuccaaguugaugccguuccagccaauggccagacuccaauccagagaaccaucaagccagauguuagaagcuacaccaucacagguuuacaaccaggcacugacuacaagaucuaccuguacaccuugaaugacaaugcucggagcuccccuguggucaucgacgccuccacugccauugaugcaccauccaaccugcguuuccuggccaccacacccaauuccuugcugguaucauggcagccgccacgugccaggauuaccggcuacaucaucaaguaugagaagccugggucuccucccagagaaguggucccucggccccgcccuggugucacagaggcuacuauuacuggccuggaaccgggaaccgaauauacaauuuaugucauugcccugaagaauaaucagaagagcgagccccugauuggaaggaaaaagacaggacaagaagcucucucucagacaaccaucucaugggccccauuccaggacacuucugaguacaucauuucaugucauccuguuggcacugaugaagaacccuuacaguucaggguuccuggaacuucuaccagugccacucugacaggccucaccagaggugccaccuacaacaucauaguggaggcacugaaagaccagcagaggcauaagguucgggaagagguuauuaccgugggcaacucugucaacgaaggcuugaaccaaccuacggaugacucgugcuuugaccccuacacaguuucccauuaugccguuggagaugagugggaacgaaugucugaaucaggcuuuaaacuguugugccagugcuuaggcuuuggaaguggucauuucagaugugauucaucuagauggugccaugacaauggugugaacuacaagauuggagagaagugggaccgucagggagaaaauggccagaugaugagcugcacaugucuugggaacggaaaaggagaauucaagugugacccucaugaggcaacguguuacgaugaugggaagacauaccacguaggagaacaguggcagaaggaauaucucggugccauuugcuccugcacaugcuuuggaggccagcggggcuggcgcugugacaacugccgcagaccugggggugaacccagucccgaaggcacuacuggccaguccuacaaccaguauucucagagauaccaucagagaacaaacacuaauguuaauugcccaauugagugcuucaugccuuuagauguacaggcugacagagaagauucccgagaguaa

SEQ ID NO: 1660 - RNA, 2685 nt, Artificial Sequence
  derived and/or modified sequence opt1 from fibronectin__Homo_sapiens__BAG62178
augcgcgugaccugggcgcccccgcccagcaucgaccugaccaacuuccucguccgguacucccccgugaagaacgaggaggacguggccgagcugagcaucucccccagcgacaacgccgucgugcugacgaaccuccugccgggcaccgaguacguggucuccgugagcuccguguacgagcagcacgagagcacgccccugcgcgggcggcagaagaccggccucgacucccccaccgggaucgacuucagcgacaucaccgccaacuccuucaccguccacuggaucgcgccccgcgccaccaucacgggcuaccggauccgccaccacccggagcacuucagcgggcggccccgcgaggaccgggugccccacucccgcaacagcaucacccugaccaaccugacccccggcacggaguacguggucuccaucguggcccucaacggccgggaggagagcccgcugcugaucgggcagcaguccaccgugagcgacgucccccgcgaccucgaggugguggccgccacccccaccucccugcugaucagcugggacgcccccgccgucacggugcgguacuaccgcaucaccuacggcgagaccgggggcaacagcccggugcaggaguucaccguccccggguccaagagcacggcgaccaucuccggccucaagcccggcguggacuacaccaucaccguguacgccgucacggggcggggcgacagccccgccuccagcaagccgaucuccaucaacuaccgcaccgagaucgacaagcccagccagaugcaggucaccgacguccaggacaacuccaucagcgugaaguggcugcccuccagcucccccgugaccggguaccgggucacgaccaccccgaagaacggccccggccccaccaagacgaagaccgccgggcccgaccagaccgagaugaccaucgagggccugcacccgacgguggaguacguggugagcguguacgcccagaaccccuccggggagagccagccccucgugcagaccgccgucaccaccaucccggcccccaccgaccugaaguucacccaggugacccccaccucccugagcgcccaguggacgcccccgaacgugcagcucaccggcuaccgcguccgggugacccccaaggagaagaccgggcccaugaaggagaucaaccuggcccccgacuccagcagcguggucguguccggccugaugguggccaccaaguacgaggucagcguguacgcgcucaaggacacgcugaccucccgcccggcccagggcguggucaccacccuggagaacgugagcccgccccggcgcgcccgcgugacggacgccaccgagaccaccaucacgaucuccuggcggaccaagaccgagaccaucacgggguuccaggucgacgccgugcccgcgaacggccagaccccgauccagcgcaccaucaagcccgacgugcggagcuacaccaucacggggcuccagcccggcaccgacuacaagaucuaccuguacacccugaacgacaacgcccgcuccagccccgucgugaucgacgccuccaccgccaucgacgccccgagcaaccuccgguuccuggcgacgacccccaacucccugcucgugagcuggcagccgccccgcgcccggaucaccggguacaucaucaaguacgagaagcccggcuccccgccccgcgaggucgugccccggccccgccccggcgugaccgaggccacgaucaccgggcuggagcccggcaccgaguacaccaucuacgucaucgcccugaagaacaaccagaaguccgagccgcucaucgggcggaagaagacgggccaggaggcgcugagccagaccaccaucagcugggcccccuuccaggacaccuccgaguacaucaucagcugccaccccguggggaccgacgaggagccccugcaguuccgcgugccgggcacgagcaccuccgccacccucaccggccugacgcgcggggccaccuacaacaucaucgucgaggcccugaaggaccagcagcggcacaaggugcgggaggaggugaucaccgucggcaacagcgugaacgaggggcucaaccagcccaccgacgacuccugcuucgaccccuacacggugagccacuacgcggucggcgacgagugggagcgcauguccgagagcggcuucaagcugcugugccagugccucggguucggcuccgggcacuuccggugcgacagcucccgcuggugccacgacaacggcgugaacuacaagaucggggagaagugggaccggcagggcgagaacggccagaugaugagcugcacgugccuggggaacggcaagggggaguucaagugcgacccccacgaggcgaccugcuacgacgacggcaagaccuaccacgugggggagcaguggcagaaggaguaccugggcgccaucugcuccugcacgugcuucggcgggcagcgcggcuggcgcugcgacaacugccggcgccccgggggcgagcccagccccgaggggaccaccggccaguccuacaaccaguacagccagcgguaccaccagcgcaccaacacgaacgucaacugccccaucgagugcuucaugccgcucgacgugcaggccgaccgggaggacucccgcgaguga

SEQ ID NO: 1661 - RNA, 2685 nt, Artificial Sequence
  derived and/or modified sequence opt2 from fibronectin__Homo_sapiens__BAG62178
augcgcgucaccugggcccccccccccuccaucgaccucaccaacuuccucguccgcuacucccccgucaagaacgaggaggacgucgccgagcucuccaucucccccuccgacaacgccgucguccucaccaaccuccuccccggcaccgaguacgucgucuccgucuccuccgucuacgagcagcacgaguccaccccccuccgcggccgccagaagaccggccucgacucccccaccggcaucgacuucuccgacaucaccgccaacuccuucaccguccacuggaucgccccccgcgccaccaucaccggcuaccgcauccgccaccaccccgagcacuucuccggccgcccccgcgaggaccgcgucccccacucccgcaacuccaucacccucaccaaccucacccccggcaccgaguacgucgucuccaucgucgcccucaacggccgcgaggaguccccccuccucaucggccagcaguccaccgucuccgacgucccccgcgaccucgaggucgucgccgccacccccaccucccuccucaucuccugggacgcccccgccgucaccguccgcuacuaccgcaucaccuacggcgagaccggcggcaacucccccguccaggaguucaccguccccggcuccaaguccaccgccaccaucuccggccucaagcccggcgucgacuacaccaucaccgucuacgccgucaccggccgcggcgacucccccgccuccuccaagcccaucuccaucaacuaccgcaccgagaucgacaagcccucccagaugcaggucaccgacguccaggacaacuccaucuccgucaaguggcuccccuccuccucccccgucaccggcuaccgcgucaccaccacccccaagaacggccccggccccaccaagaccaagaccgccggccccgaccagaccgagaugaccaucgagggccuccaccccaccgucgaguacgucgucuccgucuacgcccagaaccccuccggcgagucccagccccucguccagaccgccgucaccaccauccccgcccccaccgaccucaaguucacccaggucacccccaccucccucuccgcccaguggaccccccccaacguccagcucaccggcuaccgcguccgcgucacccccaaggagaagaccggccccaugaaggagaucaaccucgcccccgacuccuccuccgucgucgucuccggccucauggucgccaccaaguacgaggucuccgucuacgcccucaaggacacccucaccucccgccccgcccagggcgucgucaccacccucgagaacgucucccccccccgccgcgcccgcgucaccgacgccaccgagaccaccaucaccaucuccuggcgcaccaagaccgagaccaucaccggcuuccaggucgacgccguccccgccaacggccagacccccauccagcgcaccaucaagcccgacguccgcuccuacaccaucaccggccuccagcccggcaccgacuacaagaucuaccucuacacccucaacgacaacgcccgcuccucccccgucgucaucgacgccuccaccgccaucgacgcccccuccaaccuccgcuuccucgccaccacccccaacucccuccucgucuccuggcagcccccccgcgcccgcaucaccggcuacaucaucaaguacgagaagcccggcucccccccccgcgaggucgucccccgcccccgccccggcgucaccgaggccaccaucaccggccucgagcccggcaccgaguacaccaucuacgucaucgcccucaagaacaaccagaaguccgagccccucaucggccgcaagaagaccggccaggaggcccucucccagaccaccaucuccugggcccccuuccaggacaccuccgaguacaucaucuccugccaccccgucggcaccgacgaggagccccuccaguuccgcguccccggcaccuccaccuccgccacccucaccggccucacccgcggcgccaccuacaacaucaucgucgaggcccucaaggaccagcagcgccacaagguccgcgaggaggucaucaccgucggcaacuccgucaacgagggccucaaccagcccaccgacgacuccugcuucgaccccuacaccgucucccacuacgccgucggcgacgagugggagcgcauguccgaguccggcuucaagcuccucugccagugccucggcuucggcuccggccacuuccgcugcgacuccucccgcuggugccacgacaacggcgucaacuacaagaucggcgagaagugggaccgccagggcgagaacggccagaugauguccugcaccugccucggcaacggcaagggcgaguucaagugcgacccccacgaggccaccugcuacgacgacggcaagaccuaccacgucggcgagcaguggcagaaggaguaccucggcgccaucugcuccugcaccugcuucggcggccagcgcggcuggcgcugcgacaacugccgccgccccggcggcgagcccucccccgagggcaccaccggccaguccuacaaccaguacucccagcgcuaccaccagcgcaccaacaccaacgucaacugccccaucgagugcuucaugccccucgacguccaggccgaccgcgaggacucccgcgaguga

SEQ ID NO: 1662 - RNA, 2685 nt, Artificial Sequence
  derived and/or modified sequence opt3 from fibronectin__Homo_sapiens__BAG62178
augagagugaccugggccccgccuccaagcaucgaccugacaaacuuccucgucagguacuccccgguuaagaaugaggaagauguggcugagcuuucuauuucacccagugacaacgcaguagugcugacuaauuuguuaccuggcacggaauaugucgugagcguuuccucuguguacgagcagcacgaaucgaccccacugcgggggcgccagaaaacaggacuagauucacccacugguauagacuuuagcgauaucaccgccaacaguuucacaguccauuggauugcgccucgagcuaccaucacuggcuaucguauuagacaccauccagagcacuuuuccgggaggccccgggaggaccgcgugccucauucuagaaauagcaucacacucaccaaccugacgccaggaacugaauacguaguuuccauaguggcccuuaauggcagggaggaaucaccgcuguugaucggucagcagaguaccgucagcgaugugccccgggaccucgagguggucgcagccacaccuacuucucugcugauuuccugggaugcuccagcaguuaccgugcgcuauuaccgaaucacauauggggagaccggaggcaacucacccguacaggaguucacggugccuggcagcaagaguacugccacaauuucugggcucaaaccaggagucgacuacaccaucacuguguacgcuguuacagguagaggcgauucccccgccagcucgaagccgauaucuauuaauuauaggaccgaaaucgacaaaccuucccaaaugcaagugacggauguccaggacaacucaauuagugugaagugguuacccagcuccucuccaguaaccggguaccggguuacaacuaccccuaagaauggacccggcccaacaaaaacuaagaccgcgggucccgaccagacagaaaugaccaucgaggggcugcacccuacuguggaauaugucgugagcgucuacgcacaaaacccaucaggagagagucagccgcuugugcagacggccguuacaaccauccccgcuccuacugauuugaaauuuacccaggugacaccaaccucccugagcgcccaauggacucccccuaauguacagcuaacaggcuaucguguccgcgugacgccaaaggagaaaaccggccccaugaaggaaauuaaccucgcaccggacucuucaaguguuguggucagcgggcugaugguggcuacuaaguacgagguauccguguaugcccuuaaagauacacugaccucuagaccugcgcagggaguugucacaacuuuggaaaaugugucgccacccaggcgggcccgagugaccgacgcaacggagaccacaauaacuaucagcuggcgcaccaagacagaaacuauuaccgguuuccaagucgaugcuguuccugccaacggccagacgcccauccagagaacaauaaaaccagacgugagguccuacaccauuacugggcuccagccuggaacagauuacaagaucuaucuguacaccuuaaacgacaaugcucggucaagucccgugguaaucgaugccucuacugcaauugacgccccaagcaaccugcgcuuucucgcuaccacacccaauucccuucuggucucauggcaaccucccagagcgaggaucacgggcuauauuauaaaauacgagaagccagguucucccccucgugaggugguuccacggccccgaccuggggugaccgaagcaacuaucacaggcuuggagccgggaaccgaauauacaauuuacgucaucgcccuaaagaacaaucagaaaagcgagccacugaucggcagaaagaaaacugggcaggaagcucucucccagaccacgauuaguugggcccccuuccaagauacaagcgaguauauaaucucuugccacccugugggaaccgacgaggaaccacugcaguuuaggguucccgguacuuccaccucagcaacacuuacuggccugacccgcggggccacauacaacauuaucguggaggcuuugaaggaccagcagcggcauaaaguaagagaagaggucauuacggugggaaauagugugaacgagggccucaaucaaccuaccgaugacagcuguuucgauccguacacugucucgcacuaugccguuggugacgaaugggagaggauguccgaaucuggguuuaagcuguuaugccagugucugggcuucggaagcggccauuuucgcugcgauucaagucgauggugucacgacaacggggugaauuacaaaaucggagagaagugggaucggcagggugaaaacggccagaugauguccugcacaugucuagggaauggaaagggcgaguucaaaugcgacccccacgaggcaaccuguuaugaugacgguaagacuuaccauguaggggaacaauggcagaaagaguaucucggcgcgauaugcucuuguacaugcuucggaggccagcguggguggagaugcgauaacuguaggcgcccaggaggcgaaccuagccccgaggguaccacggggcaauccuacaaucaguauucacagcgguaccaccagagaacuaacaccaacgugaauugcccaaucgaauguuuuaugccucuggacguccaagcugauagggaggacagccgagaguga

SEQ ID NO: 1663 - RNA, 2685 nt, Artificial Sequence
  derived and/or modified sequence opt4 from fibronectin__Homo_sapiens__BAG62178
augagagugaccugggcccccccccccagcaucgaccugaccaacuuccuggugagauacagccccgugaagaacgaggaggacguggccgagcugagcaucagccccagcgacaacgccguggugcugaccaaccugcugcccggcaccgaguacguggugagcgugagcagcguguacgagcagcacgagagcaccccccugagaggcagacagaagaccggccuggacagccccaccggcaucgacuucagcgacaucaccgccaacagcuucaccgugcacuggaucgcccccagagccaccaucaccggcuacagaaucagacaccaccccgagcacuucagcggcagacccagagaggacagagugccccacagcagaaacagcaucacccugaccaaccugacccccggcaccgaguacguggugagcaucguggcccugaacggcagagaggagagcccccugcugaucggccagcagagcaccgugagcgacgugcccagagaccuggaggugguggccgccacccccaccagccugcugaucagcugggacgcccccgccgugaccgugagauacuacagaaucaccuacggcgagaccggcggcaacagccccgugcaggaguucaccgugcccggcagcaagagcaccgccaccaucagcggccugaagcccggcguggacuacaccaucaccguguacgccgugaccggcagaggcgacagccccgccagcagcaagcccaucagcaucaacuacagaaccgagaucgacaagcccagccagaugcaggugaccgacgugcaggacaacagcaucagcgugaaguggcugcccagcagcagccccgugaccggcuacagagugaccaccacccccaagaacggccccggccccaccaagaccaagaccgccggccccgaccagaccgagaugaccaucgagggccugcaccccaccguggaguacguggugagcguguacgcccagaaccccagcggcgagagccagccccuggugcagaccgccgugaccaccauccccgcccccaccgaccugaaguucacccaggugacccccaccagccugagcgcccaguggaccccccccaacgugcagcugaccggcuacagagugagagugacccccaaggagaagaccggccccaugaaggagaucaaccuggcccccgacagcagcagcgugguggugagcggccugaugguggccaccaaguacgaggugagcguguacgcccugaaggacacccugaccagcagacccgcccagggcguggugaccacccuggagaacgugagcccccccagaagagccagagugaccgacgccaccgagaccaccaucaccaucagcuggagaaccaagaccgagaccaucaccggcuuccagguggacgccgugcccgccaacggccagacccccauccagagaaccaucaagcccgacgugagaagcuacaccaucaccggccugcagcccggcaccgacuacaagaucuaccuguacacccugaacgacaacgccagaagcagccccguggugaucgacgccagcaccgccaucgacgcccccagcaaccugagauuccuggccaccacccccaacagccugcuggugagcuggcagccccccagagccagaaucaccggcuacaucaucaaguacgagaagcccggcagcccccccagagagguggugcccagacccagacccggcgugaccgaggccaccaucaccggccuggagcccggcaccgaguacaccaucuacgugaucgcccugaagaacaaccagaagagcgagccccugaucggcagaaagaagaccggccaggaggcccugagccagaccaccaucagcugggcccccuuccaggacaccagcgaguacaucaucagcugccaccccgugggcaccgacgaggagccccugcaguucagagugcccggcaccagcaccagcgccacccugaccggccugaccagaggcgccaccuacaacaucaucguggaggcccugaaggaccagcagagacacaaggugagagaggaggugaucaccgugggcaacagcgugaacgagggccugaaccagcccaccgacgacagcugcuucgaccccuacaccgugagccacuacgccgugggcgacgagugggagagaaugagcgagagcggcuucaagcugcugugccagugccugggcuucggcagcggccacuucagaugcgacagcagcagauggugccacgacaacggcgugaacuacaagaucggcgagaagugggacagacagggcgagaacggccagaugaugagcugcaccugccugggcaacggcaagggcgaguucaagugcgacccccacgaggccaccugcuacgacgacggcaagaccuaccacgugggcgagcaguggcagaaggaguaccugggcgccaucugcagcugcaccugcuucggcggccagagaggcuggagaugcgacaacugcagaagacccggcggcgagcccagccccgagggcaccaccggccagagcuacaaccaguacagccagagauaccaccagagaaccaacaccaacgugaacugccccaucgagugcuucaugccccuggacgugcaggccgacagagaggacagcagagaguga

SEQ ID NO: 1664 - RNA, 2685 nt, Artificial Sequence
  derived and/or modified sequence opt5 from fibronectin__Homo_sapiens__BAG62178
augagagugaccugggcucccccuccgagcaucgaccugacaaacuuccucguccgguacucccccguuaagaaugaggaagauguggccgagcugucuauuagcccuuccgacaacgccgugguccuuacgaaucugcuccccggcaccgaauaugugguuucugugagcuccgucuacgagcagcacgaaucuacaccucugcgcgggagacagaaaaccggacuugauagccccacaggcaucgacuuuuccgauauuaccgcgaacagcuucacagugcauuggaucgcuccucgggccaccauuacgggguaucgcaucagacaccauccggagcacuuuucuggacggccccgcgaggacagaguuccucauucccggaauagcaucacccugacaaaccucacccccggcacagaauacguggucucuauuguggcccugaaugggcgcgaggaauccccucugcucaucggacaacagagcaccgugucugauguccccagagaccuggagguuguggcugccacgccgacaucccuucugauuagcugggaugcuccugccgugaccguccgguauuaccgcaucacauauggcgagaccggcgggaacucccccgugcaggaguucaccguuccuggaucuaagagcacagcgacgauuuccggccucaaacccgggguggacuacaccaucacagucuacgccgugaccggaagaggcgauagccccgcuucuuccaagccuauuagcaucaauuaucggacagaaaucgacaaaccgucucaaaugcagguuaccgaugugcaggacaacagcauuuccgucaaguggcugcccucuagcuccccugugacgggguaccgcgucacaaccacccccaagaauggaccuggccccacaaaaaccaagacagccggcccggaccagacggaaaugaccaucgaggggcuucacccuacaguggaauauguugugagcgucuacgcucaaaaccccucuggagagucccagccucuggugcagaccgccguuacaaccauucccgcgccuacggaucucaaauuuacccaggugacacccaccagccugucugcccaauggacaccgccuaauguccagcugaccggcuauagagugcgggugacgcccaaggagaaaacagggcccaugaaggaaaucaaccucgcuccugacuccagcuccguugucgugucuggacugaugguggccaccaaguacgaggucagcguguaugcucuuaaagauacacugaccuccagaccggcccagggcguugugaccacacucgaaaaugucucucccccucgccgggccagagugacggacgcuaccgagacaaccauuacaaucagcuggcgcaccaagacggaaacaaucaccggguuccaaguugaugcggugcccgccaacggacagaccccuauucagcggacaaucaaacccgacgucagauccuacaccauuacaggccugcagccuggcacggauuacaagaucuaucuuuacacccugaacgacaaugcucgcagcucucccgugguuauugaugccuccacagccaucgacgcuccgagcaaccuccgguuucuggccaccacaccuaauucucugcucguguccuggcaacccccuagagcgcgcaucaccggguauauuaucaaauacgagaagcccggaagcccgccucgggaggucgugcccagaccucgccccggcgugacggaagcuaccauuacagggcuggagcccggaaccgaauauacaaucuacgucauugcccuuaaaaacaaucagaagucugagccucugaucggccggaagaaaaccgggcaggaagcccucagccagacaaccauuuccugggcuccguuccaagauacgagcgaguauaucaucucuugccaccccguuggcacagacgaggaaccucugcaguuuagagugcccggaaccuccaccagcgccacacuuaccggccugacgcgcggggcuacauacaacauuaucguggaggcccucaaggaccagcagcggcauaaagucagagaagaggugauuaccguuggaaauuccgugaacgagggccugaaucaaccuacagaugacucuuguuucgaucccuacaccgucagccacuaugcggugggggacgaaugggagcggauguccgaaucuggauuuaagcugcucugccagugucugggcuucgggagcggccauuuuagaugcgauuccucucgcuggugucacgacaacggaguuaauuacaaaaucggcgagaagugggaucggcagggggaaaacggacagaugaugagcugcacaugucuuggcaaugggaagggagaguucaaaugcgacccucacgaggccaccuguuaugaugacggcaagacguaccaugugggggaacaauggcagaaagaguaucugggcgcuauuugcuccuguaccugcuucggaggccagagaggguggcgcugcgauaacuguagacggccgggaggcgaacccagcccugaggggacaaccggacaaucuuacaaucaguauucccagcgcuaccaccagagaacaaacaccaacgucaauugccccaucgaauguuuuaugccucucgacgugcaagccgaucgggaggacagccgcgaguga

SEQ ID NO: 1665 - protein, 383 aa, Artificial Sequence
  fibronectin__Homo_sapiens__B7Z3W5
MASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSVHVTSLKKHTSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 1666 - RNA, 1152 nt, Artificial Sequence
  fibronectin__Homo_sapiens__BAH12351
auggcuucagccuuucgccuuucuuugaaaccaaaggucagugacaacaugacucauuuaaugguggauuucucacaggaaagacagaugcugcaaacuuugaaguuuuugccaguccccaaagcuccagagauagauccaguagaguguuugguggcagauaacucuguaacaguggcuuggagaaugccagaagaagauaauaagauugaccauuuuauacuggaacauaggaagacuaauuuugauggacuuccacguguaaaggaugagcgaugcugggagauaauugauaauauuaaggguacugaauauacacuaucaggcuuaaaauuugauucaaaguauaugaauuucagagugcgagcuuguaacaaggcuguggcuggagaguauucugauccagugacucuagagaccaaagcacuuaacuucaauuuggauaacuccucaucccauuugaaccugaaaguugaagauacauguguagagugggauccuacuggaggaaaaggucaagaaaguaaaauuaaaggaaaagagaacaagggcaguguccauguuacuucacugaagaaacauacaagugguacaccauccccaaaacgaacaucuguaggcuccaggccaccagcaguaagaggcaguagagaucguuuuacuggagaaucauacacagugcugggagacacugcuauugaaaguggacaacauuauugggaggucaaggcccagaaggauuguaaauccuacagugugggaguagcauacaaaacguuggggaaauuugaccaauugggaaagacaaacacuaguugguguauccaugucaacaacuggcuacaaaacacauuugcagcaaagcauaauaauaaagucaaagcuuuggauguuacuguuccugaaaaaauagguguauuuugugauuuugaugggggucaacuuucauucuaugaugcaaauucuaaacaguugcuauauuccuuuaagacaaaauuuacucagccaguacuaccugguuucaugguauggugugguggacuuucuuugaguacugggaugcagguuccaagugcugugagaacacuucagaaaagugaaaauggaaugacugguucagcuagcagccugaacaauguuguuacucaauag

SEQ ID NO: 1667 - RNA, 1152 nt, Artificial Sequence
  derived and/or modified sequence opt1 from fibronectin__Homo_sapiens__BAH12351
auggccagcgccuuccgccugucccucaagcccaaggugagcgacaacaugacccaccugauggucgacuucucccaggagcggcagaugcugcagacccucaaguuccugccggugcccaaggcgcccgagaucgaccccguggagugccuggucgccgacaacagcgugacgguggccuggcgcaugccggaggaggacaacaagaucgaccacuucauccucgagcaccggaagaccaacuucgacggccugccccgcgucaaggacgagcggugcugggagaucaucgacaacaucaaggggaccgaguacacccuguccggccucaaguucgacagcaaguacaugaacuuccgcgugcgggccugcaacaaggccguggcgggggaguacuccgaccccgucacgcuggagaccaaggcccugaacuucaaccucgacaacagcuccagccaccugaaccugaagguggaggacacgugcguggagugggaccccaccggcgggaagggccaggaguccaagaucaagggcaaggagaacaaggggagcguccacgugaccucccucaagaagcacaccagcggcaccccgucccccaagcgcaccagcguggggucccggccgcccgccguccgcggcagccgggaccgcuucacgggggaguccuacaccgugcugggcgacaccgccaucgagagcggccagcacuacugggaggugaaggcgcagaaggacugcaagagcuacuccgucgggguggccuacaagacccugggcaaguucgaccagcucgggaagacgaacaccagcuggugcauccacgugaacaacuggcugcagaacaccuucgccgccaagcacaacaacaaggucaaggcccuggacgugaccgugcccgagaagaucggcgucuucugcgacuucgacggcgggcagcucuccuucuacgacgcgaacagcaagcagcugcuguacuccuucaagacgaaguucacccagcccgugcuccccggcuucauggucuggugcgggggccugagccuguccaccgggaugcagguccccagcgccgugcggacccuccagaaguccgagaacggcaugacgggcagcgccuccagccugaacaacguggugacccaguga

SEQ ID NO: 1668 - RNA, 1152 nt, Artificial Sequence
  derived and/or modified sequence opt2 from fibronectin__Homo_sapiens__BAH12351
auggccuccgccuuccgccucucccucaagcccaaggucuccgacaacaugacccaccucauggucgacuucucccaggagcgccagaugcuccagacccucaaguuccuccccguccccaaggcccccgagaucgaccccgucgagugccucgucgccgacaacuccgucaccgucgccuggcgcaugcccgaggaggacaacaagaucgaccacuucauccucgagcaccgcaagaccaacuucgacggccucccccgcgucaaggacgagcgcugcugggagaucaucgacaacaucaagggcaccgaguacacccucuccggccucaaguucgacuccaaguacaugaacuuccgcguccgcgccugcaacaaggccgucgccggcgaguacuccgaccccgucacccucgagaccaaggcccucaacuucaaccucgacaacuccuccucccaccucaaccucaaggucgaggacaccugcgucgagugggaccccaccggcggcaagggccaggaguccaagaucaagggcaaggagaacaagggcuccguccacgucaccucccucaagaagcacaccuccggcacccccucccccaagcgcaccuccgucggcucccgcccccccgccguccgcggcucccgcgaccgcuucaccggcgaguccuacaccguccucggcgacaccgccaucgaguccggccagcacuacugggaggucaaggcccagaaggacugcaaguccuacuccgucggcgucgccuacaagacccucggcaaguucgaccagcucggcaagaccaacaccuccuggugcauccacgucaacaacuggcuccagaacaccuucgccgccaagcacaacaacaaggucaaggcccucgacgucaccguccccgagaagaucggcgucuucugcgacuucgacggcggccagcucuccuucuacgacgccaacuccaagcagcuccucuacuccuucaagaccaaguucacccagcccguccuccccggcuucauggucuggugcggcggccucucccucuccaccggcaugcagguccccuccgccguccgcacccuccagaaguccgagaacggcaugaccggcuccgccuccucccucaacaacgucgucacccaguga

SEQ ID NO: 1669 - RNA, 1152 nt, Artificial Sequence
  derived and/or modified sequence opt3 from fibronectin__Homo_sapiens__BAH12351
auggccagcgcuuucagacugucccucaagcccaaagugucugacaacaugacccaccuuauggucgauuuuucacaggagaggcaaaugcugcagacauugaaguucuuaccuguuccaaaagcaccggaaaucgaccccguggagugccugguagccgauaauagugugacugucgcguggcggaugccugaagaggacaacaagauugaucauuuuauacuagaacaccgcaaaacgaauuucgacggccucccacgagugaaggaugagcguuguugggagaucauugacaacaucaaggggaccgaauacacacugagcggacuuaaauuugauuccaaguauaugaauuucagaguuagggcuugcaacaaagccguggccggugaguacucugaccccgucacucuggaaaccaaggcauugaauuuuaaccucgauaauucgucaagccaucugaaccugaaaguggaggacacauguguagagugggauccuaccggcgggaagggacaggaaaguaagauuaaaggcaaggagaauaaagguuccguucacgugacuucucucaagaaacauacaagcgggaccccaucccccaagcggacgucagucggaagucgcccuccagcugugagaggcagcagggaccgguucacuggcgaaucuuauaccguguuaggggacacagcaaucgaguccggacagcacuacugggaagucaaagcccaaaaggauugcaagucauauagcguugguguggcuuacaaaacucugggcaaguuugaccagcuugggaaaaccaacacaaguugguguauacacguaaauaacugguugcagaauaccuucgccgcgaagcauaacaacaaagugaaggcacuggaugucacggugccggagaagaucggaguguuuugcgacuucgauggcggucagcuaucuuuuuaugacgccaauuccaaacaacuccuguacagcuucaagacuaaauucacacagcccgugcuuccuggguuuauggucugguguggaggccugucguugucuaccggcaugcagguuccauccgcuguacgcacucuccagaagucagagaacgggaugacaggaagugccagcucccugaauaacguugugacccaauga

SEQ ID NO: 1670 - RNA, 1152 nt, Artificial Sequence
  derived and/or modified sequence opt4 from fibronectin__Homo_sapiens__BAH12351
auggccagcgccuucagacugagccugaagcccaaggugagcgacaacaugacccaccugaugguggacuucagccaggagagacagaugcugcagacccugaaguuccugcccgugcccaaggcccccgagaucgaccccguggagugccugguggccgacaacagcgugaccguggccuggagaaugcccgaggaggacaacaagaucgaccacuucauccuggagcacagaaagaccaacuucgacggccugcccagagugaaggacgagagaugcugggagaucaucgacaacaucaagggcaccgaguacacccugagcggccugaaguucgacagcaaguacaugaacuucagagugagagccugcaacaaggccguggccggcgaguacagcgaccccgugacccuggagaccaaggcccugaacuucaaccuggacaacagcagcagccaccugaaccugaagguggaggacaccugcguggagugggaccccaccggcggcaagggccaggagagcaagaucaagggcaaggagaacaagggcagcgugcacgugaccagccugaagaagcacaccagcggcacccccagccccaagagaaccagcgugggcagcagaccccccgccgugagaggcagcagagacagauucaccggcgagagcuacaccgugcugggcgacaccgccaucgagagcggccagcacuacugggaggugaaggcccagaaggacugcaagagcuacagcgugggcguggccuacaagacccugggcaaguucgaccagcugggcaagaccaacaccagcuggugcauccacgugaacaacuggcugcagaacaccuucgccgccaagcacaacaacaaggugaaggcccuggacgugaccgugcccgagaagaucggcguguucugcgacuucgacggcggccagcugagcuucuacgacgccaacagcaagcagcugcuguacagcuucaagaccaaguucacccagcccgugcugcccggcuucaugguguggugcggcggccugagccugagcaccggcaugcaggugcccagcgccgugagaacccugcagaagagcgagaacggcaugaccggcagcgccagcagccugaacaacguggugacccaguga

SEQ ID NO: 1671 - RNA, 1152 nt, Artificial Sequence
  derived and/or modified sequence opt5 from fibronectin__Homo_sapiens__BAH12351
auggccagcgcuuucagacugucccucaagcccaaagugucugacaacaugacccaccugauggucgauuuuagccaggagcggcaaaugcuucagacacugaaguuccucccuguuccgaaagcccccgaaaucgacccuguggagugccugguggcggauaauuccgucacgguggcuuggcgcaugcccgaagaggacaacaagauugaucauuuuauccuugaacacagaaaaaccaauuucgacggccugccucggguuaaggaugagcgcuguugggagauuaucgacaacauuaaggggacagaauacacccucucuggacugaaauuugauagcaaguauaugaauuucagagugcgggccugcaacaaagccgucgcuggcgaguacuccgaccccgugacacuggaaaccaaggcccucaauuuuaaccuggauaauucuagcucccaucuuaaccugaaaguugaggacacauguguggagugggauccuaccgggggaaagggccaggaaagcaagaucaaagggaaggagaauaaaggaucuguccacgugacgucccucaagaaacauaccagcggcacaccgucucccaagcgcaccuccgugggcagcagaccucccgcuguccgggggucucgcgacagauucacaggagaauccuauaccguucugggcgacacggccaucgagagcgggcagcacuacugggaagugaaagcgcaaaaggauugcaaguccuauucugugggagucgccuacaaaacacuuggcaaguuugaccagcuggggaaaaccaacacaagcugguguauucacgugaauaacuggcuccagaauaccuucgcugccaagcauaacaacaaaguuaaggcucuggaugugaccgucccugagaagaucggaguguuuugcgacuucgauggcggccagcuguccuuuuaugacgccaauagcaaacaacuccuguacucuuucaagacaaaauucacgcagcccguucuuccgggguuuauggugugguguggaggccugucccucagcaccgggaugcaggucccuucugcggugcggacacugcaaaagagcgagaacggaaugaccggcuccgccucuagccuuaauaacgucgugacacaguga

SEQ ID NO: 1672 - protein, 146 aa, Artificial Sequence
  fibronectin__Homo_sapiens__B7Z939
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSEYSDRPHSPLSRSMEMTSNLEKIFCLSFGLTRSRNDTIFKHCNNIC

SEQ ID NO: 1673 - RNA, 441 nt, Artificial Sequence
  fibronectin__Homo_sapiens__BAH14175
augccacccucaaagccucauccaccugucgugggcaaagugacucaucacagcauugaauuauacugggaucuggaaaagaaagccaaacgccaaggaccucaagagcagugguucagguucucgauugaagaagaagaccccaaaaugcacacuuaugguaucauuuauacgggauaugcaacgaagcauguuguugaaggucuggaaccaaggacgcuguacagauuucgccugaaggucaccagccccucuggggagugugaguacagcccacucgucucagugucuacaaccagugaguauucagaccguccacacucaccucucucuagaucaauggagaugacaagcaauuuagaaaaaauauucugccucucguuuggccuuaccagaagcagaaaugauacaauuuuuaaacacugcaauaauauuugcuag

SEQ ID NO: 1674 - RNA, 441 nt, Artificial Sequence
  derived and/or modified sequence opt1 from fibronectin__Homo_sapiens__BAH14175
augcccccgagcaagccccacccgcccguggucggcaaggugacccaccacuccaucgagcuguacugggaccucgagaagaaggccaagcgccaggggccccaggagcagugguuccgguucagcaucgaggaggaggaccccaagaugcacaccuacggcaucaucuacacgggguacgccaccaagcacguggucgagggccuggagccccgcacccuguaccgguuccgccucaaggugaccucccccagcggggagugcgaguacuccccgcuggugagcgucuccacgaccagcgaguacuccgaccggccccacagcccccugucccgcagcauggagaugaccuccaaccucgagaagaucuucugccugagcuucggccugacccggucccgcaacgacacgaucuucaagcacugcaacaacaucugcuga

SEQ ID NO: 1675 - RNA, 441 nt, Artificial Sequence
  derived and/or modified sequence opt2 from fibronectin__Homo_sapiens__BAH14175
augccccccuccaagccccacccccccgucgucggcaaggucacccaccacuccaucgagcucuacugggaccucgagaagaaggccaagcgccagggcccccaggagcagugguuccgcuucuccaucgaggaggaggaccccaagaugcacaccuacggcaucaucuacaccggcuacgccaccaagcacgucgucgagggccucgagccccgcacccucuaccgcuuccgccucaaggucaccucccccuccggcgagugcgaguacuccccccucgucuccgucuccaccaccuccgaguacuccgaccgcccccacuccccccucucccgcuccauggagaugaccuccaaccucgagaagaucuucugccucuccuucggccucacccgcucccgcaacgacaccaucuucaagcacugcaacaacaucugcuga

SEQ ID NO: 1676 - RNA, 441 nt, Artificial Sequence
  derived and/or modified sequence opt3 from fibronectin__Homo_sapiens__BAH14175
augcccccuagcaagccacacccgcccguggucggcaaaguuacccaucacuccaucgagcuguacugggaccucgaaaagaaagccaagagacaggggccucaagagcagugguucagguuuucuauugaagaggaagauccaaaaaugcauacauauggaauaaucuacacugguuaugcuacgaagcacgugguagagggccuugagccccggacccuguaccgcuuccgauugaaggugacaucaccuaguggggaaugcgaguauagcccauuagucuccgugucuacuaccucggaauacucagaccguccccauagcccucugaguagauccauggagaugacaucuaaccuagagaaaaucuuuugucucagcuucggacugaccaggucccggaaugauacuauuuuuaagcacugcaacaauauuuguuga

SEQ ID NO: 1677 - RNA, 441 nt, Artificial Sequence
  derived and/or modified sequence opt4 from fibronectin__Homo_sapiens__BAH14175
augccccccagcaagccccacccccccguggugggcaaggugacccaccacagcaucgagcuguacugggaccuggagaagaaggccaagagacagggcccccaggagcagugguucagauucagcaucgaggaggaggaccccaagaugcacaccuacggcaucaucuacaccggcuacgccaccaagcacgugguggagggccuggagcccagaacccuguacagauucagacugaaggugaccagccccagcggcgagugcgaguacagcccccuggugagcgugagcaccaccagcgaguacagcgacagaccccacagcccccugagcagaagcauggagaugaccagcaaccuggagaagaucuucugccugagcuucggccugaccagaagcagaaacgacaccaucuucaagcacugcaacaacaucugcuga

SEQ ID NO: 1678 - RNA, 441 nt, Artificial Sequence
  derived and/or modified sequence opt5 from fibronectin__Homo_sapiens__BAH14175
augcccccuagcaagccgcaucccccuguggucggcaaaguuacccaccacuccaucgagcuguacugggaccucgaaaagaaagccaagagacaggggccccaagagcagugguuccgguuuucuauugaagaggaagauccuaaaaugcauacauauggaaucauuuacacgggcuaugcuaccaagcacgugguggaggggcuggagccccgcacacuuuacagauuccggcugaaggucaccagcccuuccggagaaugcgaguauucuccgcucgugagcguuuccacaaccucugaauacagcgaccgcccccauuccccucugagcagaucuauggagaugacauccaaccuugagaaaaucuuuugucugagcuucggccucacccggucucgcaaugauacgauuuuuaagcacugcaacaauaucuguuga

SEQ ID NO: 1679 - protein, 684 aa, Artificial Sequence
  fibronectin__Homo_sapiens__G5E9X3
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQTPSG

SEQ ID NO: 1680 - RNA, 2055 nt, Artificial Sequence
  fibronectin__Homo_sapiens__EAX08810
auggcagaacauccaccacuacuggauacaacucagaucuuaaguagugauauuucucuuuugucugccccuauuguaagugcagauggaacacaacagguuauucugguacaaguuaacccaggagaagcauuuacaauaagaagagaagauggacaguuucagugcauuacagguccugcucagguuccaaugauguccccaaaugguucugugccuccuaucuaugugccuccuggauaugccccacagguuauugaagacaaugguguucgaagaguugucguggucccucaggcaccagaguuucacccugguagucacacaguucuccaccguucuccacauccuccucuaccugguuucauuccugucccaacuaugaugccgccuccaccacgucauauguacucacccgugacuggagcuggagacaugacaacacaguauaugccacaguaucagucuucacaagucuauggagauguagaugcucacucuacacauggaagguccaacuuuagagaugaacgaucuaguaaaacauaugaacguuugcagaaaaaauugaaggaucgccaaggaacacagaaagauaaaaugagcaguccaccaucaucaccccagaaaugcccuucucccauuaaugaacauaauggacuuauaaaaggacaaauugcuggugguauaaacacaggaucagcaaaaaucaagucugggaaggggaaaggugguacacaaguugauacagaaauugaagaaaaagaugaagaaacuaaagcauuugaagcacuucuuuccaacauugucaaaccaguggccuccgacauccaggcaaggacaguaguacuuaccuggucaccaccuuccagccucauuaauggugaaacagaugaaaguaguguaccagagcucuaugguuaugaaguucugaucucaaguacuggaaaagaugggaaauacaaaaguguauauguaggagaagaaacaaauaucacuuuaaaugaucucaagccagccauggauuaccaugcaaaaguccaggcagaauauaauucuauaaagggaacuccuucagaggcugaaaucuuuaccaccuugagcugugaaccugauauaccuaauccaccaaggauagccaaucggaccaaaaauucacucacuuugcaauggaaggcaccuagugacaaugguucuaaaauccaaaacuuuguauuagaaugggaugaaggaaaaggaaauggagaauuuugucaguguuacaugggcucacagaaacaauuuaaaauuacuaaacuuucaccagcaaugggcuguaaauucagacuaucggccagaaaugacuaugguacaagugguuuuagugaagaagucuuauauuacaccucaggcugugcuccuucuaugccagcaaguccuguauuaaccaaggcuggaauuacuugguuauccuuacaauggaguaagcccucaggaacaccaucagaugaaggaauuucuuacauuuuagagauggaggaagaaacuucaggauaugguuuuaagccuaaauaugauggagaagaucuugcuuacacagugaaaaaucucagacguaguacuaaguauaaauuuaagguuauugcuuacaacucagaagguaaaaguaauccaagugaaguaguagaauuuacuacuugcccugauaaaccaggcauaccuguaaagccuucagugaaaggaaagauacauucacacaguuuuaaaauaaccugggauccaccaaaagacaauggcggagcaaccaucaauaaauauguaguggagauggcagaagguucuaacggaaacaaaugggaaaugauauacaguggugcuaccagggaacaucuuugugaucgacugaauccaggcuguuucuaucguuuacgaguuuacugcaucagugauggaggacagagugcggucucugaaucuuuacuugugcagacuccagcugugccuccuggcccaugccucccucccagauuacaggguagacccaaagcaaaagaaauacagacccccucugguuga

SEQ ID NO: 1681 - RNA, 2055 nt, Artificial Sequence
  derived and/or modified sequence opt1 from fibronectin__Homo_sapiens__EAX08810
auggccgagcacccgccccugcucgacaccacccagauccugagcuccgacaucagccugcucuccgcccccaucgugagcgcggacggcacgcagcaggucauccugguccaggugaaccccggggaggccuucaccauccgccgggaggacggccaguuccagugcaucaccgggcccgcccaggugccgaugaugucccccaacggcagcgugccgcccaucuacgugccgcccggguacgcgccccaggucaucgaggacaacggcgugcgccggguggucguggugccccaggcccccgaguuccaccccggcucccacaccguccugcaccgcagcccccacccgccccuccccggguucauccccgugcccacgaugaugccgcccccgccccggcacauguacucccccgugaccggcgccggggacaugaccacccaguacaugccccaguaccagagcucccaggucuacggcgacguggacgcccacagcacgcacgggcgcuccaacuuccgggacgagcgcagcuccaagaccuacgagcggcugcagaagaagcugaaggaccgccagggcacccagaaggacaagaugagcuccccgcccagcagcccccagaagugccccucccccaucaacgagcacaacggccucaucaaggggcagaucgccggcgggaucaacaccggcagcgccaagaucaaguccggcaaggggaagggcgggacccagguggacacggagaucgaggagaaggacgaggagaccaaggcguucgaggcccugcugagcaacaucgucaagccgguggccuccgacauccaggcccggaccgugguccucacguggagcccgcccuccagccugaucaacggcgagaccgacgaguccagcgugcccgagcuguacggguacgaggugcucaucuccagcaccggcaaggacggcaaguacaaguccgucuacgugggggaggagaccaacaucacgcugaacgaccugaagcccgccauggacuaccacgcgaagguccaggccgaguacaacagcaucaagggcacccccuccgaggccgagaucuucaccacccucagcugcgagcccgacauccccaacccgccccgcaucgccaaccggacgaagaacucccugacccugcaguggaaggcccccagcgacaacggguccaagauccagaacuucgugcucgagugggacgagggcaaggggaacggcgaguucugccagugcuacaugggcagccagaagcaguucaagaucaccaagcugucccccgcgauggggugcaaguuccgccugagcgcccggaacgacuacggcaccagcggguucuccgaggaggugcucuacuacacgagcggcugcgccccguccaugcccgccagccccguccugaccaaggccgggaucaccuggcugucccuccaguggagcaagcccuccggcaccccgagcgacgagggcaucuccuacauccuggagauggaggaggagacgagcggguacggcuucaagcccaaguacgacggggaggaccuggcguacaccgugaagaaccuccgccgguccaccaaguacaaguucaaggugaucgccuacaacagcgagggcaaguccaaccccagcgaggucguggaguucaccacgugccccgacaagccgggcauccccgugaagcccuccgucaaggggaagauccacagccacuccuucaagaucaccugggacccgcccaaggacaacggcggggccaccaucaacaaguacgugguggagauggccgagggcagcaacgggaacaagugggagaugaucuacagcggcgccacccgcgagcaccugugcgaccggcugaaccccggcugcuucuaccgccuccgggucuacugcaucuccgacgggggccagagcgcgguguccgagagccugcuggugcagacccccgccgucccgcccgggcccugccugcccccgcgccuccagggccgccccaaggccaaggagauccagacgcccuccggguga

SEQ ID NO: 1682 - RNA, 2055 nt, Artificial Sequence
  derived and/or modified sequence opt2 from fibronectin__Homo_sapiens__EAX08810
auggccgagcaccccccccuccucgacaccacccagauccucuccuccgacaucucccuccucuccgcccccaucgucuccgccgacggcacccagcaggucauccucguccaggucaaccccggcgaggccuucaccauccgccgcgaggacggccaguuccagugcaucaccggccccgcccagguccccaugaugucccccaacggcuccgucccccccaucuacgucccccccggcuacgccccccaggucaucgaggacaacggcguccgccgcgucgucgucgucccccaggcccccgaguuccaccccggcucccacaccguccuccaccgcuccccccaccccccccuccccggcuucauccccguccccaccaugaugcccccccccccccgccacauguacucccccgucaccggcgccggcgacaugaccacccaguacaugccccaguaccaguccucccaggucuacggcgacgucgacgcccacuccacccacggccgcuccaacuuccgcgacgagcgcuccuccaagaccuacgagcgccuccagaagaagcucaaggaccgccagggcacccagaaggacaagauguccuccccccccuccuccccccagaagugccccucccccaucaacgagcacaacggccucaucaagggccagaucgccggcggcaucaacaccggcuccgccaagaucaaguccggcaagggcaagggcggcacccaggucgacaccgagaucgaggagaaggacgaggagaccaaggccuucgaggcccuccucuccaacaucgucaagcccgucgccuccgacauccaggcccgcaccgucguccucaccugguccccccccuccucccucaucaacggcgagaccgacgaguccuccguccccgagcucuacggcuacgagguccucaucuccuccaccggcaaggacggcaaguacaaguccgucuacgucggcgaggagaccaacaucacccucaacgaccucaagcccgccauggacuaccacgccaagguccaggccgaguacaacuccaucaagggcacccccuccgaggccgagaucuucaccacccucuccugcgagcccgacauccccaaccccccccgcaucgccaaccgcaccaagaacucccucacccuccaguggaaggcccccuccgacaacggcuccaagauccagaacuucguccucgagugggacgagggcaagggcaacggcgaguucugccagugcuacaugggcucccagaagcaguucaagaucaccaagcucucccccgccaugggcugcaaguuccgccucuccgcccgcaacgacuacggcaccuccggcuucuccgaggagguccucuacuacaccuccggcugcgcccccuccaugcccgccucccccguccucaccaaggccggcaucaccuggcucucccuccagugguccaagcccuccggcacccccuccgacgagggcaucuccuacauccucgagauggaggaggagaccuccggcuacggcuucaagcccaaguacgacggcgaggaccucgccuacaccgucaagaaccuccgccgcuccaccaaguacaaguucaaggucaucgccuacaacuccgagggcaaguccaaccccuccgaggucgucgaguucaccaccugccccgacaagcccggcauccccgucaagcccuccgucaagggcaagauccacucccacuccuucaagaucaccugggacccccccaaggacaacggcggcgccaccaucaacaaguacgucgucgagauggccgagggcuccaacggcaacaagugggagaugaucuacuccggcgccacccgcgagcaccucugcgaccgccucaaccccggcugcuucuaccgccuccgcgucuacugcaucuccgacggcggccaguccgccgucuccgagucccuccucguccagacccccgccgucccccccggccccugccuccccccccgccuccagggccgccccaaggccaaggagauccagacccccuccggcuga

SEQ ID NO: 1683 - RNA, 2055 nt, Artificial Sequence
  derived and/or modified sequence opt3 from fibronectin__Homo_sapiens__EAX08810
auggccgagcaucccccucugcucgacaccacacagauccuuagcuccgauauuucucuguugucagcuccaauagugagugcagacggcacucaacaggucaucuuaguucaggugaacccgggggaagccuucacgauuagaagggaggauggacaguuucaaugcaucaccggucccgcgcagguaccuaugaugagcccaaauggcuccgugcccccuauuuacgucccacccggguaugcuccucaggugaucgaagacaacggaguucggcgcguggucgugguaccacaggccccggaguuccaccccggcucucacacaguucugcaucgaucgccucacccaccccuaccugguuuuauaccagugcccacuaugaugccgccucccccacgucauauguacucaccugucaccggggcaggagauaugacaacccaauauaugccccaguaccagagcagucagguguauggcgacguggaugcccacuccacucacggcagaucuaauuucagggacgaacggagcuccaagacauacgagcgccuccaaaagaagcugaaagauagacaggggacccagaaggacaaaaugucaaguccacccagcucuccucaaaaguguccauccccgaucaacgagcauaauggacuuauuaagggucagaucgcuggcgggauuaacacgggaucagcaaaaaucaagagcggcaaagguaaagggggaacucaggucgauaccgaaauagaggaaaaagacgaggagacaaaggccuuugaagcucuguugaguaauauuguuaagcccguggccucugauauccaggcgaggacuguagugcucaccugguccccuccaagcucgcugauuaacggcgagacagacgaaucuuccguccccgagcuguauggcuacgaagugcucaucucaaguaccgggaaagacggaaaguacaaaagcguuuaugugggugaggagacgaauaucacuuuaaacgaucugaagccugcaauggacuaccacgccaaaguccaagcugaauauaauuccauuaagggcacaccaucugaggccgaaauauucaccacucuuagcugcgagcccgauaucccgaacccuccacggauugcaaaucgcaccaaaaacucauugacacugcaguggaaggcucccagugacaauggguccaagauccagaacuuugugcuagaaugggaugagggaaaaggcaacggugaguucugucagugcuacauggggagccaaaagcaguuuaaaauaacgaagcucucuccugccaugggcuguaaauuccgacugucagcgagaaaugacuauggaaccaguggcuuuagcgaagagguacuuuacuauacauccgggugcgcccccucuaugccagcaucgccuguucugacuaaggcuggaauuaccugguugagccuccagugguccaagcccucagguacaccaagugaugaaggcaucucuuacauccuggagauggaagaggagacuagcggguacggauucaaaccgaaguaugacggcgaagauuuagccuacaccgugaaaaaccugaggcgguccacaaaguauaaauuuaaggucauugcuuacaauucagaggguaagagcaacccuucugaaguggucgaguucaccacuugucccgacaaaccagggauccccgugaagccuuccguuaaaggcaagauucauagucacagcuucaaaauaacgugggauccacccaaggacaauggaggcgccacaaucaacaaguaugugguagagauggcagaagggucuaauggaaacaaaugggagaugauuuacuccggugccacccgugaacaccucugcgaccgccuuaauccuggcuguuuuuauagacugagggucuacugcaucucagaugggggacagagugcugugagcgagucguugcuaguucaaacuccggcggugccacccggcccuugucugccaccccggcuccagggucgaccuaaggcaaaagaaauccagaccccguccggguga

SEQ ID NO: 1684 - RNA, 2055 nt, Artificial Sequence
  derived and/or modified sequence opt4 from fibronectin__Homo_sapiens__EAX08810
auggccgagcaccccccccugcuggacaccacccagauccugagcagcgacaucagccugcugagcgcccccaucgugagcgccgacggcacccagcaggugauccuggugcaggugaaccccggcgaggccuucaccaucagaagagaggacggccaguuccagugcaucaccggccccgcccaggugcccaugaugagccccaacggcagcgugccccccaucuacgugccccccggcuacgccccccaggugaucgaggacaacggcgugagaagaguggugguggugccccaggcccccgaguuccaccccggcagccacaccgugcugcacagaagcccccaccccccccugcccggcuucauccccgugcccaccaugaugccccccccccccagacacauguacagccccgugaccggcgccggcgacaugaccacccaguacaugccccaguaccagagcagccagguguacggcgacguggacgcccacagcacccacggcagaagcaacuucagagacgagagaagcagcaagaccuacgagagacugcagaagaagcugaaggacagacagggcacccagaaggacaagaugagcagcccccccagcagcccccagaagugccccagccccaucaacgagcacaacggccugaucaagggccagaucgccggcggcaucaacaccggcagcgccaagaucaagagcggcaagggcaagggcggcacccagguggacaccgagaucgaggagaaggacgaggagaccaaggccuucgaggcccugcugagcaacaucgugaagcccguggccagcgacauccaggccagaaccguggugcugaccuggagcccccccagcagccugaucaacggcgagaccgacgagagcagcgugcccgagcuguacggcuacgaggugcugaucagcagcaccggcaaggacggcaaguacaagagcguguacgugggcgaggagaccaacaucacccugaacgaccugaagcccgccauggacuaccacgccaaggugcaggccgaguacaacagcaucaagggcacccccagcgaggccgagaucuucaccacccugagcugcgagcccgacauccccaacccccccagaaucgccaacagaaccaagaacagccugacccugcaguggaaggcccccagcgacaacggcagcaagauccagaacuucgugcuggagugggacgagggcaagggcaacggcgaguucugccagugcuacaugggcagccagaagcaguucaagaucaccaagcugagccccgccaugggcugcaaguucagacugagcgccagaaacgacuacggcaccagcggcuucagcgaggaggugcuguacuacaccagcggcugcgcccccagcaugcccgccagccccgugcugaccaaggccggcaucaccuggcugagccugcaguggagcaagcccagcggcacccccagcgacgagggcaucagcuacauccuggagauggaggaggagaccagcggcuacggcuucaagcccaaguacgacggcgaggaccuggccuacaccgugaagaaccugagaagaagcaccaaguacaaguucaaggugaucgccuacaacagcgagggcaagagcaaccccagcgaggugguggaguucaccaccugccccgacaagcccggcauccccgugaagcccagcgugaagggcaagauccacagccacagcuucaagaucaccugggacccccccaaggacaacggcggcgccaccaucaacaaguacgugguggagauggccgagggcagcaacggcaacaagugggagaugaucuacagcggcgccaccagagagcaccugugcgacagacugaaccccggcugcuucuacagacugagaguguacugcaucagcgacggcggccagagcgccgugagcgagagccugcuggugcagacccccgccgugccccccggccccugccugccccccagacugcagggcagacccaaggccaaggagauccagacccccagcggcuga

SEQ ID NO: 1685 - RNA, 2055 nt, Artificial Sequence
  derived and/or modified sequence opt5 from fibronectin__Homo_sapiens__EAX08810
auggccgagcaucccccucugcucgacaccacacagauccugagcuccgauauuucucuucugagcgcuccgaucguguccgccgacggcacgcaacaggucauucucguucaggugaaccccggggaagcguucaccaucagacgggaggauggacaguuucaaugcauuacaggcccugcucaggugcccaugaugucuccuaaugggagcgugcccccuaucuacgucccgcccggauaugccccucagguuaucgaagacaacggcgugcgcagagucgugguugugccccaggccccugaguuccaccccgggucccacaccguccugcaucggucuccgcacccuccccuuccuggauuuauucccgugcccacaaugaugccuccgcccccucgccauauguacagccccgugaccggcgcuggcgauaugacaacccaauauaugccucaguaccaguccagccaggucuauggggacguugaugcccacucuacgcacggaagauccaauuuccgggacgaacgcagcucuaagaccuacgagagacugcaaaagaagcucaaagaucggcagggcacacagaaggacaaaauguccucucccccgagcuccccucaaaagugucccagcccuaucaacgagcauaaugggcugauuaagggacagaucgcuggcgggauuaacaccggauccgccaaaaucaagucuggcaaaggcaaagggggaacacagguggauaccgaaauugaggaaaaagacgaggagacgaaggcguuugaagcccugcucagcaauaucgugaagcccgucgcuuccgauauccaggcccgcacagugguucugaccuggagcccucccucuucccuuauuaacggcgagacagacgaaagcucugugccggagcuguauggguacgaaguccucaucagcuccaccggaaaagacggcaaguacaaaucuguguauguuggggaggagaccaauauuacacugaacgaucuuaagccugcuauggacuaccacgccaaagugcaagcggaauauaauagcaucaagggaacgcccuccgaggccgaaauuuucaccacacugagcugcgagcccgauaucccuaacccgcccagaaucgcuaaucggaccaaaaacucucucacacugcaguggaaggccccuuccgacaauggcagcaagauucagaacuuuguccuggaaugggaugagggcaaagggaacggagaguucugucagugcuacaugggcucucaaaagcaguuuaaaaucaccaagcucucccccgcuaugggguguaaauuccgccugagcgccagaaaugacuauggaacguccggcuuuucugaagaggugcuuuacuauacaagcgggugcgccccuuccaugcccgcuucuccuguccugaccaaggcgggcauuaccuggcucagccugcagugguccaagcccagcggaacaccgucugaugaaggcaucuccuacauucuugagauggaagaggagaccagcggguacggauucaaaccuaaguaugacggcgaagaucuggccuacacagugaaaaaccuccggcgcucuacgaaguauaaauuuaagguuaucgcuuacaauuccgagggaaagagcaaccccucugaaguggucgaguucaccacauguccugacaaacccgggaucccggugaagccuagcguuaaaggcaagauucauucccacagcuucaaaaucaccugggaucccccuaaggacaaugggggcgccacaauuaacaaguauguggucgagauggccgaaggaucuaauggcaacaaaugggagaugaucuacuccggggcuaccagagaacaccugugcgaccggcugaaucccggauguuuuuauagacuccgcguguacugcauuagcgauggcgggcaguccgccgugucugagagccugcuuguucaaacgcccgcggucccuccgggacccugucugccuccccggcuccagggcagaccuaaggcuaaagaaauccagacccccuccggguga

SEQ ID NO: 1686 - protein, 163 aa, Artificial Sequence
  fibronectin__Homo_sapiens__Q9H382
MSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1687 - RNA, 492 nt, Artificial Sequence
  fibronectin__Homo_sapiens__AAG35520
augucugaaucaggcuuuaaacuguugugccagugcuuaggcuuuggaaguggucauuucagaugugauucaucuagauggugccaugacaauggugugaacuacaagauuggagagaagugggaccgucagggagaaaauggccagaugaugagcugcacaugucuugggaacggaaaaggagaauucaagugugacccucaugaggcaacguguuaugaugaugggaagacauaccacguaggagaacaguggcagaaggaauaucucggugccauuugcuccugcacaugcuuuggaggccagcggggcuggcgcugugacaacugccgcagaccugggggugaacccagucccgaaggcacuacuggccaguccuacaaccaguauucucagagauaccaucagagaacaaacacuaauguuaauugcccaauugagugcuucaugccuuuagauguacaggcugacagagaagauucccgagaguaa

SEQ ID NO: 1688 - RNA, 492 nt, Artificial Sequence
  derived and/or modified sequence opt1 from fibronectin__Homo_sapiens__AAG35520
augagcgaguccggcuucaagcugcucugccagugccugggguucggcagcgggcacuuccgcugcgacuccagccgguggugccacgacaacggcgugaacuacaagaucggggagaagugggaccgccagggcgagaacggccagaugauguccugcacgugccuggggaacggcaagggggaguucaagugcgacccccacgaggcgaccugcuacgacgacggcaagaccuaccacgucggggagcaguggcagaaggaguaccucggcgccaucugcagcugcacgugcuucggcgggcagcggggcuggcgcugcgacaacugccggcgccccgggggcgagccgucccccgagggcaccaccgggcagagcuacaaccaguacucccagcgguaccaccagcgcaccaacaccaacgugaacugccccaucgagugcuucaugccgcuggacgugcaggccgaccgggaggacagccgcgaguga

SEQ ID NO: 1689 - RNA, 492 nt, Artificial Sequence
  derived and/or modified sequence opt2 from fibronectin__Homo_sapiens__AAG35520
auguccgaguccggcuucaagcuccucugccagugccucggcuucggcuccggccacuuccgcugcgacuccucccgcuggugccacgacaacggcgucaacuacaagaucggcgagaagugggaccgccagggcgagaacggccagaugauguccugcaccugccucggcaacggcaagggcgaguucaagugcgacccccacgaggccaccugcuacgacgacggcaagaccuaccacgucggcgagcaguggcagaaggaguaccucggcgccaucugcuccugcaccugcuucggcggccagcgcggcuggcgcugcgacaacugccgccgccccggcggcgagcccucccccgagggcaccaccggccaguccuacaaccaguacucccagcgcuaccaccagcgcaccaacaccaacgucaacugccccaucgagugcuucaugccccucgacguccaggccgaccgcgaggacucccgcgaguga

SEQ ID NO: 1690 - RNA, 492 nt, Artificial Sequence
  derived and/or modified sequence opt3 from fibronectin__Homo_sapiens__AAG35520
augagcgaguccggcuucaagcugcucugccagugucuuggguuuggaucuggucacuucagaugcgacucaaguagguggugucaugauaacggcgugaauuacaaaaucggggaaaagugggaccggcaaggagagaacggccagaugaugagcugcaccugucuggguaaugggaaaggagaauuuaagugcgauccccacgaggccacauguuaugacgauggcaaaacuuaccaugucggcgaacaguggcagaaggaguauuugggggcuauuugcuccuguacgugcuucggaggucaacgcggcuggcgaugugacaacugccguagaccugggggagagccaucuccggaaggcaccacaggucagucguacaaucaguauucacagagguaccaccaacggacuaacaccaauguuaacugccccauagaguguuuuaugccuuuagaugugcaggcagaccgcgaagauagcagagaguga

SEQ ID NO: 1691 - RNA, 492 nt, Artificial Sequence
  derived and/or modified sequence opt4 from fibronectin__Homo_sapiens__AAG35520
augagcgagagcggcuucaagcugcugugccagugccugggcuucggcagcggccacuucagaugcgacagcagcagauggugccacgacaacggcgugaacuacaagaucggcgagaagugggacagacagggcgagaacggccagaugaugagcugcaccugccugggcaacggcaagggcgaguucaagugcgacccccacgaggccaccugcuacgacgacggcaagaccuaccacgugggcgagcaguggcagaaggaguaccugggcgccaucugcagcugcaccugcuucggcggccagagaggcuggagaugcgacaacugcagaagacccggcggcgagcccagccccgagggcaccaccggccagagcuacaaccaguacagccagagauaccaccagagaaccaacaccaacgugaacugccccaucgagugcuucaugccccuggacgugcaggccgacagagaggacagcagagaguga

SEQ ID NO: 1692 - RNA, 492 nt, Artificial Sequence
  derived and/or modified sequence opt5 from fibronectin__Homo_sapiens__AAG35520
augagcgaguccggcuucaagcugcucugccagugucugggguuuggaucuggccacuucagaugcgacagcucccgguggugucaugauaacggggugaauuacaaaaucggagaaaagugggaccgccaaggcgagaacgggcagaugaugucuugcaccugucuuggaaauggcaaaggcgaauuuaagugcgauccccacgaggccacauguuaugacgaugggaaaacguaccaugucggagaacaguggcagaaggaguaucugggcgcuauuugcagcuguaccugcuucgggggacaaagaggcuggcggugugacaacugccgcagaccugggggagagccgucccccgaaggcacaaccggccagucuuacaaucaguauagccagcgguaccaccaacgcacaaacaccaauguuaacugcccuaucgaguguuuuaugccccucgaugugcaggccgacagagaagauucccgggaguga

SEQ ID NO: 1693 - protein, 380 aa, Artificial Sequence
  FOS__Homo_sapiens__P01100
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 1694 - RNA, 1143 nt, Artificial Sequence
  FOS__Homo_sapiens__AAA52471
augauguucucgggcuucaacgcagacuacgaggcgucauccucccgcugcagcagcgcguccccggccggggauagccucucuuacuaccacucacccgcagacuccuucuccagcaugggcucgccugucaacgcgcaggacuucugcacggaccuggccgucuccagugccaacuucauucccacggucacugccaucucgaccaguccggaccugcaguggcuggugcagcccgcccucgucuccucuguggccccaucgcagaccagagccccucacccuuucggaguccccgcccccuccgcuggggcuuacuccagggcuggcguugugaagaccaugacaggaggccgagcgcagagcauuggcaggaggggcaagguggaacaguuaucuccagaagaagaagagaaaaggagaauccgaagggaaaggaauaagauggcugcagccaaaugccgcaaccggaggagggagcugacugauacacuccaagcggagacagaccaacuagaagaugagaagucugcuuugcagaccgagauugccaaccugcugaaggagaaggaaaaacuagaguucauccuggcagcucaccgaccugccugcaagaucccugaugaccugggcuucccagaagagaugucuguggcuucccuugaucugacugggggccugccagagguugccaccccggagucugaggaggccuucacccugccucuccucaaugacccugagcccaagcccucaguggaaccugucaagagcaucagcagcauggagcugaagaccgagcccuuugaugacuuccuguucccagcaucauccaggcccaguggcucugagacagcccgcuccgugccagacauggaccuaucuggguccuucuaugcagcagacugggagccucugcacaguggcucccuggggauggggcccauggccacagagcuggagccccugugcacuccgguggucaccuguacucccagcugcacugcuuacacgucuuccuucgucuucaccuaccccgaggcugacuccuuccccagcugugcagcugcccaccgcaagggcagcagcagcaaugagccuuccucugacucgcucagcucacccacgcugcuggcccuguga

SEQ ID NO: 1695 - RNA, 1143 nt, Artificial Sequence
  derived and/or modified sequence opt1 from FOS__Homo_sapiens__AAA52471
augauguucagcggcuucaacgccgacuacgaggccuccagcucccgcugcagcuccgcgagccccgccggggacucccugagcuacuaccacuccccggccgacagcuucuccagcaugggcucccccgugaacgcccaggacuucugcaccgaccucgccgucagcuccgcgaacuucauccccaccgugacggccaucagcaccucccccgaccugcaguggcuggugcagccggcccucgucagcuccguggcccccagccagacccgggcgccccaccccuucggggugccggcccccagcgccggcgccuacucccgcgccggggucgugaagaccaugacgggcggccgggcgcagagcaucgggcgccggggcaagguggagcagcugucccccgaggaggaggagaagcgccggauccgccgggagcgcaacaagauggccgccgccaagugccggaaccgccggcgcgagcugaccgacacccuccaggccgagaccgaccagcuggaggacgagaaguccgcgcugcagacggagaucgccaaccuccugaaggagaaggagaagcuggaguucauccucgccgcccaccggcccgccugcaagaucccggacgaccugggguuccccgaggagaugagcgucgcgagccuggaccucaccggcgggcugcccgagguggccacccccgaguccgaggaggccuucacccugccgcuccugaacgaccccgagcccaagcccagcguggagccggucaaguccaucagcuccauggagcugaagacggagcccuucgacgacuuccucuuccccgccagcucccgccccagcggcuccgagaccgcccggagcgugccggacauggaccuguccggcagcuucuacgcggccgacugggagccccugcacuccgggagccucggcauggggcccauggccaccgagcuggagccccugugcaccccgguggucacgugcacccccagcugcaccgccuacaccuccagcuucguguucacguaccccgaggcggacuccuucccgagcugcgccgccgcccaccgcaagggcuccagcuccaacgagcccagcuccgacagccucuccagccccacccugcuggcccucuga

SEQ ID NO: 1696 - RNA, 1143 nt, Artificial Sequence
  derived and/or modified sequence opt2 from FOS__Homo_sapiens__AAA52471
augauguucuccggcuucaacgccgacuacgaggccuccuccucccgcugcuccuccgccucccccgccggcgacucccucuccuacuaccacucccccgccgacuccuucuccuccaugggcucccccgucaacgcccaggacuucugcaccgaccucgccgucuccuccgccaacuucauccccaccgucaccgccaucuccaccucccccgaccuccaguggcucguccagcccgcccucgucuccuccgucgcccccucccagacccgcgccccccaccccuucggcguccccgcccccuccgccggcgccuacucccgcgccggcgucgucaagaccaugaccggcggccgcgcccaguccaucggccgccgcggcaaggucgagcagcucucccccgaggaggaggagaagcgccgcauccgccgcgagcgcaacaagauggccgccgccaagugccgcaaccgccgccgcgagcucaccgacacccuccaggccgagaccgaccagcucgaggacgagaaguccgcccuccagaccgagaucgccaaccuccucaaggagaaggagaagcucgaguucauccucgccgcccaccgccccgccugcaagauccccgacgaccucggcuuccccgaggagauguccgucgccucccucgaccucaccggcggccuccccgaggucgccacccccgaguccgaggaggccuucacccucccccuccucaacgaccccgagcccaagcccuccgucgagcccgucaaguccaucuccuccauggagcucaagaccgagcccuucgacgacuuccucuuccccgccuccucccgccccuccggcuccgagaccgcccgcuccguccccgacauggaccucuccggcuccuucuacgccgccgacugggagccccuccacuccggcucccucggcaugggccccauggccaccgagcucgagccccucugcacccccgucgucaccugcacccccuccugcaccgccuacaccuccuccuucgucuucaccuaccccgaggccgacuccuuccccuccugcgccgccgcccaccgcaagggcuccuccuccaacgagcccuccuccgacucccucuccucccccacccuccucgcccucuga

SEQ ID NO: 1697 - RNA, 1143 nt, Artificial Sequence
  derived and/or modified sequence opt3 from FOS__Homo_sapiens__AAA52471
augauguucagcggcuuuaacgccgacuacgaggcuuccucuucaagaugcaguagcgcaucccccgccggggauucucugucguauuaccacagcccugcggacagcuucaguuccaugggaucuccagugaaugcucaggauuuuuguaccgaccucgccgucagcuccgcaaacuucaucccgacaguuacugccauuucaacgagucccgaucuucaauggcuggugcagccugcuuugguaagcucuguggcaccaucccagaccagggcuccccauccuuuuggugucccagcccccucagccggcgcguauagccgggcaggggugguuaagacaaugacuggaggccgcgcccagaguauaggucgacgugggaaaguggaacaauuaucuccugaggaagaggaaaagagaaggauccggcgcgagagaaauaaaauggcugccgcaaagugcaggaaccggcgccgagagcugaccgacacacuacaggcugaaaccgaucagcucgaggacgaaaaauccgcccugcagacugagauugcgaaucuucugaaggagaaggaaaaauuggaguucauccucgccgcacacagaccagcuuguaagauuccggaugaccugggauuucccgaagagaugagcgucgccucgcuggaucucacaggcggcuuaccugaaguggcuaccccagagucugaggaagccuucacgcugccccuuuugaacgacccugagccaaaacccuccguagaaccgguuaagucaaucaguagcauggagcugaaaacugaaccuuuugaugacuuccuauuucccgcauccucuaggccaagcgggucagagaccgcccggagugugccugacauggaucucuccggaucauucuacgcugcggacugggagccccugcauucugguucacuuggcauggggccaauggcaacagaacuggagcccuugugcacuccugucgugaccuguacaccaaguugcaccgccuauacgagcuccuuuguguucacuuacccggaagcugauucuuuccccucgugugccgcagcccaccguaagggaagcuccucaaaugagccuaguucugacagccucuccucaccaacacuguuagcucuguga

SEQ ID NO: 1698 - RNA, 1143 nt, Artificial Sequence
  derived and/or modified sequence opt4 from FOS__Homo_sapiens__AAA52471
augauguucagcggcuucaacgccgacuacgaggccagcagcagcagaugcagcagcgccagccccgccggcgacagccugagcuacuaccacagccccgccgacagcuucagcagcaugggcagccccgugaacgcccaggacuucugcaccgaccuggccgugagcagcgccaacuucauccccaccgugaccgccaucagcaccagccccgaccugcaguggcuggugcagcccgcccuggugagcagcguggcccccagccagaccagagccccccaccccuucggcgugcccgcccccagcgccggcgccuacagcagagccggcguggugaagaccaugaccggcggcagagcccagagcaucggcagaagaggcaagguggagcagcugagccccgaggaggaggagaagagaagaaucagaagagagagaaacaagauggccgccgccaagugcagaaacagaagaagagagcugaccgacacccugcaggccgagaccgaccagcuggaggacgagaagagcgcccugcagaccgagaucgccaaccugcugaaggagaaggagaagcuggaguucauccuggccgcccacagacccgccugcaagauccccgacgaccugggcuuccccgaggagaugagcguggccagccuggaccugaccggcggccugcccgagguggccacccccgagagcgaggaggccuucacccugccccugcugaacgaccccgagcccaagcccagcguggagcccgugaagagcaucagcagcauggagcugaagaccgagcccuucgacgacuuccuguuccccgccagcagcagacccagcggcagcgagaccgccagaagcgugcccgacauggaccugagcggcagcuucuacgccgccgacugggagccccugcacagcggcagccugggcaugggccccauggccaccgagcuggagccccugugcacccccguggugaccugcacccccagcugcaccgccuacaccagcagcuucguguucaccuaccccgaggccgacagcuuccccagcugcgccgccgcccacagaaagggcagcagcagcaacgagcccagcagcgacagccugagcagccccacccugcuggcccuguga

SEQ ID NO: 1699 - RNA, 1143 nt, Artificial Sequence
  derived and/or modified sequence opt5 from FOS__Homo_sapiens__AAA52471
augauguucagcggcuuuaacgccgacuacgaggcuuccucuagcagaugcuccucugccagccccgcgggggauucccugucuuauuaccacagcccugcugacuccuucagcucuaugggauccccggugaaugcccaggauuuuuguaccgaccucgccgucagcucugcuaacuucauccccacaguuacggccauuuccaccagcccugaucugcaauggcuugugcagcccgcucuggugucuuccgucgccccuagccagacacgggcgccccauccuuuuggcgugccggcccccuccgcuggggccuauucucgcgcuggaguugugaagaccaugacaggcgggagagcccagagcaucggacggcgcggcaaagucgaacaacucuccccugaggaagaggaaaagagacggauucgcagagagcggaauaaaauggcggccgcuaagugccgcaacagacggcgcgagcugaccgacacacuucaggccgaaaccgaucagcuggaggacgagaaaagcgcucuccagacggaaaucgccaaucugcugaaggagaaggaaaaacucgaguucauucuggccgcucacagacccgcguguaagaucccugaugaccuuggcuuucccgaagagaugucuguggccucccuggaucucaccgggggacugccggaaguugcuacaccugagagcgaggaagccuucacccuuccccugcucaacgacccugagcccaaacccucuguggaaccugucaagagcaucuccucuauggagcugaaaacagaaccguuugaugacuuccuguuucccgccagcucccggccuagcggcucugagaccgcucgcuccgugcccgacauggaucucagcgggucuuucuacgccgcggacugggagccucugcauuccggaagccuuggcauggggcccauggcuacggaacuggagccgcucugcacaccuguggucaccuguacacccuccugcaccgccuauaccucuagcuuuguuuucacauacccugaagccgauuccuuccccucuugugcugccgcucacagaaagggaagcuccagcaaugagccuucuuccgacagccugucuucccccacgcuucuggcccucuga

SEQ ID NO: 1700 - protein, 431 aa, Artificial Sequence
  FOXP3__Homo_sapiens__Q9BZS1
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 1701 - RNA, 1296 nt, Artificial Sequence
  FOXP3__Homo_sapiens__AAG53607
augcccaaccccaggccuggcaagcccucggccccuuccuuggcccuuggcccauccccaggagccucgcccagcuggagggcugcacccaaagccucagaccugcugggggcccggggcccagggggaaccuuccagggccgagaucuucgaggcggggcccaugccuccucuucuuccuugaaccccaugccaccaucgcagcugcagcugcccacacugccccuagucaugguggcacccuccggggcacggcugggccccuugccccacuuacaggcacuccuccaggacaggccacauuucaugcaccagcucucaacgguggaugcccacgcccggaccccugugcugcaggugcacccccuggagagcccagccaugaucagccucacaccacccaccaccgccacuggggucuucucccucaaggcccggccuggccucccaccugggaucaacguggccagccuggaauggguguccagggagccggcacugcucugcaccuucccaaaucccagugcacccaggaaggacagcacccuuucggcugugccccagagcuccuacccacugcuggcaaauggugucugcaaguggcccggaugugagaaggucuucgaagagccagaggacuuccucaagcacugccaggcggaccaucuucuggaugagaagggcagggcacaaugucuccuccagagagagaugguacagucucuggagcagcagcuggugcuggagaaggagaagcugagugccaugcaggcccaccuggcugggaaaauggcacugaccaaggcuucaucuguggcaucauccgacaagggcuccugcugcaucguagcugcuggcagccaaggcccugucgucccagccuggucuggcccccgggaggccccugacagccuguuugcuguccggaggcaccugugggguagccauggaaacagcacauucccagaguuccuccacaacauggacuacuucaaguuccacaacaugcgacccccuuucaccuacgccacgcucauccgcugggccauccuggaggcuccagagaagcagcggacacucaaugagaucuaccacugguucacacgcauguuugccuucuucagaaaccauccugccaccuggaagaacgccauccgccacaaccugagucugcacaagugcuuugugcggguggagagcgagaagggggcuguguggaccguggaugagcuggaguuccgcaagaaacggagccagaggcccagcagguguuccaacccuacaccuggccccuga

SEQ ID NO: 1702 - RNA, 1296 nt, Artificial Sequence
  derived and/or modified sequence opt1 from FOXP3__Homo_sapiens__AAG53607
augcccaacccgcgccccggcaagcccagcgcccccucccuggcccucgggccgagccccggcgcgucccccagcuggcgggccgcccccaaggccuccgaccugcugggggcccgcggccccgggggcaccuuccagggccgggaccuccgcgggggcgcgcacgccagcuccagcucccugaaccccaugccgcccagccagcugcagcucccgacccugccccuggugauggucgcccccuccggggcccggcucggcccccugccgcaccuccaggcgcugcugcaggaccgcccccacuucaugcaccagcugagcacgguggacgcccacgcccggacccccgugcuccagguccacccccuggaguccccggccaugaucagccugaccccgcccaccacggccaccgggguguucucccucaaggcgcgccccggccugccgcccggcaucaacguggccagccuggagugggucucccgggagcccgcccuccugugcaccuuccccaaccccagcgcgccccgcaaggacuccacccugagcgccgugccccagagcuccuacccgcuccuggccaacggggugugcaaguggcccggcugcgagaaggucuucgaggagcccgaggacuuccugaagcacugccaggccgaccaccuccuggacgagaaggggcgggcccagugccugcuccagcgcgagauggugcagagccuggagcagcagcuggugcucgagaaggagaagcuguccgccaugcaggcccaccuggcgggcaagauggcccucacgaaggccagcuccgucgccagcuccgacaagggcagcugcugcaucguggccgcggggucccagggccccguggucccggccuggagcgggccccgggaggcccccgacucccuguucgccgugcgccggcaccuguggggcagccacgggaacuccaccuuccccgaguuccuccacaacauggacuacuucaaguuccacaacaugcgcccgcccuucaccuacgcgacccugauccggugggccauccuggaggcccccgagaagcagcgcacgcucaacgagaucuaccacugguucacccggauguucgccuucuuccgcaaccaccccgccaccuggaagaacgcgauccggcacaaccugagccugcacaagugcuucgugcgcgucgaguccgagaagggcgccguguggaccguggacgagcucgaguuccgcaagaagcggagccagcgcccgucccggugcagcaaccccacgcccggccccuga

SEQ ID NO: 1703 - RNA, 1296 nt, Artificial Sequence
  derived and/or modified sequence opt2 from FOXP3__Homo_sapiens__AAG53607
augcccaacccccgccccggcaagcccuccgcccccucccucgcccucggccccucccccggcgccucccccuccuggcgcgccgcccccaaggccuccgaccuccucggcgcccgcggccccggcggcaccuuccagggccgcgaccuccgcggcggcgcccacgccuccuccuccucccucaaccccaugccccccucccagcuccagcuccccacccucccccucgucauggucgcccccuccggcgcccgccucggcccccucccccaccuccaggcccuccuccaggaccgcccccacuucaugcaccagcucuccaccgucgacgcccacgcccgcacccccguccuccagguccacccccucgagucccccgccaugaucucccucaccccccccaccaccgccaccggcgucuucucccucaaggcccgccccggccucccccccggcaucaacgucgccucccucgagugggucucccgcgagcccgcccuccucugcaccuuccccaaccccuccgccccccgcaaggacuccacccucuccgccgucccccaguccuccuacccccuccucgccaacggcgucugcaaguggcccggcugcgagaaggucuucgaggagcccgaggacuuccucaagcacugccaggccgaccaccuccucgacgagaagggccgcgcccagugccuccuccagcgcgagaugguccagucccucgagcagcagcucguccucgagaaggagaagcucuccgccaugcaggcccaccucgccggcaagauggcccucaccaaggccuccuccgucgccuccuccgacaagggcuccugcugcaucgucgccgccggcucccagggccccgucguccccgccugguccggcccccgcgaggcccccgacucccucuucgccguccgccgccaccucuggggcucccacggcaacuccaccuuccccgaguuccuccacaacauggacuacuucaaguuccacaacaugcgcccccccuucaccuacgccacccucauccgcugggccauccucgaggcccccgagaagcagcgcacccucaacgagaucuaccacugguucacccgcauguucgccuucuuccgcaaccaccccgccaccuggaagaacgccauccgccacaaccucucccuccacaagugcuucguccgcgucgaguccgagaagggcgccgucuggaccgucgacgagcucgaguuccgcaagaagcgcucccagcgccccucccgcugcuccaaccccacccccggccccuga

SEQ ID NO: 1704 - RNA, 1296 nt, Artificial Sequence
  derived and/or modified sequence opt3 from FOXP3__Homo_sapiens__AAG53607
augcccaacccuagaccaggcaagccgagcgcccccucccuggcucucgggccuucuccaggagcaucacccaguuggagggccgcgccuaaagcuagcgaccuucugggugcccggggcccagggggaaccuuccagggccgcgauuugcgagguggggcacacgccuccucuucgucauuaaaucccaugccuccaagccaacugcagcuaccgacacucccccuggugauggucgcuccuaguggagcacgucuuggcccacugccccauuugcaggcccuccugcaggacagaccucacuuuaugcaucaacuguccacuguugaugcucacgccaggacgccagugcuccagguacaucccuuagaaucuccggcgaugaucagccugaccccucccacaacugcaaccggcguguucucccuuaaggcccggccaggguugccucccggaauuaacgucgcuucacuggaaugggugagucgcgagccagcccuacucugcacauuucccaauccuagcgcaccaagaaaagacucuacccuguccgcuguuccgcagucaagcuacccccuucuggccaacgguguguguaaguggccuggcugcgaaaaagucuucgaggaaccagaggauuucuugaagcacugucaggcggaccaccuccuggaugagaaggggagggcccaaugcuuacugcagcgggaaauggugcagagucucgagcagcaacuuguacuggaaaaagagaaguugucugcaaugcaggcucaucuagccggaaaaauggcucugacuaaggccuccagcguugcaucgucugacaaaggcuccuguugcauaguggccgcugguucacaggggcccgucgugccugcguggaguggaccacgcgaggcacccgauagccucuucgccgugcgaagacaccuguggggcucccauggcaauucuacauuuccggaauuucuucacaacauggacuauuuuaaguuccacaauaugaggccuccauuuaccuacgcuacgcugauccggugggccauuuuggaggcacccgaaaagcaacguacucucaacgagaucuaucauugguucacccgcauguuugccuucuucagaaaucacccugcuacauggaaaaacgccauuaggcauaaucugagcuuacacaaguguuuuguccggguugaaucagagaaaggggcaguguggacuguagaugagcuggaguuccgaaagaaacgcagucagagacccuccaggugcagcaacccaaccccuggacccuga

SEQ ID NO: 1705 - RNA, 1296 nt, Artificial Sequence
  derived and/or modified sequence opt4 from FOXP3__Homo_sapiens__AAG53607
augcccaaccccagacccggcaagcccagcgcccccagccuggcccugggccccagccccggcgccagccccagcuggagagccgcccccaaggccagcgaccugcugggcgccagaggccccggcggcaccuuccagggcagagaccugagaggcggcgcccacgccagcagcagcagccugaaccccaugccccccagccagcugcagcugcccacccugccccuggugaugguggcccccagcggcgccagacugggcccccugccccaccugcaggcccugcugcaggacagaccccacuucaugcaccagcugagcaccguggacgcccacgccagaacccccgugcugcaggugcacccccuggagagccccgccaugaucagccugaccccccccaccaccgccaccggcguguucagccugaaggccagacccggccugccccccggcaucaacguggccagccuggagugggugagcagagagcccgcccugcugugcaccuuccccaaccccagcgcccccagaaaggacagcacccugagcgccgugccccagagcagcuacccccugcuggccaacggcgugugcaaguggcccggcugcgagaagguguucgaggagcccgaggacuuccugaagcacugccaggccgaccaccugcuggacgagaagggcagagcccagugccugcugcagagagagauggugcagagccuggagcagcagcuggugcuggagaaggagaagcugagcgccaugcaggcccaccuggccggcaagauggcccugaccaaggccagcagcguggccagcagcgacaagggcagcugcugcaucguggccgccggcagccagggccccguggugcccgccuggagcggccccagagaggcccccgacagccuguucgccgugagaagacaccuguggggcagccacggcaacagcaccuuccccgaguuccugcacaacauggacuacuucaaguuccacaacaugagaccccccuucaccuacgccacccugaucagaugggccauccuggaggcccccgagaagcagagaacccugaacgagaucuaccacugguucaccagaauguucgccuucuucagaaaccaccccgccaccuggaagaacgccaucagacacaaccugagccugcacaagugcuucgugagaguggagagcgagaagggcgccguguggaccguggacgagcuggaguucagaaagaagagaagccagagacccagcagaugcagcaaccccacccccggccccuga

SEQ ID NO: 1706 - RNA, 1296 nt, Artificial Sequence
  derived and/or modified sequence opt5 from FOXP3__Homo_sapiens__AAG53607
augcccaacccuagaccgggcaagcccagcgccccuucccuggcucucgggcccucuccuggagccagccccuccuggcgggcggcuccuaaagccucugaccugcuuggcgcccgcgggccgggaggcaccuuccaggggagagaucugcggggaggcgcucacgccagcuccucuagccucaaucccaugccucccucccaacugcagcuuccuacacugccccucgugauggucgcuccgagcggcgcccgccuggggccucugccccaucuccaggcgcugcuucaggacagaccucacuuuaugcaucaacugucuacgguugaugcccacgcucggacccccgugcuccaggugcauccccuggaauccccugccaugaucagccuuacaccgcccaccacagcuaccggagucuucucucugaaggcccgcccuggccugcccccugggauuaacguggcgucccuggaauggguuagcagagagcccgcccugcucugcacauuuccgaauccuucugcuccccggaaagacuccacccugagcgccgugccucaguccucuuacccccuucuggcuaacggagucuguaaguggccuggcugcgaaaaaguguucgaggaacccgaggauuuucucaagcacugucaggccgaccaccuccuugaugagaaggggcgcgcccaaugccugcuccagagagaaaugguucagagccuggagcagcaacuggugcucgaaaaagagaagcuguccgcuaugcaggcgcaucuugccggaaaaauggcucugacgaaggccagcucugucgccuccagcgacaaaggcucuuguugcaucguggcugccggcagccaggggccgguggucccugcgugguccggaccccgggaggcucccgauucucucuucgccguucgcagacaccuguggggcagccauggaaauuccaccuuuccugaguuccuucacaacauggacuauuuuaaguuccacaauaugcggccgcccuuuacauacgccacccugauucgcugggcuauccucgaagccccugaaaagcaaagaacacugaacgagauuuaucauugguucacccggauguuugcuuucuucagaaaucaccccgccacguggaaaaacgcgauccgccauaaucugagccuccacaaguguuuugugcggguggaaucugagaaaggggccgucuggacaguggaugagcuggaguucagaaagaaacgcucccagcggccuagcagaugcucuaaccccaccccuggccccuga

SEQ ID NO: 1707 - protein, 365 aa, Artificial Sequence
  FUT1__Homo_sapiens__P19526
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 1708 - RNA, 1098 nt, Artificial Sequence
  FUT1__Homo_sapiens__AAA52639
auguggcuccggagccaucgucagcucugccuggccuuccugcuagucuguguccucucuguaaucuucuuccuccauauccaucaagacagcuuuccacauggccuaggccugucgauccuguguccagaccgccgccuggugacacccccaguggccaucuucugccugccggguacugcgaugggccccaacgccuccucuuccuguccccagcacccugcuucccucuccggcaccuggacugucuaccccaauggccgguuugguaaucagaugggacaguaugccacgcugcuggcucuggcccagcucaacggccgccgggccuuuauccugccugccaugcaugccgcccuggccccgguauuccgcaucacccugcccgugcuggccccagaaguggacagccgcacgccguggcgggagcugcagcuucacgacuggaugucggaggaguacgcggacuugagagauccuuuccugaagcucucuggcuuccccugcucuuggacuuucuuccaccaucuccgggaacagauccgcagagaguucacccugcacgaccaccuucgggaagaggcgcagagugugcugggucagcuccgccugggccgcacaggggaccgcccgcgcaccuuugucggcguccacgugcgccguggggacuaucugcagguuaugccucagcgcuggaaggguguggugggcgacagcgccuaccuccggcaggccauggacugguuccgggcacggcacgaagcccccguuuucguggucaccagcaacggcauggagugguguaaagaaaacaucgacaccucccagggcgaugugacguuugcuggcgauggacaggaggcuacaccguggaaagacuuugcccugcucacacagugcaaccacaccauuaugaccauuggcaccuucggcuucugggcugccuaccuggcuggcggagacacugucuaccuggccaacuucacccugccagacucugaguuccugaagaucuuuaagccggaggcggccuuccugcccgagugggugggcauuaaugcagacuugucuccacucuggacauuggcuaagccuuga

SEQ ID NO: 1709 - RNA, 1098 nt, Artificial Sequence
  derived and/or modified sequence opt1 from FUT1__Homo_sapiens__AAA52639
auguggcugcgcagccaccggcagcucugccuggccuuccugcucgugugcguccuguccgugaucuucuuccugcacauccaccaggacagcuucccccacggccucgggcuguccauccugugcccggaccgccggcucgugaccccgcccgucgccaucuucugccugcccggcaccgcgauggggcccaacgccagcuccagcugcccccagcaccccgccucccugagcggcacguggaccguguaccccaacgggcgcuucggcaaccagaugggccaguacgccacccuccuggcccuggcgcagcucaacgggcggcgcgccuucauccugccggccaugcacgccgcgcuggcccccguguuccggaucacccuccccguccuggcccccgagguggacucccgcacgccguggcgggagcugcagcuccacgacuggaugagcgaggaguacgccgaccugcgcgaccccuuccugaagcucuccggcuuccccugcagcuggaccuucuuccaccaccuccgggagcagauccgccgggaguucacccugcacgaccaccuccgcgaggaggcccaguccgugcuggggcagcugcggcugggccgcaccggggaccggccccgcacguucgucggcgugcacgugcggcgcggcgacuaccugcaggucaugccgcagcgguggaaggggguggugggcgacagcgcguaccugcgccaggccauggacugguuccgcgcccggcacgaggcccccgucuucguggugaccuccaacgggauggaguggugcaaggagaacaucgacaccagccagggcgacgucaccuucgccggcgacgggcaggaggcgacgcccuggaaggacuucgcccuccugacccagugcaaccacaccaucaugaccaucggcacguucggguucugggccgccuaccuggccggcggggacaccguguaccucgcgaacuucacccugcccgacuccgaguuccugaagaucuucaagccggaggccgccuuccuccccgagugggugggcaucaacgccgaccugagcccccuguggacccucgccaagcccuga

SEQ ID NO: 1710 - RNA, 1098 nt, Artificial Sequence
  derived and/or modified sequence opt2 from FUT1__Homo_sapiens__AAA52639
auguggcuccgcucccaccgccagcucugccucgccuuccuccucgucugcguccucuccgucaucuucuuccuccacauccaccaggacuccuucccccacggccucggccucuccauccucugccccgaccgccgccucgucaccccccccgucgccaucuucugccuccccggcaccgccaugggccccaacgccuccuccuccugcccccagcaccccgccucccucuccggcaccuggaccgucuaccccaacggccgcuucggcaaccagaugggccaguacgccacccuccucgcccucgcccagcucaacggccgccgcgccuucauccuccccgccaugcacgccgcccucgcccccgucuuccgcaucacccuccccguccucgcccccgaggucgacucccgcacccccuggcgcgagcuccagcuccacgacuggauguccgaggaguacgccgaccuccgcgaccccuuccucaagcucuccggcuuccccugcuccuggaccuucuuccaccaccuccgcgagcagauccgccgcgaguucacccuccacgaccaccuccgcgaggaggcccaguccguccucggccagcuccgccucggccgcaccggcgaccgcccccgcaccuucgucggcguccacguccgccgcggcgacuaccuccaggucaugccccagcgcuggaagggcgucgucggcgacuccgccuaccuccgccaggccauggacugguuccgcgcccgccacgaggcccccgucuucgucgucaccuccaacggcauggaguggugcaaggagaacaucgacaccucccagggcgacgucaccuucgccggcgacggccaggaggccacccccuggaaggacuucgcccuccucacccagugcaaccacaccaucaugaccaucggcaccuucggcuucugggccgccuaccucgccggcggcgacaccgucuaccucgccaacuucacccuccccgacuccgaguuccucaagaucuucaagcccgaggccgccuuccuccccgagugggucggcaucaacgccgaccucuccccccucuggacccucgccaagcccuga

SEQ ID NO: 1711 - RNA, 1098 nt, Artificial Sequence
  derived and/or modified sequence opt3 from FUT1__Homo_sapiens__AAA52639
auguggcugagaagccacaggcagcucugccuugccuuccuguuggugugugucuuauccguuaucuuuuuccugcauauucaccaagacucuuuuccccauggccuagggcucucaauacugugcccugaucggcgccuugugaccccaccgguagcuaucuucugucugcccggaacagcaauggguccuaacgccaguagcuccugcccacagcaccccgcgucuuugucgggcacuuggacgguguacccuaaugggcgauuuggaaaccagaugggccaguaugcuacccuccuggcccuggcacaacucaauggucguagagccuucauuuuaccagcuaugcaugcagcccuggcucccgucuuuaggaucacacuuccuguguuggccccagagguugacucacggacuccguggcgcgaacugcagcuacacgauuggaugagcgaggaauacgcggaccucagagaucccuuccugaaacuuaguggguuuccuuguuccuggaccuucuuucaccaucugagggagcagauucggcgcgaguucacauugcacgaccaucuccgagaagaggcacagucugugcugggacaauuaagacugggcaggaccggcgaucggccacguacuuuugucggggugcacguacgcagaggagacuaucuccagguuaugccccagagguggaaggguguggucggcgauagcgccuaccuucggcaggcuauggacugguuccgagcccgccacgaagcaccuguguucguggucacauccaacgggauggaguggugcaaggaaaauaucgauaccucacaaggagacguuacguuugcuggcgauggucaggaggccacuccauggaaagacuucgcgcuguugacccaguguaaccauacaauaaugacuaucgggaccuuuggauucugggccgcauaucuagcuggcggcgacacaguguaccuggccaauuuuacccuccccgauagugaguuccugaagauuuuuaaaccggaagcugccuuccuuccugaguggguagggaucaacgcagaccugagccccuuguggacgcucgccaagccauga

SEQ ID NO: 1712 - RNA, 1098 nt, Artificial Sequence
  derived and/or modified sequence opt4 from FUT1__Homo_sapiens__AAA52639
auguggcugagaagccacagacagcugugccuggccuuccugcuggugugcgugcugagcgugaucuucuuccugcacauccaccaggacagcuucccccacggccugggccugagcauccugugccccgacagaagacuggugaccccccccguggccaucuucugccugcccggcaccgccaugggccccaacgccagcagcagcugcccccagcaccccgccagccugagcggcaccuggaccguguaccccaacggcagauucggcaaccagaugggccaguacgccacccugcuggcccuggcccagcugaacggcagaagagccuucauccugcccgccaugcacgccgcccuggcccccguguucagaaucacccugcccgugcuggcccccgagguggacagcagaacccccuggagagagcugcagcugcacgacuggaugagcgaggaguacgccgaccugagagaccccuuccugaagcugagcggcuuccccugcagcuggaccuucuuccaccaccugagagagcagaucagaagagaguucacccugcacgaccaccugagagaggaggcccagagcgugcugggccagcugagacugggcagaaccggcgacagacccagaaccuucgugggcgugcacgugagaagaggcgacuaccugcaggugaugccccagagauggaagggcguggugggcgacagcgccuaccugagacaggccauggacugguucagagccagacacgaggcccccguguucguggugaccagcaacggcauggaguggugcaaggagaacaucgacaccagccagggcgacgugaccuucgccggcgacggccaggaggccacccccuggaaggacuucgcccugcugacccagugcaaccacaccaucaugaccaucggcaccuucggcuucugggccgccuaccuggccggcggcgacaccguguaccuggccaacuucacccugcccgacagcgaguuccugaagaucuucaagcccgaggccgccuuccugcccgagugggugggcaucaacgccgaccugagcccccuguggacccuggccaagcccuga

SEQ ID NO: 1713 - RNA, 1098 nt, Artificial Sequence
  derived and/or modified sequence opt5 from FUT1__Homo_sapiens__AAA52639
auguggcugagaagccaccggcagcucugccuggccuuccuucugguguguguccucuccguuaucuuuuuccugcauauucaccaagacucuuuuccccauggccuugggcugagcauccucugcccugaucgcagacuggugaccccgcccguggcuauuuucugucugccuggaacagccaugggccccaacgcguccucuagcugcccucagcaccccgcuucccucucugggacguggaccgucuacccuaauggacgguuuggcaaccagauggggcaguaugccacacugcuugcccuggcucaacucaauggacgcagagccuucauccugccggcuaugcaugccgcgcuugcccccguguuucggauuacccugccuguucucgcucccgagguggacagccgcacaccuuggagagaacugcagcugcacgauuggauguccgaggaauacgccgaccuccgggaucccuuccugaaacuuagcggcuuuccguguucuuggaccuucuuucaccaucugcgcgagcagaucagacgggaguucacacuccacgaccaucugcgcgaagaggcucaguccguccuuggccaacugagacucgggcggaccggagaucgcccuagaacguuugugggcguucacgugcggagaggggacuaucugcaggucaugccccagcgcuggaagggaguggugggcgauagcgccuaccugcggcaggcgauggacugguucagagcccgccacgaagcuccugucuucguugugaccucuaacgggauggaguggugcaaggaaaauaucgauacaucccaaggagacgugaccuuugccggcgauggccaggaggcuacacccuggaaagacuucgcccuccugacccaguguaaccauacgauuaugacaaucgggaccuuuggauucugggccgcuuaucuugcgggcggggacacagucuaccuggccaauuuuacccuccccgauagcgaguuccugaagauuuuuaaaccugaagcugccuuccuuccggagugggugggaaucaacgccgaccugucuccccucuggacccuggcuaagccuuga

SEQ ID NO: 1714 - protein, 459 aa, Artificial Sequence
  G250__Homo_sapiens__Q16790
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 1715 - RNA, 1380 nt, Artificial Sequence
  G250__Homo_sapiens__EAW58359
auggcuccccugugccccagccccuggcucccucuguugaucccggccccugcuccaggccucacugugcaacugcugcugucacugcugcuucuggugccuguccauccccagagguugccccggaugcaggaggauucccccuugggaggaggcucuucuggggaagaugacccacugggcgaggaggaucugcccagugaagaggauucacccagagaggaggauccacccggagaggaggaucuaccuggagaggaggaucuaccuggagaggaggaucuaccugaaguuaagccuaaaucagaagaagagggcucccugaaguuagaggaucuaccuacuguugaggcuccuggagauccucaagaaccccagaauaaugcccacagggacaaagaaggggaugaccagagucauuggcgcuauggaggcgacccgcccuggccccggguguccccagccugcgcgggccgcuuccaguccccgguggauauccgcccccagcucgccgccuucugcccggcccugcgcccccuggaacuccugggcuuccagcucccgccgcucccagaacugcgccugcgcaacaauggccacagugugcaacugacccugccuccugggcuagagauggcucugggucccgggcgggaguaccgggcucugcagcugcaucugcacuggggggcugcaggucguccgggcucggagcacacuguggaaggccaccguuucccugccgagauccacgugguucaccucagcaccgccuuugccagaguugacgaggccuuggggcgcccgggaggccuggccguguuggccgccuuucuggaggagggcccggaagaaaacagugccuaugagcaguugcugucucgcuuggaagaaaucgcugaggaaggcucagagacucaggucccaggacuggacauaucugcacuccugcccucugacuucagccgcuacuuccaauaugaggggucucugacuacaccgcccugugcccagggugucaucuggacuguguuuaaccagacagugaugcugagugcuaagcagcuccacacccucucugacacccuguggggaccuggugacucucggcuacagcugaacuuccgagcgacgcagccuuugaaugggcgagugauugaggccuccuucccugcuggaguggacagcaguccucgggcugcugagccaguccagcugaauuccugccuggcugcuggugacauccuagcccugguuuuuggccuccuuuuugcugucaccagcgucgcguuccuugugcagaugagaaggcagcacagaaggggaaccaaagggggugugagcuaccgcccagcagagguagccgagacuggagccuag

SEQ ID NO: 1716 - RNA, 1380 nt, Artificial Sequence
  derived and/or modified sequence opt1 from G250__Homo_sapiens__EAW58359
auggcgccccugugcccgagccccuggcucccccugcugauccccgccccggcccccggccucaccgugcagcugcugcucucccugcugcuccugguccccgugcacccccagcgccugccgcggaugcaggaggacagcccccucgggggcggguccagcggcgaggacgacccccugggggaggaggaccugcccuccgaggaggacagcccgcgcgaggaggacccgcccggcgaggaggaccuccccggcgaggaggaccugcccggggaggaggaccugcccgaggugaagcccaaguccgaggaggagggcagccucaagcuggaggaccugcccaccgucgaggccccgggggacccccaggagccccagaacaacgcccaccgggacaaggagggcgacgaccagucccacuggcgcuacgggggcgacccgcccuggccccgggugagccccgccugcgccggccgcuuccagucccccguggacauccggccgcagcucgcggccuucugccccgcccugcgcccccuggagcuccugggguuccagcugccgccccuccccgagcugcggcugcgcaacaacggccacagcguccagcucacgcugcccccggggcuggagauggcccucggccccggccgggaguaccgcgcgcugcagcugcaccuccacuggggcgccgccgggcggcccggguccgagcacaccguggagggccaccgcuuccccgccgagauccacgugguccaccugagcaccgccuucgcgcggguggacgaggcccuggggcgcccgggcggccucgccgugcuggccgccuuccuggaggaggggcccgaggagaacuccgcguacgagcagcuccugagccggcuggaggagaucgccgaggagggcuccgagacccagguccccgggcucgacaucagcgcccugcugcccuccgacuucagccgcuacuuccaguacgagggcagccucacgaccccgcccugcgcccagggggugaucuggaccguguucaaccagaccgucaugcuguccgccaagcagcugcacacgcugagcgacacccucuggggccccggcgacucccggcugcagcugaacuuccgcgcgacccagccccucaacgggcgggugaucgaggccagcuucccggccggcguggacuccagcccccgcgccgccgagcccguccagcugaacuccugccuggcggccggggacauccucgcccugguguucggccuccuguucgccgugaccagcgucgcguuccuggugcagaugcgccggcagcaccgccgggggacgaagggcggcguguccuaccgccccgccgaggucgccgagaccggggccuga

SEQ ID NO: 1717 - RNA, 1380 nt, Artificial Sequence
  derived and/or modified sequence opt2 from G250__Homo_sapiens__EAW58359
auggccccccucugccccucccccuggcucccccuccucauccccgcccccgcccccggccucaccguccagcuccuccucucccuccuccuccucguccccguccacccccagcgccucccccgcaugcaggaggacuccccccucggcggcggcuccuccggcgaggacgacccccucggcgaggaggaccuccccuccgaggaggacuccccccgcgaggaggacccccccggcgaggaggaccuccccggcgaggaggaccuccccggcgaggaggaccuccccgaggucaagcccaaguccgaggaggagggcucccucaagcucgaggaccuccccaccgucgaggcccccggcgacccccaggagccccagaacaacgcccaccgcgacaaggagggcgacgaccagucccacuggcgcuacggcggcgacccccccuggccccgcgucucccccgccugcgccggccgcuuccagucccccgucgacauccgcccccagcucgccgccuucugccccgcccuccgcccccucgagcuccucggcuuccagcuccccccccuccccgagcuccgccuccgcaacaacggccacuccguccagcucacccucccccccggccucgagauggcccucggccccggccgcgaguaccgcgcccuccagcuccaccuccacuggggcgccgccggccgccccggcuccgagcacaccgucgagggccaccgcuuccccgccgagauccacgucguccaccucuccaccgccuucgcccgcgucgacgaggcccucggccgccccggcggccucgccguccucgccgccuuccucgaggagggccccgaggagaacuccgccuacgagcagcuccucucccgccucgaggagaucgccgaggagggcuccgagacccagguccccggccucgacaucuccgcccuccuccccuccgacuucucccgcuacuuccaguacgagggcucccucaccaccccccccugcgcccagggcgucaucuggaccgucuucaaccagaccgucaugcucuccgccaagcagcuccacacccucuccgacacccucuggggccccggcgacucccgccuccagcucaacuuccgcgccacccagccccucaacggccgcgucaucgaggccuccuuccccgccggcgucgacuccuccccccgcgccgccgagcccguccagcucaacuccugccucgccgccggcgacauccucgcccucgucuucggccuccucuucgccgucaccuccgucgccuuccucguccagaugcgccgccagcaccgccgcggcaccaagggcggcgucuccuaccgccccgccgaggucgccgagaccggcgccuga

SEQ ID NO: 1718 - RNA, 1380 nt, Artificial Sequence
  derived and/or modified sequence opt3 from G250__Homo_sapiens__EAW58359
auggcuccccugugcccuagcccauggcucccgcuucugauccccgcuccugcaccaggcuugaccgugcaguuacugcuaucccuccugcuucugguccccguucacccucaaagauugccaaggaugcaggaggacucuccccucgggggagguucaaguggcgaagaugacccucugggggaggaagaucugccaagcgaggaagacuccccgcgggaggaggaucccccuggagaagaggaccucccaggcgaagaggauuuacccggugaggaagaccugccugaggugaagccaaaaucugaagaggaagggucgcuuaaguuggaggaucugcccacaguagaggccccgggagacccucaggaaccccagaacaaugcgcaucgcgauaaagagggcgacgaucaaucacacuggcgauacggcggggacccaccuuggccccgugugagcccagcuugugccggaagauuccagagucccgucgacauuaggccucagcuagcagccuuuugcccagcucuccggccgcuggaacuucuggguuuccaguugcccccucucccagagcugcgcuuaagaaacaauggccauuccgugcaacugacuuugcccccugggcuugaaauggcacugggaccaggcagggaguaucgggccuugcagcuacaucugcacuggggugcugccgggcgccccggaucugagcacacgguugaaggccaccgauuuccggcggagauacaugugguccaccucagcaccgcauucgccagaguggaugaagcucugggcaggccugggggacuugccguacuggcagcuuuucucgaggaagguccagaggagaacuccgccuacgaacagcuccugucacgguuagaggaaaucgcggaggagggcagugaaacacagguucccgggcuggacauuagcgcccuacucccuucugauuucucccguuauuuucaauacgagggaucacugacuacacccccaugugcacagggcgugaucuggaccgucuucaaucagaccgugaugcuuagcgcuaagcaauugcauacucugagugacacacucugggguccuggggauucucgccugcagcuuaacuuuagagccacccagccccugaauggcagggugauugaagccuccuucccagccggagucgacagcucgccgcgggcagccgagccuguucaguugaacucuugccucgcugcgggcgauauccuggcauuaguguuugggcugcuauucgccguaacguccguggcuuuucucguccaaaugcgacgccagcacagaaggggaacuaaagguggcgugucauaucggcccgccgaaguugcagagaccggggccuga

SEQ ID NO: 1719 - RNA, 1380 nt, Artificial Sequence
  derived and/or modified sequence opt4 from G250__Homo_sapiens__EAW58359
auggccccccugugccccagccccuggcugccccugcugauccccgcccccgcccccggccugaccgugcagcugcugcugagccugcugcugcuggugcccgugcacccccagagacugcccagaaugcaggaggacagcccccugggcggcggcagcagcggcgaggacgacccccugggcgaggaggaccugcccagcgaggaggacagccccagagaggaggacccccccggcgaggaggaccugcccggcgaggaggaccugcccggcgaggaggaccugcccgaggugaagcccaagagcgaggaggagggcagccugaagcuggaggaccugcccaccguggaggcccccggcgacccccaggagccccagaacaacgcccacagagacaaggagggcgacgaccagagccacuggagauacggcggcgacccccccuggcccagagugagccccgccugcgccggcagauuccagagccccguggacaucagaccccagcuggccgccuucugccccgcccugagaccccuggagcugcugggcuuccagcugcccccccugcccgagcugagacugagaaacaacggccacagcgugcagcugacccugccccccggccuggagauggcccugggccccggcagagaguacagagcccugcagcugcaccugcacuggggcgccgccggcagacccggcagcgagcacaccguggagggccacagauuccccgccgagauccacguggugcaccugagcaccgccuucgccagaguggacgaggcccugggcagacccggcggccuggccgugcuggccgccuuccuggaggagggccccgaggagaacagcgccuacgagcagcugcugagcagacuggaggagaucgccgaggagggcagcgagacccaggugcccggccuggacaucagcgcccugcugcccagcgacuucagcagauacuuccaguacgagggcagccugaccaccccccccugcgcccagggcgugaucuggaccguguucaaccagaccgugaugcugagcgccaagcagcugcacacccugagcgacacccuguggggccccggcgacagcagacugcagcugaacuucagagccacccagccccugaacggcagagugaucgaggccagcuuccccgccggcguggacagcagccccagagccgccgagcccgugcagcugaacagcugccuggccgccggcgacauccuggcccugguguucggccugcuguucgccgugaccagcguggccuuccuggugcagaugagaagacagcacagaagaggcaccaagggcggcgugagcuacagacccgccgagguggccgagaccggcgccuga

SEQ ID NO: 1720 - RNA, 1380 nt, Artificial Sequence
  derived and/or modified sequence opt5 from G250__Homo_sapiens__EAW58359
auggcuccccugugcccuagcccguggcucccccugcuuaucccugcccccgccccuggccugaccgugcagcuccugcuuucccugcuccugcugguccccguucacccucaaagacucccgcggaugcaggaggacucuccccucgggggaggcagcuccggggaagaugacccucuuggagaggaagaucugcccucugaggaagacagcccucgcgaggaggaucccccgggcgaagaggaccucccuggggaagaggaucugcccggagaggaagaccuuccugaggugaagcccaaauccgaagaggaaggcucucugaagcucgaggaucugcccacaguggaggcgccuggcgacccgcaggaaccccagaacaaugcucauagagauaaagagggggacgaucaaagccacuggcgguacggaggcgacccucccuggccucgcgucucccccgccugugccgggagauuccagagcccgguggacauucggccucagcuggcugccuuuugccccgcucuccgcccucuggaacuucugggauuccagcugcccccucugcccgagcuuagacugcggaacaauggccauucuguucaacucacgcugccgccugggcuggaaauggcccucggacccggccgcgaguauagagcgcugcagcuucaucugcacuggggcgccgcugggcggcccggauccgagcacaccguggaaggccaccgcuuuccugccgagauccaugucgugcaccucagcacagcuuucgccagaguugaugaagcgcuggggcggccgggaggccuugccgugcuggcugccuuucucgaggaagggcccgaggagaacucugcuuacgaacagcugcugucccgccucgaggaaauugccgaggagggaagcgaaacccaggucccuggccuggacaucucugcccuucugcccuccgauuucagcagauauuuucaauacgagggcucccucacaaccccucccugugcucagggggugauuuggacaguguucaaucagaccgucaugcugucugcgaagcaacugcauacgcuuagcgacacccucuggggaccuggcgauucccggcugcagcugaacuuuagagccacacagccccucaaugggcgcguuaucgaagcuagcuucccggccggaguggacucuuccccucgggccgcugagcccgugcagcugaacagcugccuugccgcgggcgauauccuggcucucgucuuugggcugcuguucgccgugaccucuguugccuuucuugugcaaaugagacgccagcaccggagaggcacaaaaggaggcgucagcuaucgcccugcugaaguggccgagaccggggcuuga

SEQ ID NO: 1721 - protein, 138 aa, Artificial Sequence
  GAGE-1__Homo_sapiens__AAA82744
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 1722 - RNA, 417 nt, Artificial Sequence
  GAGE-1__Homo_sapiens__U19142.1
augaguuggcgaggaagaucgaccuaucggccuagaccaagacgcuacguagagccuccugaaaugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcugauagccaggaacagggucacccacagacugggugugagugugaagaugguccugaugggcaggagauggacccgccaaauccagaggaggugaaaacgccugaagaagagaugaggucucacuauguugcccagacugggauucucuggcuuuuaaugaacaauugcuucuuaaaucuuuccccacggaaaccuuga

SEQ ID NO: 1723 - RNA, 417 nt, Artificial Sequence
  derived and/or modified sequence opt1 from GAGE-1__Homo_sapiens__U19142.1
augagcuggcgcggccgguccaccuaccgcccccggccgcgccgguacguggagccgcccgagaugaucgggcccaugcgccccgagcaguucagcgacgaggucgagcccgccacccccgaggagggcgagcccgccacgcagcggcaggacccggcggccgcccaggagggggaggacgagggcgccuccgccgggcagggccccaagcccgaggcggacagccaggagcagggccacccccagaccgggugcgagugcgaggacggcccggacgggcaggagauggacccgcccaaccccgaggaggugaagacccccgaggaggagaugcgcucccacuacguggcccagaccggcauccuguggcuccugaugaacaacugcuuccugaaccucagcccccggaagcccuga

SEQ ID NO: 1724 - RNA, 417 nt, Artificial Sequence
  derived and/or modified sequence opt2 from GAGE-1__Homo_sapiens__U19142.1
auguccuggcgcggccgcuccaccuaccgcccccgcccccgccgcuacgucgagccccccgagaugaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagggccacccccagaccggcugcgagugcgaggacggccccgacggccaggagauggacccccccaaccccgaggaggucaagacccccgaggaggagaugcgcucccacuacgucgcccagaccggcauccucuggcuccucaugaacaacugcuuccucaaccucuccccccgcaagcccuga

SEQ ID NO: 1725 - RNA, 417 nt, Artificial Sequence
  derived and/or modified sequence opt3 from GAGE-1__Homo_sapiens__U19142.1
augagcuggagaggcagguccaccuaccggccccgcccucgacguuauguggagccaccggaaaugaucgggcccaugagaccugagcaguucucugacgaagucgagccagccacacccgaagagggagagccugcuacucaaaggcaggacccagcagccgcgcaggaaggugaggacgaaggcgcuucagccgggcagggacccaagccugaggcagauagucaagagcagggccacccacagacggguugcgaaugugaggacgggccggauggacaggaaauggaucccccuaacccagaggaaguuaaaacccccgaggaggaaaugcggagccauuacguggcccaaacaggcauucuguggcuccuuaugaauaacugcuuucugaauuuguccccucgcaagccauga

SEQ ID NO: 1726 - RNA, 417 nt, Artificial Sequence
  derived and/or modified sequence opt4 from GAGE-1__Homo_sapiens__U19142.1
augagcuggagaggcagaagcaccuacagacccagacccagaagauacguggagccccccgagaugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcagggccacccccagaccggcugcgagugcgaggacggccccgacggccaggagauggacccccccaaccccgaggaggugaagacccccgaggaggagaugagaagccacuacguggcccagaccggcauccuguggcugcugaugaacaacugcuuccugaaccugagccccagaaagcccuga

SEQ ID NO: 1727 - RNA, 417 nt, Artificial Sequence
  derived and/or modified sequence opt5 from GAGE-1__Homo_sapiens__U19142.1
augagcuggagaggccgguccaccuaccgccccagaccucggcgcuauguggagccgcccgaaaugaucgggccuaugagacccgagcaguucucugacgaagucgagccugccacacccgaagagggagagccugcuacgcaacggcaggacccggccgcggcucaggaaggcgaggacgaaggggccagcgccggacagggccccaagccugaggcugauucccaagagcaggggcacccccagaccggaugcgaaugugaggacggcccugauggccaggaaauggaucccccgaacccugaggaaguuaaaacacccgaggaggaaaugcgcucucauuacguggcccaaaccgggauucuguggcuccugaugaauaacugcuuucuuaaucugagcccuagaaagcccuga

SEQ ID NO: 1728 - protein, 116 aa, Artificial Sequence
  GAGE-2__Homo_sapiens__Q6NT46
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEGEKQSQC

SEQ ID NO: 1729 - RNA, 351 nt, Artificial Sequence
  GAGE-2__Homo_sapiens__AAH69397
augaguuggcgaggaagaucgaccuaucggccuagaccaagacgcuacguagagccuccugaaaugauugggccuaugcggcccgagcaguucagugaugaaguggaaccagcaacaccugaagaaggggaaccagcaacucaacgucaggauccugcagcugcucaggagggacaggaugagggagcaucugcaggucaagggccgaagccugaagcucauagccaggaacagggucacccacagacugggugugagugugaagaugguccugaugggcaggagauggacccgccaaauccagaggaggugaaaacgccugaagaaggugaaaagcaaucacaguguuaa

SEQ ID NO: 1730 - RNA, 351 nt, Artificial Sequence
  derived and/or modified sequence opt1 from GAGE-2__Homo_sapiens__AAH69397
augagcuggcgcggccgguccaccuaccgcccccggccgcgccgguacguggagccgcccgagaugaucgggcccaugcgccccgagcaguucagcgacgaggucgagcccgccacccccgaggagggcgagcccgccacgcagcggcaggacccggcggccgcccaggaggggcaggacgagggcgccuccgccgggcagggccccaagcccgaggcgcacagccaggagcagggccacccccagaccgggugcgagugcgaggacggcccggacgggcaggagauggacccgcccaaccccgaggaggugaagacccccgaggagggcgagaagcagucccagugcuga

SEQ ID NO: 1731 - RNA, 351 nt, Artificial Sequence
  derived and/or modified sequence opt2 from GAGE-2__Homo_sapiens__AAH69397
auguccuggcgcggccgcuccaccuaccgcccccgcccccgccgcuacgucgagccccccgagaugaucggccccaugcgccccgagcaguucuccgacgaggucgagcccgccacccccgaggagggcgagcccgccacccagcgccaggaccccgccgccgcccaggagggccaggacgagggcgccuccgccggccagggccccaagcccgaggcccacucccaggagcagggccacccccagaccggcugcgagugcgaggacggccccgacggccaggagauggacccccccaaccccgaggaggucaagacccccgaggagggcgagaagcagucccagugcuga

SEQ ID NO: 1732 - RNA, 351 nt, Artificial Sequence
  derived and/or modified sequence opt3 from GAGE-2__Homo_sapiens__AAH69397
augagcuggagaggcagguccaccuaccggccccgcccucgacguuauguggagccaccggaaaugaucgggcccaugagaccugagcaguucucugacgaagucgagccagccacacccgaagagggagagccugcuacucaaaggcaggauccagcagccgcgcaggaaggucaggacgagggcgcuucagccgggcaaggacccaagccugaagcacacagucaggagcagggccauccacagacggguugcgagugugaagaugggccggacggacaagagauggaucccccuaacccagaagagguuaaaacccccgaagagggcgagaagcagagccagugcuga

SEQ ID NO: 1733 - RNA, 351 nt, Artificial Sequence
  derived and/or modified sequence opt4 from GAGE-2__Homo_sapiens__AAH69397
augagcuggagaggcagaagcaccuacagacccagacccagaagauacguggagccccccgagaugaucggccccaugagacccgagcaguucagcgacgagguggagcccgccacccccgaggagggcgagcccgccacccagagacaggaccccgccgccgcccaggagggccaggacgagggcgccagcgccggccagggccccaagcccgaggcccacagccaggagcagggccacccccagaccggcugcgagugcgaggacggccccgacggccaggagauggacccccccaaccccgaggaggugaagacccccgaggagggcgagaagcagagccagugcuga

SEQ ID NO: 1734 - RNA, 351 nt, Artificial Sequence
  derived and/or modified sequence opt5 from GAGE-2__Homo_sapiens__AAH69397
augagcuggagaggccgguccaccuaccgccccagaccucggcgcuauguggagccgcccgaaaugaucgggccuaugagacccgagcaguucucugacgaagucgagccugccacacccgaagagggagagccugcuacgcaacggcaggauccggccgcggcucaggaaggccaggacgagggggccagcgccggacaaggccccaagccugaagcucacucccaggagcaggggcauccccagaccggaugcgagugugaagauggcccugacggccaagagauggaucccccgaacccugaagagguuaaaacacccgaagagggggagaagcagucucagugcuga

SEQ ID NO: 1735 - protein, 118 aa, Artificial Sequence
  GAGE-3__Homo_sapiens__Q13067
MNLSRGKSTYYWPRPRRYVQPPEVIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 1736 - RNA, 357 nt, Artificial Sequence
  GAGE-3__Homo_sapiens__AAA82746
augaaucucaguagaggaaaaucgaccuauuauuggccuagaccaaggcgcuauguacagccuccugaagugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcugauagccaggaacagggucacccacagacugggugugagugugaagaugguccugaugggcaggagauggacccgccaaauccagaggaggugaaaacgccugaagaaggugaaaagcaaucacaguguuaa

SEQ ID NO: 1737 - RNA, 357 nt, Artificial Sequence
  derived and/or modified sequence opt1 from GAGE-3__Homo_sapiens__AAA82746
augaaccugagccgcggcaaguccaccuacuacuggccccggccgcgccgguacgugcagccgcccgaggucaucgggcccaugcgccccgagcaguucagcgacgagguggagcccgccacccccgaggagggcgagcccgccacgcagcggcaggacccggcggccgcccaggagggggaggacgagggcgccuccgccgggcagggccccaagcccgaggcggacagccaggagcagggccacccccagaccgggugcgagugcgaggacggcccggacgggcaggagauggacccgcccaaccccgaggaggugaagacccccgaggagggcgagaagcagucccagugcuga

SEQ ID NO: 1738 - RNA, 357 nt, Artificial Sequence
  derived and/or modified sequence opt2 from GAGE-3__Homo_sapiens__AAA82746
augaaccucucccgcggcaaguccaccuacuacuggccccgcccccgccgcuacguccagccccccgaggucaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagggccacccccagaccggcugcgagugcgaggacggccccgacggccaggagauggacccccccaaccccgaggaggucaagacccccgaggagggcgagaagcagucccagugcuga

SEQ ID NO: 1739 - RNA, 357 nt, Artificial Sequence
  derived and/or modified sequence opt3 from GAGE-3__Homo_sapiens__AAA82746
augaaccugagcagaggcaaguccaccuacuauuggcccaggccucggcgcuacgugcagccaccggaggucaucgggcccaugcgaccugaacaauucucugacgagguugaaccagccacacccgaggaaggagagccugcuacucagcgucaggacccagcagccgcgcaggagggugaagacgagggcgcuucagccgggcaaggacccaaaccugaagcagauagucaggagcagggccacccacagacggguugcgagugugaagacgggccggauggacaagagauggaucccccuaauccagaagaggugaagacccccgaagagggcgagaaacagagccagugcuga

SEQ ID NO: 1740 - RNA, 357 nt, Artificial Sequence
  derived and/or modified sequence opt4 from GAGE-3__Homo_sapiens__AAA82746
augaaccugagcagaggcaagagcaccuacuacuggcccagacccagaagauacgugcagccccccgaggugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcagggccacccccagaccggcugcgagugcgaggacggccccgacggccaggagauggacccccccaaccccgaggaggugaagacccccgaggagggcgagaagcagagccagugcuga

SEQ ID NO: 1741 - RNA, 357 nt, Artificial Sequence
  derived and/or modified sequence opt5 from GAGE-3__Homo_sapiens__AAA82746
augaaccugagcagaggcaaguccaccuacuauuggccccggccucgcagauacgugcagccgcccgaggucaucgggccuaugcggcccgaacaauucucugacgagguugaaccugccacacccgaggaaggagagccugcuacgcagcgccaggacccggccgcggcucaggagggcgaagacgagggggccagcgccggacaaggccccaaaccugaagcugauucccaggagcaggggcacccccagaccggaugcgagugugaagacggcccugauggccaagagauggaucccccgaauccugaagaggugaagacacccgaagagggggagaaacagucucagugcuga

SEQ ID NO: 1742 - protein, 117 aa, Artificial Sequence
  GAGE-4__Homo_sapiens__Q13068
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEGQSQC

SEQ ID NO: 1743 - RNA, 354 nt, Artificial Sequence
  GAGE-4__Homo_sapiens__AAH69470
augaguuggcgaggaagaucgaccuauuauuggccuagaccaaggcgcuauguacagccuccugaaaugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcugauagccaggaacagggucacccacagacugggugugagugugaagaugguccugaugggcaggagauggacccgccaaauccagaggaggugaaaacgccugaagaaggugaagggcaaucacaguguuaa

SEQ ID NO: 1744 - RNA, 354 nt, Artificial Sequence
  derived and/or modified sequence opt1 from GAGE-4__Homo_sapiens__AAH69470
augagcuggcgcggccgguccaccuacuacuggccccgcccgcggcgcuacgugcagccgcccgagaugaucgggcccaugcggcccgagcaguucagcgacgaggucgagcccgccacccccgaggagggcgagcccgccacgcagcgccaggacccggcggccgcccaggagggggaggacgagggcgccuccgccgggcagggccccaagcccgaggcggacagccaggagcagggccacccccagaccgggugcgagugcgaggacggcccggacgggcaggagauggacccgcccaaccccgaggaggugaagacccccgaggagggcgaggggcagucccagugcuga

SEQ ID NO: 1745 - RNA, 354 nt, Artificial Sequence
  derived and/or modified sequence opt2 from GAGE-4__Homo_sapiens__AAH69470
auguccuggcgcggccgcuccaccuacuacuggccccgcccccgccgcuacguccagccccccgagaugaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagggccacccccagaccggcugcgagugcgaggacggccccgacggccaggagauggacccccccaaccccgaggaggucaagacccccgaggagggcgagggccagucccagugcuga

SEQ ID NO: 1746 - RNA, 354 nt, Artificial Sequence
  derived and/or modified sequence opt3 from GAGE-4__Homo_sapiens__AAH69470
augagcuggagaggcagguccaccuacuauuggccccggccucgccgauacgugcagccaccggagaugaucgggcccaugcguccugaacaauucucugacgaggucgaaccagccacacccgaggaaggagagccugcuacucagagacaggacccagcagccgcgcaggagggugaagacgagggcgcuucagccgggcaaggacccaagccugaagcagauagucaggagcagggccacccacagacggguugcgagugugaagacgggccggauggacaagagauggaucccccuaacccagaagagguuaaaacccccgaagagggcgagggccagagccagugcuga

SEQ ID NO: 1747 - RNA, 354 nt, Artificial Sequence
  derived and/or modified sequence opt4 from GAGE-4__Homo_sapiens__AAH69470
augagcuggagaggcagaagcaccuacuacuggcccagacccagaagauacgugcagccccccgagaugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcagggccacccccagaccggcugcgagugcgaggacggccccgacggccaggagauggacccccccaaccccgaggaggugaagacccccgaggagggcgagggccagagccagugcuga

SEQ ID NO: 1748 - RNA, 354 nt, Artificial Sequence
  derived and/or modified sequence opt5 from GAGE-4__Homo_sapiens__AAH69470
augagcuggagaggccgguccaccuacuauuggccccgcccuagacgguacgugcagccgcccgagaugaucgggccuaugcgccccgaacaauucucugacgaggucgaaccugccacacccgaggaaggagagccugcuacgcagagacaggacccggccgcggcucaggagggcgaagacgagggggccagcgccggacaaggccccaagccugaagcugauucccaggagcaggggcacccccagaccggaugcgagugugaagacggcccugauggccaagagauggaucccccgaacccugaagagguuaaaacacccgaagagggggagggacagucucagugcuga

SEQ ID NO: 1749 - protein, 117 aa, Artificial Sequence
  GAGE-5__Homo_sapiens__Q13069
MSWRGRSTYYWPRPRRYVQPPEVIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 1750 - RNA, 354 nt, Artificial Sequence
  GAGE-5__Homo_sapiens__AAA82748
augaguuggcgaggaagaucgaccuauuauuggccuagaccaaggcgcuauguacagccuccugaagugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcugauagccaggaacagggucacccacagacugggugugagugugaagaugguccugaugggcaggagauggacccgccaaauccagaggaggugaaaacgccugaagaaggugaaaagcaaucacaguguuaa

SEQ ID NO: 1751 - RNA, 354 nt, Artificial Sequence
  derived and/or modified sequence opt1 from GAGE-5__Homo_sapiens__AAA82748
augagcuggcgcggccgguccaccuacuacuggccccgcccgcggcgcuacgugcagccgcccgaggucaucgggcccaugcggcccgagcaguucagcgacgagguggagcccgccacccccgaggagggcgagcccgccacgcagcgccaggacccggcggccgcccaggagggggaggacgagggcgccuccgccgggcagggccccaagcccgaggcggacagccaggagcagggccacccccagaccgggugcgagugcgaggacggcccggacgggcaggagauggacccgcccaaccccgaggaggugaagacccccgaggagggcgagaagcagucccagugcuga

SEQ ID NO: 1752 - RNA, 354 nt, Artificial Sequence
  derived and/or modified sequence opt2 from GAGE-5__Homo_sapiens__AAA82748
auguccuggcgcggccgcuccaccuacuacuggccccgcccccgccgcuacguccagccccccgaggucaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagggccacccccagaccggcugcgagugcgaggacggccccgacggccaggagauggacccccccaaccccgaggaggucaagacccccgaggagggcgagaagcagucccagugcuga

SEQ ID NO: 1753 - RNA, 354 nt, Artificial Sequence
  derived and/or modified sequence opt3 from GAGE-5__Homo_sapiens__AAA82748
augagcuggagaggcagguccaccuacuauuggccccggccucgccgauacgugcagccaccggaggucaucgggcccaugcguccugaacaauucucugacgagguugaaccagccacacccgaggaaggagagccugcuacucagagacaggacccagcagccgcgcaggagggugaagacgagggcgcuucagccgggcaaggacccaagccugaagcagauagucaggagcagggccacccacagacggguugcgagugugaagacgggccggauggacaagagauggaucccccuaacccagaagaggugaaaacccccgaagagggcgagaagcagagccagugcuga

SEQ ID NO: 1754 - RNA, 354 nt, Artificial Sequence
  derived and/or modified sequence opt4 from GAGE-5__Homo_sapiens__AAA82748
augagcuggagaggcagaagcaccuacuacuggcccagacccagaagauacgugcagccccccgaggugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcagggccacccccagaccggcugcgagugcgaggacggccccgacggccaggagauggacccccccaaccccgaggaggugaagacccccgaggagggcgagaagcagagccagugcuga

SEQ ID NO: 1755 - RNA, 354 nt, Artificial Sequence
  derived and/or modified sequence opt5 from GAGE-5__Homo_sapiens__AAA82748
augagcuggagaggccgguccaccuacuauuggccccgcccuagacgguacgugcagccgcccgaggucaucgggccuaugcgccccgaacaauucucugacgagguugaaccugccacacccgaggaaggagagccugcuacgcagagacaggacccggccgcggcucaggagggcgaagacgagggggccagcgccggacaaggccccaagccugaagcugauucccaggagcaggggcacccccagaccggaugcgagugugaagacggcccugauggccaagagauggaucccccgaacccugaagaggugaaaacacccgaagagggggagaagcagucucagugcuga

SEQ ID NO: 1756 - protein, 117 aa, Artificial Sequence
  GAGE-6__Homo_sapiens__Q13070
MSWRGRSTYYWPRPRRYVQPPEVIGPMRPEQFSDEVEPATPEEGEPATQRQDPAAAQEGEDEGASAGQGPKPEADSQEQGHPQTGCECEDGPDGQEVDPPNPEEVKTPEEGEKQSQC

SEQ ID NO: 1757 - RNA, 354 nt, Artificial Sequence
  GAGE-6__Homo_sapiens__AAA82749
augaguuggcgaggaagaucgaccuauuauuggccuagaccaaggcgcuauguacagccuccugaagugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcugauagccaggaacagggucacccacagacugggugugagugugaagaugguccugaugggcaggagguggacccgccaaauccagaggaggugaaaacgccugaagaaggugaaaagcaaucacaguguuaa

SEQ ID NO: 1758 - RNA, 354 nt, Artificial Sequence
  derived and/or modified sequence opt1 from GAGE-6__Homo_sapiens__AAA82749
augagcuggcgcggccgguccaccuacuacuggccccgcccgcggcgcuacgugcagccgcccgaggucaucgggcccaugcggcccgagcaguucagcgacgagguggagcccgccacccccgaggagggcgagcccgccacgcagcgccaggacccggcggccgcccaggagggggaggacgagggcgccuccgccgggcagggccccaagcccgaggcggacagccaggagcagggccacccccagaccgggugcgagugcgaggacggcccggacgggcaggagguggacccgcccaaccccgaggaggucaagacccccgaggagggcgagaagcagucccagugcuga

SEQ ID NO: 1759 - RNA, 354 nt, Artificial Sequence
  derived and/or modified sequence opt2 from GAGE-6__Homo_sapiens__AAA82749
auguccuggcgcggccgcuccaccuacuacuggccccgcccccgccgcuacguccagccccccgaggucaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagggccacccccagaccggcugcgagugcgaggacggccccgacggccaggaggucgacccccccaaccccgaggaggucaagacccccgaggagggcgagaagcagucccagugcuga

SEQ ID NO: 1760 - RNA, 354 nt, Artificial Sequence
  derived and/or modified sequence opt3 from GAGE-6__Homo_sapiens__AAA82749
augagcuggagaggcagguccaccuacuauuggccccggccucgccgauacgugcagccaccggaggucaucgggcccaugcguccugaacaauucucugacgagguugaaccagccacacccgaggaaggagagccugcuacucagagacaggacccagcagccgcgcaggagggugaagacgagggcgcuucagccgggcaaggacccaagccugaagcagauagucaggagcagggccacccacagacggguugcgagugugaagacgggccggauggacaagagguggaucccccuaacccagaagagguaaaaacccccgaagagggcgagaagcagagccagugcuga

SEQ ID NO: 1761 - RNA, 354 nt, Artificial Sequence
  derived and/or modified sequence opt4 from GAGE-6__Homo_sapiens__AAA82749
augagcuggagaggcagaagcaccuacuacuggcccagacccagaagauacgugcagccccccgaggugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcagggccacccccagaccggcugcgagugcgaggacggccccgacggccaggagguggacccccccaaccccgaggaggugaagacccccgaggagggcgagaagcagagccagugcuga

SEQ ID NO: 1762 - RNA, 354 nt, Artificial Sequence
  derived and/or modified sequence opt5 from GAGE-6__Homo_sapiens__AAA82749
augagcuggagaggccgguccaccuacuauuggccccgcccuagacgguacgugcagccgcccgaggucaucgggccuaugcgccccgaacaauucucugacgagguugaaccugccacacccgaggaaggagagccugcuacgcagagacaggacccggccgcggcucaggagggcgaagacgagggggccagcgccggacaaggccccaagccugaagcugauucccaggagcaggggcacccccagaccggaugcgagugugaagacggcccugauggccaagagguggaucccccgaacccugaagaggugaaaacacccgaagagggggagaagcagucucagugcuga

SEQ ID NO: 1763 - protein, 117 aa, Artificial Sequence
  GAGE7b__Homo_sapiens__O76087
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 1764 - RNA, 354 nt, Artificial Sequence
  GAGE7b__Homo_sapiens__AAC25989
augaguuggcgaggaagaucgaccuauuauuggccuagaccaaggcgcuauguacagccuccugaaaugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcucauagccaggaacagggucacccacagacugggugugagugugaagaugguccugaugggcaggagauggacccgccaaauccagaggaggugaaaacgccugaagaaggugaaaagcaaucacaguguuaa

SEQ ID NO: 1765 - RNA, 354 nt, Artificial Sequence
  derived and/or modified sequence opt1 from GAGE7b__Homo_sapiens__AAC25989
augagcuggcgcggccgguccaccuacuacuggccccgcccgcggcgcuacgugcagccgcccgagaugaucgggcccaugcggcccgagcaguucagcgacgaggucgagcccgccacccccgaggagggcgagcccgccacgcagcgccaggacccggcggccgcccaggagggggaggacgagggcgccuccgccgggcagggccccaagcccgaggcgcacagccaggagcagggccacccccagaccgggugcgagugcgaggacggcccggacgggcaggagauggacccgcccaaccccgaggaggugaagacccccgaggagggcgagaagcagucccagugcuga

SEQ ID NO: 1766 - RNA, 354 nt, Artificial Sequence
  derived and/or modified sequence opt2 from GAGE7b__Homo_sapiens__AAC25989
auguccuggcgcggccgcuccaccuacuacuggccccgcccccgccgcuacguccagccccccgagaugaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggcccacucccaggagcagggccacccccagaccggcugcgagugcgaggacggccccgacggccaggagauggacccccccaaccccgaggaggucaagacccccgaggagggcgagaagcagucccagugcuga

SEQ ID NO: 1767 - RNA, 354 nt, Artificial Sequence
  derived and/or modified sequence opt3 from GAGE7b__Homo_sapiens__AAC25989
augagcuggagaggcagguccaccuacuauuggccccggccucgccgauacgugcagccaccggagaugaucgggcccaugcguccugaacaauucucugacgaggucgaaccagccacacccgaggaaggagagccugcuacucagagacaggauccagcagccgcgcaggagggugaagacgagggcgcuucagccgggcaaggacccaagccugaagcacacagucaggagcagggccauccacagacggguugcgagugugaagaugggccggacggacaagagauggaucccccuaacccagaagagguuaaaacccccgaagagggcgagaagcagagccagugcuga

SEQ ID NO: 1768 - RNA, 354 nt, Artificial Sequence
  derived and/or modified sequence opt4 from GAGE7b__Homo_sapiens__AAC25989
augagcuggagaggcagaagcaccuacuacuggcccagacccagaagauacgugcagccccccgagaugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggcccacagccaggagcagggccacccccagaccggcugcgagugcgaggacggccccgacggccaggagauggacccccccaaccccgaggaggugaagacccccgaggagggcgagaagcagagccagugcuga

SEQ ID NO: 1769 - RNA, 354 nt, Artificial Sequence
  derived and/or modified sequence opt5 from GAGE7b__Homo_sapiens__AAC25989
augagcuggagaggccgguccaccuacuauuggccccgcccuagacgguacgugcagccgcccgagaugaucgggccuaugcgccccgaacaauucucugacgaggucgaaccugccacacccgaggaaggagagccugcuacgcagagacaggauccggccgcggcucaggagggcgaagacgagggggccagcgccggacaaggccccaagccugaagcucacucccaggagcaggggcauccccagaccggaugcgagugugaagauggcccugacggccaagagauggaucccccgaacccugaagagguuaaaacacccgaagagggggagaagcagucucagugcuga

SEQ ID NO: 1770 - protein, 116 aa, Artificial Sequence
  GAGE-8_(GAGE-2D)__Homo_sapiens__Q9UEU5
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 1771 - RNA, 351 nt, Artificial Sequence
  GAGE-8_(GAGE-2D)__Homo_sapiens__AAC33676
augaguuggcgaggaagaucgaccuaucggccuagaccaagacgcuacguagagccuccugaaaugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcugauagccaggaacagggucacccacagacugggugugagugugaagaugguccugaugggcaggagauggacccgccaaauccagaggaggugaaaacgccugaagaaggugaaaagcaaucacaguguuaa

SEQ ID NO: 1772 - RNA, 351 nt, Artificial Sequence
  derived and/or modified sequence opt1 from GAGE-8_(GAGE-2D)__Homo_sapiens__AAC33676
augagcuggcgcggccgguccaccuaccgcccccggccgcgccgguacguggagccgcccgagaugaucgggcccaugcgccccgagcaguucagcgacgaggucgagcccgccacccccgaggagggcgagcccgccacgcagcggcaggacccggcggccgcccaggagggggaggacgagggcgccuccgccgggcagggccccaagcccgaggcggacagccaggagcagggccacccccagaccgggugcgagugcgaggacggcccggacgggcaggagauggacccgcccaaccccgaggaggugaagacccccgaggagggcgagaagcagucccagugcuga

SEQ ID NO: 1773 - RNA, 351 nt, Artificial Sequence
  derived and/or modified sequence opt2 from GAGE-8_(GAGE-2D)__Homo_sapiens__AAC33676
auguccuggcgcggccgcuccaccuaccgcccccgcccccgccgcuacgucgagccccccgagaugaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagggccacccccagaccggcugcgagugcgaggacggccccgacggccaggagauggacccccccaaccccgaggaggucaagacccccgaggagggcgagaagcagucccagugcuga

SEQ ID NO: 1774 - RNA, 351 nt, Artificial Sequence
  derived and/or modified sequence opt3 from GAGE-8_(GAGE-2D)__Homo_sapiens__AAC33676
augagcuggagaggcagguccaccuaccggccccgcccucgacguuauguggagccaccggaaaugaucgggcccaugagaccugagcaguucucugacgaagucgagccagccacacccgaagagggagagccugcuacucaaaggcaggacccagcagccgcgcaggaaggugaggacgaaggcgcuucagccgggcagggacccaagccugaggcagauagucaagagcagggccacccacagacggguugcgaaugugaggacgggccggauggacaggaaauggaucccccuaacccagaggaaguuaaaacccccgaggagggcgaaaagcaaagccagugcuga

SEQ ID NO: 1775 - RNA, 351 nt, Artificial Sequence
  derived and/or modified sequence opt4 from GAGE-8_(GAGE-2D)__Homo_sapiens__AAC33676
augagcuggagaggcagaagcaccuacagacccagacccagaagauacguggagccccccgagaugaucggccccaugagacccgagcaguucagcgacgagguggagcccgccacccccgaggagggcgagcccgccacccagagacaggaccccgccgccgcccaggagggcgaggacgagggcgccagcgccggccagggccccaagcccgaggccgacagccaggagcagggccacccccagaccggcugcgagugcgaggacggccccgacggccaggagauggacccccccaaccccgaggaggugaagacccccgaggagggcgagaagcagagccagugcuga

SEQ ID NO: 1776 - RNA, 351 nt, Artificial Sequence
  derived and/or modified sequence opt5 from GAGE-8_(GAGE-2D)__Homo_sapiens__AAC33676
augagcuggagaggccgguccaccuaccgccccagaccucggcgcuauguggagccgcccgaaaugaucgggccuaugagacccgagcaguucucugacgaagucgagccugccacacccgaagagggagagccugcuacgcaacggcaggacccggccgcggcucaggaaggcgaggacgaaggggccagcgccggacagggccccaagccugaggcugauucccaagagcaggggcacccccagaccggaugcgaaugugaggacggcccugauggccaggaaauggaucccccgaacccugaggaaguuaaaacacccgaggagggggaaaagcaaucucagugcuga

SEQ ID NO: 1777 - protein, 447 aa, Artificial Sequence
  GASR__Homo_sapiens__P32239
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 1778 - RNA, 1344 nt, Artificial Sequence
  GASR__Homo_sapiens__AAA35657
auggagcugcuaaagcugaaccggagcgugcagggaaccggacccgggccgggggcuucccugugccgcccgggggcgccucuccucaacagcagcagugugggcaaccucagcugcgagcccccucgcauucgcggagccgggacacgagaauuggagcuggccauuagaaucacucuuuacgcagugaucuuccugaugagcguuggaggaaauaugcucaucaucgugguccugggacugagccgccgccugaggacugucaccaaugccuuccuccucucacuggcagucagcgaccuccugcuggcuguggcuugcaugcccuucacccuccugcccaaucucaugggcacauucaucuuuggcaccgucaucugcaaggcgguuuccuaccucaugggggugucugugaguguguccacgcuaagccucguggccaucgcacuggagcgguacagcgccaucugccgaccacugcaggcacgaguguggcagacgcgcucccacgcggcucgcgugauuguagccacguggcugcuguccggacuacucauggugcccuaccccguguacacugucgugcaaccaguggggccucgugugcugcagugcgugcaucgcuggcccagugcgcggguccgccagaccugguccguacugcugcuucugcucuuguucuucaucccgggugugguuauggccguggccuacgggcuuaucucucgcgagcucuacuuagggcuucgcuuugacggcgacagugacagcgacagccaaagcaggguccgaaaccaaggcgggcugccaggggcuguucaccagaacgggcguugccggccugagacuggcgcgguuggcgaagacagcgauggcugcuacgugcaacuuccacguucccggccugcccuggagcugacggcgcugacggcuccugggccgggauccggcucccggcccacccaggccaagcugcuggcuaagaagcgcguggugcgaauguugcuggugaucguugugcuuuuuuuucuguguugguugccaguuuauagugccaacacguggcgcgccuuugauggcccgggugcacaccgagcacucucgggugcuccuaucuccuucauucacuugcugagcuacgccucggccugugucaacccccuggucuacugcuucaugcaccgucgcuuucgccaggccugccuggaaacuugcgcucgcugcugcccccggccuccacgagcucgccccagggcucuucccgaugaggacccucccacucccuccauugcuucgcuguccaggcuuagcuacaccaccaucagcacacugggcccuggcuga

SEQ ID NO: 1779 - RNA, 1344 nt, Artificial Sequence
  derived and/or modified sequence opt1 from GASR__Homo_sapiens__AAA35657
auggagcugcucaagcugaaccgcagcgugcagggcaccgggcccggcccgggggccucccugugccggcccggcgcgccccuccugaacagcuccagcgucgggaaccuguccugcgagcccccgcgcauccggggcgccggcacccgcgagcucgagcuggccauccggaucacgcuguacgccgugaucuuccucaugagcgucgggggcaacaugcugaucaucguggugcuggggcucucccgccggcugcgcaccgugaccaacgccuuccugcucagccuggccgucuccgaccugcuccuggcgguggccugcaugcccuucacccugcuccccaaccugaugggcacguucaucuucgggaccgugaucugcaaggccgucagcuaccugaugggcguguccgugagcgucuccacccucagccugguggccaucgcgcuggagcgguacuccgccaucugccgcccccuccaggcccggguguggcagacccgcagccacgccgcccgggucaucguggcgacguggcugcuguccggccuccugauggugccguaccccgucuacaccguggugcagcccgucgggccccgcgugcugcagugcgugcaccgguggccgagcgcccgcguccggcagaccugguccgugcuccugcugcuccugcuguucuucauccccggcgucgugauggccguggccuacgggcucaucagccgcgagcuguaccugggccuccgguucgacggcgacagcgacuccgacagccagucccgcguccggaaccagggcgggcugcccggggccgugcaccagaacggccgcugccgccccgagaccggggcggugggcgaggacagcgacggcugcuacguccagcugccgcggucccgccccgcccucgagcugacggcccugaccgcccccgggcccggcagcgggucccggccgacccaggccaagcuccuggcgaagaagcgcguggugcggaugcugcuggucaucguggugcuguucuuccugugcuggcugcccgucuacagcgccaacaccuggcgcgccuucgacggccccggggcccaccgggcccucuccggcgcgcccaucagcuucauccaccuccuguccuacgccagcgccugcgugaacccgcucguguacugcuucaugcaccgccgguuccgccaggccugccuggagacgugcgcgcggugcugcccccgcccgccccgggcccgcccccgggcccugcccgacgaggacccgcccacccccuccaucgccagccucucccgccugagcuacaccaccaucuccacgcugggccccggguga

SEQ ID NO: 1780 - RNA, 1344 nt, Artificial Sequence
  derived and/or modified sequence opt2 from GASR__Homo_sapiens__AAA35657
auggagcuccucaagcucaaccgcuccguccagggcaccggccccggccccggcgccucccucugccgccccggcgccccccuccucaacuccuccuccgucggcaaccucuccugcgagcccccccgcauccgcggcgccggcacccgcgagcucgagcucgccauccgcaucacccucuacgccgucaucuuccucauguccgucggcggcaacaugcucaucaucgucguccucggccucucccgccgccuccgcaccgucaccaacgccuuccuccucucccucgccgucuccgaccuccuccucgccgucgccugcaugcccuucacccuccuccccaaccucaugggcaccuucaucuucggcaccgucaucugcaaggccgucuccuaccucaugggcgucuccgucuccgucuccacccucucccucgucgccaucgcccucgagcgcuacuccgccaucugccgcccccuccaggcccgcgucuggcagacccgcucccacgccgcccgcgucaucgucgccaccuggcuccucuccggccuccucaugguccccuaccccgucuacaccgucguccagcccgucggcccccgcguccuccagugcguccaccgcuggcccuccgcccgcguccgccagaccugguccguccuccuccuccuccuccucuucuucauccccggcgucgucauggccgucgccuacggccucaucucccgcgagcucuaccucggccuccgcuucgacggcgacuccgacuccgacucccagucccgcguccgcaaccagggcggccuccccggcgccguccaccagaacggccgcugccgccccgagaccggcgccgucggcgaggacuccgacggcugcuacguccagcucccccgcucccgccccgcccucgagcucaccgcccucaccgcccccggccccggcuccggcucccgccccacccaggccaagcuccucgccaagaagcgcgucguccgcaugcuccucgucaucgucguccucuucuuccucugcuggcuccccgucuacuccgccaacaccuggcgcgccuucgacggccccggcgcccaccgcgcccucuccggcgcccccaucuccuucauccaccuccucuccuacgccuccgccugcgucaacccccucgucuacugcuucaugcaccgccgcuuccgccaggccugccucgagaccugcgcccgcugcugcccccgccccccccgcgcccgcccccgcgcccuccccgacgaggacccccccacccccuccaucgccucccucucccgccucuccuacaccaccaucuccacccucggccccggcuga

SEQ ID NO: 1781 - RNA, 1344 nt, Artificial Sequence
  derived and/or modified sequence opt3 from GASR__Homo_sapiens__AAA35657
auggagcugcucaaacuuaacagaagcgugcagggcaccgggcccggaccuggugccucccugugcaggccaggcgcuccguuguuaaauucuucaagugucgggaaccugagcugugaacccccucggauccgcggagcaggcacacgagagcuagaacucgccauucguauaacucuguacgcgguuaucuuccuuauguccgugggugggaauaugcugauuaucguaguguugggacucucuagaaggcugcggacggucaccaacgcuuuucugcucucguuagccgugucagaccugcuuuuggcaguugccugcaugccauucacacugcuacccaaucucaugggcacuuuuauuuucggcaccgugaucuguaaggcugucagcuaucugaugggggugaguguauccguuucuacacuuagccugguggcaauagccuuggagcgcuacuccgcuaucugcagaccucuccaagccagggucuggcagacccggucacacgcggcacgcgugauuguggccacuuggcuguuaaguggacugcucauggucccauaucccguuuacacagugguacagccuguggguccacgaguccuucagugugugcauagauggccgagcgcuaggguucggcaaaccuggucugugcuguugcuacugcuccuguuuuucauccccggcgucgugauggccguagcauaugggcuuauuucccgugaacuguacuugggacuccgcuuugauggcgacucagauagcgacagucagucuagaguuaggaaccagggugggcugccuggagcugugcaccagaauggccggugccgaccagagacgggcgccgucggggaggauuccgacggauguuaugugcaauuaccccgcagcagaccugcgcuggaacuaacugcccucaccgcaccaggucccggcucggggucuaggccgacacaggcuaagcugcuugccaaaaagcgggucgugcgcauguugcugguuaucgugguacucuucuuucugugcuggcuuccugucuacuccgcuaacacuuggagagccuucgauggacccggcgcacauagggcccugucaggugcuccaauaaguuuuauucacuugcucagcuacgcguccgcaugugugaauccucugguuuauugcuucaugcaucgucgguuucgacaggccuguuuagagaccugcgcuagaugcugucccaggccaccccgcgcccggccuagagcacugccagacgaagauccgcccacaccuucuaucgccagccuaucaaggcucaguuacaccacgauuuccacucuggggccaggcuga

SEQ ID NO: 1782 - RNA, 1344 nt, Artificial Sequence
  derived and/or modified sequence opt4 from GASR__Homo_sapiens__AAA35657
auggagcugcugaagcugaacagaagcgugcagggcaccggccccggccccggcgccagccugugcagacccggcgccccccugcugaacagcagcagcgugggcaaccugagcugcgagccccccagaaucagaggcgccggcaccagagagcuggagcuggccaucagaaucacccuguacgccgugaucuuccugaugagcgugggcggcaacaugcugaucaucguggugcugggccugagcagaagacugagaaccgugaccaacgccuuccugcugagccuggccgugagcgaccugcugcuggccguggccugcaugcccuucacccugcugcccaaccugaugggcaccuucaucuucggcaccgugaucugcaaggccgugagcuaccugaugggcgugagcgugagcgugagcacccugagccugguggccaucgcccuggagagauacagcgccaucugcagaccccugcaggccagaguguggcagaccagaagccacgccgccagagugaucguggccaccuggcugcugagcggccugcugauggugcccuaccccguguacaccguggugcagcccgugggccccagagugcugcagugcgugcacagauggcccagcgccagagugagacagaccuggagcgugcugcugcugcugcugcuguucuucauccccggcguggugauggccguggccuacggccugaucagcagagagcuguaccugggccugagauucgacggcgacagcgacagcgacagccagagcagagugagaaaccagggcggccugcccggcgccgugcaccagaacggcagaugcagacccgagaccggcgccgugggcgaggacagcgacggcugcuacgugcagcugcccagaagcagacccgcccuggagcugaccgcccugaccgcccccggccccggcagcggcagcagacccacccaggccaagcugcuggccaagaagagaguggugagaaugcugcuggugaucguggugcuguucuuccugugcuggcugcccguguacagcgccaacaccuggagagccuucgacggccccggcgcccacagagcccugagcggcgcccccaucagcuucauccaccugcugagcuacgccagcgccugcgugaacccccugguguacugcuucaugcacagaagauucagacaggccugccuggagaccugcgccagaugcugccccagaccccccagagccagacccagagcccugcccgacgaggacccccccacccccagcaucgccagccugagcagacugagcuacaccaccaucagcacccugggccccggcuga

SEQ ID NO: 1783 - RNA, 1344 nt, Artificial Sequence
  derived and/or modified sequence opt5 from GASR__Homo_sapiens__AAA35657
auggagcugcucaagcugaacagaagcgugcagggcaccgggcccggaccuggcgccucccuuugccggccgggggcuccccugcucaauucuagcuccgucggaaaccugucuugugaaccuccccgcaucagaggcgccgggacacgggagcuugaacuggcgauucgcaucacgcucuacgcuguuauuuuccugaugagcgugggaggcaauaugcugaucauugugguccucggccuguccagacggcuucgcaccgugacaaacgccuuucugcucucucuggccguuagcgaccuucugcucgcuguggccugcaugccuuucacccugcugcccaaucucauggggacauuuaucuucggaaccgucaucuguaaagcuguguccuaucugaugggcguuagcgugucugucuccacacuuagccugguggccauugcgcucgagagauacucugccaucugccggccucugcaagcucgcguguggcagaccagaucccacgccgcucgggucauuguugccacguggcuucugagcgggcuccugauggugccguaucccguguacaccgucgugcagccuguuggaccccgcgugcugcaguguguccauagauggccuucugcgcgggugcgccaaacaugguccguucuccugcuucugcuccuguuuuucauccccggcguggucauggccguggcuuaugggcuuauuagcagagaacuguaccucggacugcgguuugauggcgacuccgauucugacagccaguccagaguccgcaaccagggcgggcugccgggagccgugcaccagaauggccggugcagaccugagaccggggcuguuggagaggauagcgacggcuguuaugugcaacucccccgcucucggccugcccuggaacuuacagcccugaccgcucccgggcccggauccggcagcagaccuacgcaggcgaagcuccuggccaaaaagcgcgucgugcggaugcugcuuguuaucgugguccucuucuuucugugcuggcugccgguguacucugcuaacacauggagagccuucgauggccccggggcccaucgcgcucucagcggagccccuauuuccuuuauccaucugcuuucuuacgcgagcgcuugugugaauccccugguuuauugcuucaugcaccggagauuucgccaggccugucucgagaccugcgcccggugcuguccuagacccccgcgggcucgcccuagagcccugcccgacgaagauccucccacaccuuccaucgcuagccugucucggcuuuccuacaccaccauuagcacacucggccccggguga

SEQ ID NO: 1784 - protein, 741 aa, Artificial Sequence
  GnT-V__Homo_sapiens__Q09328
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 1785 - RNA, 2226 nt, Artificial Sequence
  GnT-V__Homo_sapiens__AAD22449
auggcucucuucacuccguggaaguuguccucucagaagcugggcuuuuuccuggugacuuuuggcuucauuugggguaugaugcuucugcacuuuaccauccagcagcgaacucagccugaaagcagcuccaugcugcgcgagcagauccuggaccucagcaaaagguacaucaaggcacuggcagaagaaaacaggaaugugguggaugggccauacgcuggagucaugacagcuuaugaucugaagaaaacccuugcuguguuauuagauaacauuuugcagcgcauuggcaaguuggagucgaagguggacaaucuuguugucaauggcaccggaacaaacucaaccaacuccacuacagcuguucccagcuugguugcacuugagaaaauuaauguggcagauaucauuaacggagcucaagaaaaauguguauugccuccuauggacggcuacccucacugugagggaaagaucaaguggaugaaagacauguggcguucagaucccugcuacgcagacuauggaguggauggauccaccugcucuuuuuuuauuuaccucagugagguugaaaauugguguccucauuuaccuuggagagcaaaaaaucccuacgaagaagcugaucauaauucauuggcggaaauucguacagauuuuaauauucucuacaguaugaugaaaaagcaugaagaauuccgguggaugagacuacggauccggcgaauggcugacgcauggauccaagcaaucaagucccuggcagaaaagcagaaccuugaaaagagaaagcggaagaaaguccucguucaccugggacuccugaccaaggaaucuggauuuaagauugcagagacagcuuucagugguggcccucuuggugaauuaguucaauggagugauuuaauuacaucucuguacuuacugggccaugacauuaggauuucagcuucacuggcugagcucaaggaaaucaugaagaagguuguaggaaaccgaucuggcugcccaacuguaggagacagaauuguugagcucauuuacauugauauuguaggacuugcucaauucaagaaaacucuuggaccauccuggguucauuaccagugcaugcuccgagugcuggauuccuuuggaacagaaccugaguucaaucacgcaaauuaugcccaaucgaaaggccacaagaccccuuggggaaaauggaaucugaacccucagcaguuuuauaccauguucccucauaccccagacaacagcuuucugggguuugugguugagcagcaccugaacuccagugauauccaccacauuaaugaaaucaaaaggcagaaccagucccuuguguauggcaaaguggauagcuucuggaagaauaagaagaucuacuuggacauuauucacacauacauggaagugcaugcaacuguuuauggcuccagcacaaagaauauucccaguuacgugaaaaaccaugguauccucaguggacgggaccugcaguuccuucuucgagaaaccaaguuguuuguuggacuuggguucccuuacgagggcccagcuccccuggaagcuaucgcaaauggaugugcuuuucugaaucccaaguucaacccacccaaaagcagcaaaaacacagacuucuucauuggcaagccaacacugagagagcucacaucccagcauccuuacgcugaaguuuucaucgggcggccacauguguggacuguugaccucaacaaucaggaggaaguagaggaugcagugaaagccaucuuaaaccagaagauugagccauacaugccauaugaauuuacgugcgaggggaugcuacagagaaucaaugcuuucauugaaaaacaggacuucugccaugggcaagugauguggccaccccucagcgcccuacaggucaagcuugcugagcccgggcaguccugcaagcaggugugccaggagagccagcucaucugcgagccuucuuucuuccagcaccucaacaaggacaaggacaugcugaaguacaaggugaccugccaaagcucagagcuggccaaggacauccuggugcccuccuuugacccuaagaauaagcacuguguguuucaaggugaccuccugcucuucagcugugcaggcgcccaccccaggcaccagagggucugccccugccgggacuucaucaagggccagguggcucucugcaaagacugccuauag

SEQ ID NO: 1786 - RNA, 2226 nt, Artificial Sequence
  derived and/or modified sequence opt1 from GnT-V__Homo_sapiens__AAD22449
auggcccuguucacccccuggaagcucagcucccagaagcugggguucuuccuggugaccuucggguucaucuggggcaugaugcuccugcacuucacgauccagcagcgcacccagccggagagcuccagcaugcugcgggagcagauccucgaccuguccaagcgcuacaucaaggcccuggcggaggagaaccggaacgucguggacgggcccuacgccggcgugaugaccgccuacgaccucaagaagacccuggccguccugcucgacaacauccugcagcgcaucgggaagcuggagagcaagguggacaaccucguggucaacggcacgggcaccaacuccaccaacagcaccacggccgugcccucccugguggcgcuggagaagaucaacgucgccgacaucaucaacggggcccaggagaagugcgugcugcccccgauggacggcuacccccacugcgaggggaagaucaaguggaugaaggacauguggcggagcgaccccugcuacgccgacuacggcguggacggguccacgugcagcuucuucaucuaccuguccgaggucgagaacuggugcccccaccucccguggcgcgcgaagaaccccuacgaggaggccgaccacaacagccucgccgagauccggaccgacuucaacauccuguacuccaugaugaagaagcacgaggaguuccgcuggaugcggcugcgcauccggcgcauggccgacgccuggauccaggcgaucaagagccucgccgagaagcagaaccuggagaagcggaagcgcaagaaggugcuggugcaccucggccugcugaccaaggaguccggcuucaagaucgccgagaccgccuucagcgggggcccccucggggagcugguccagugguccgaccugaucaccagccucuaccugcugggccacgacauccggaucagcgccucccucgcggagcugaaggagaucaugaagaagguggugggcaaccgcagcgggugccccaccgucggcgaccggaucguggagcugaucuacaucgacaucguggggcucgcccaguucaagaagacccugggcccguccuggguccacuaccagugcaugcugcgcgugcucgacagcuucgggacggagcccgaguucaaccacgccaacuacgcccaguccaagggccacaagacccccuggggcaaguggaaccugaacccccagcaguucuacaccauguucccgcacacccccgacaacagcuuccugggguucguggucgagcagcaccucaacuccagcgacauccaccacaucaacgagaucaagcggcagaaccagucccugguguacggcaaggucgacagcuucuggaagaacaagaagaucuaccuggacaucauccacacguacauggaggugcacgccaccguguacggguccagcaccaagaacauccccuccuacgucaagaaccacggcauccucagcgggcgcgaccugcaguuccugcugcgggagaccaagcuguucgugggccugggcuuccccuacgaggggccggcgccccuggaggccaucgccaacggcugcgccuuccucaaccccaaguucaacccgcccaaguccagcaagaacacggacuucuucaucgggaagcccacccugcgcgagcugaccucccagcaccccuacgccgagguguucaucggccgcccccacgucuggaccguggaccucaacaaccaggaggagguggaggacgcggucaaggccauccugaaccagaagaucgagccguacaugcccuacgaguucacgugcgaggggaugcugcagcggaucaacgccuucaucgagaagcaggacuucugccacggccaggugauguggcccccgcucagcgcccuccaggugaagcuggcggagcccggccaguccugcaagcaggucugccaggagagccagcucaucugcgagcccagcuucuuccagcaccugaacaaggacaaggacaugcugaaguacaaggugaccugccaguccagcgagcucgccaaggacauccuggugcccuccuucgacccgaagaacaagcacugcgucuuccagggggaccugcuccuguucagcugcgccggcgcccacccccgccaccagcgggugugccccugccgcgacuucaucaagggccagguggcccugugcaaggacugccucuga

SEQ ID NO: 1787 - RNA, 2226 nt, Artificial Sequence
  derived and/or modified sequence opt2 from GnT-V__Homo_sapiens__AAD22449
auggcccucuucacccccuggaagcucuccucccagaagcucggcuucuuccucgucaccuucggcuucaucuggggcaugaugcuccuccacuucaccauccagcagcgcacccagcccgaguccuccuccaugcuccgcgagcagauccucgaccucuccaagcgcuacaucaaggcccucgccgaggagaaccgcaacgucgucgacggccccuacgccggcgucaugaccgccuacgaccucaagaagacccucgccguccuccucgacaacauccuccagcgcaucggcaagcucgaguccaaggucgacaaccucgucgucaacggcaccggcaccaacuccaccaacuccaccaccgccguccccucccucgucgcccucgagaagaucaacgucgccgacaucaucaacggcgcccaggagaagugcguccucccccccauggacggcuacccccacugcgagggcaagaucaaguggaugaaggacauguggcgcuccgaccccugcuacgccgacuacggcgucgacggcuccaccugcuccuucuucaucuaccucuccgaggucgagaacuggugcccccaccuccccuggcgcgccaagaaccccuacgaggaggccgaccacaacucccucgccgagauccgcaccgacuucaacauccucuacuccaugaugaagaagcacgaggaguuccgcuggaugcgccuccgcauccgccgcauggccgacgccuggauccaggccaucaagucccucgccgagaagcagaaccucgagaagcgcaagcgcaagaagguccucguccaccucggccuccucaccaaggaguccggcuucaagaucgccgagaccgccuucuccggcggcccccucggcgagcucguccagugguccgaccucaucaccucccucuaccuccucggccacgacauccgcaucuccgccucccucgccgagcucaaggagaucaugaagaaggucgucggcaaccgcuccggcugccccaccgucggcgaccgcaucgucgagcucaucuacaucgacaucgucggccucgcccaguucaagaagacccucggccccuccuggguccacuaccagugcaugcuccgcguccucgacuccuucggcaccgagcccgaguucaaccacgccaacuacgcccaguccaagggccacaagacccccuggggcaaguggaaccucaacccccagcaguucuacaccauguucccccacacccccgacaacuccuuccucggcuucgucgucgagcagcaccucaacuccuccgacauccaccacaucaacgagaucaagcgccagaaccagucccucgucuacggcaaggucgacuccuucuggaagaacaagaagaucuaccucgacaucauccacaccuacauggagguccacgccaccgucuacggcuccuccaccaagaacauccccuccuacgucaagaaccacggcauccucuccggccgcgaccuccaguuccuccuccgcgagaccaagcucuucgucggccucggcuuccccuacgagggccccgccccccucgaggccaucgccaacggcugcgccuuccucaaccccaaguucaacccccccaaguccuccaagaacaccgacuucuucaucggcaagcccacccuccgcgagcucaccucccagcaccccuacgccgaggucuucaucggccgcccccacgucuggaccgucgaccucaacaaccaggaggaggucgaggacgccgucaaggccauccucaaccagaagaucgagcccuacaugcccuacgaguucaccugcgagggcaugcuccagcgcaucaacgccuucaucgagaagcaggacuucugccacggccaggucauguggcccccccucuccgcccuccaggucaagcucgccgagcccggccaguccugcaagcaggucugccaggagucccagcucaucugcgagcccuccuucuuccagcaccucaacaaggacaaggacaugcucaaguacaaggucaccugccaguccuccgagcucgccaaggacauccucguccccuccuucgaccccaagaacaagcacugcgucuuccagggcgaccuccuccucuucuccugcgccggcgcccacccccgccaccagcgcgucugccccugccgcgacuucaucaagggccaggucgcccucugcaaggacugccucuga

SEQ ID NO: 1788 - RNA, 2226 nt, Artificial Sequence
  derived and/or modified sequence opt3 from GnT-V__Homo_sapiens__AAD22449
auggcccuguucacccccuggaagcucagcucccagaaacuuggcuuuuuccuggugacauuuggguucaucuggggaaugauguuguuacacuuuacuauucaacagagaacgcagccugagucuucaaguaugcugagggaacagauacuagaccucagcaagcgguacaucaaagcucuggcagaggaaaaccgcaaugucguugaugguccauaugccggcgugaugaccgcguacgaccuuaagaaaacacuggcuguauugcucgauaacauucugcaacgaaucgggaagcuggaguccaagguggacaaucucgucgugaacggaacuggcaccaauucuacaaacucgaccacugccguuccgucauuaguggcacuggaaaagauuaaugucgccgauaucauaaacggugcucaggagaagugcgugcuucccccuauggacggguauccacauugugagggaaaaaucaaguggaugaaagauauguggcguagcgaccccugcuacgcagauuauggcguagacggcaguacauguuccuucuuuauuuacuugucugaaguugagaauuggugcccucaucugccauggagagccaagaaccccuaugaagaggcugaucacaauagccuagccgagaucaggaccgacuucaacauucucuacuccaugaugaagaaacacgaagaguuucgguggaugcgccugagaaucaggcggauggcggaugcauggauacaggccauuaagucacuugcugaaaaacagaaucuggagaagcgcaaacgaaagaaaguguugguccaucucgggcuguuaacgaaggaaaguggauucaagaucgccgagacugcauuuagcgguggcccucugggggagcucgugcaauggucugaccuuauuaccucccuguacuugcuaggacacgacaucagaaucucagcuagccuggccgaacucaaagagauuaugaagaaaguggucggcaacaggagugguuguccaacaguuggggaucggauaguggaacugaucuauauugacaucguaggacuugcgcaguucaagaaaacucugggcccgucuugggugcacuaccagugcauguugcguguccucgauuccuuuggcaccgagcccgaguucaaucaugccaacuaugcacagagcaaggggcacaagacaccuuggggaaaauggaaccugaauccacaacaguucuacaccauguuuccccauacgccugacaacucguucuuagguuuugugguugaacagcaccuuaauucuuccgauauacaccauauuaacgagaucaagcgccaaaaucagagucuaguguauggcaaagucgacaguuucuggaagaacaaaaagaucuaccucgauauuauccacacuuauauggaagugcaugcuacaguauacgggagcuccaccaagaauauuccaucuuacguuaaaaaccacggaauacugagcggcagagaccuucaguuuuugcugagggagacuaaacucuucgugggucugggguuucccuaugaaggcccggccccucuugaggcuaucgccaauggaugugcauuccugaaccccaaauuuaauccaccuaagucaaguaaaaacacagauuucuuuauuggcaagcccaccuugcgggaacucacgucccagcauccauacgccgaggucuucaucgggcgaccccacguguggaccgucgaccugaauaaccaagaggaaguggaggaugcuguuaaggcgaucuuaaaucagaaaauugaaccuuauaugccauacgaguuuacaugcgagggaaugcugcagcgcauaaacgcauucaucgaaaagcaggacuucugucacggucaagugauguggccgccccuaagcgcccuccagguaaaacuggcugagccuggccagucuugcaagcaggucugucaagaaucacagcuuauuugcgagccaucauuuuuccagcauuugaacaaagacaaggauaugcugaaauauaaggugacuugccagagcuccgaacucgccaaggacauccugguucccucuuuugauccuaaaaauaagcacuguguguuccaaggggacuuacugcuguuuucgugcgcaggagcccauccaagacaccagagggucugucccugccgggauuucauuaaaggccagguggcuuuguguaaggacugccucuga

SEQ ID NO: 1789 - RNA, 2226 nt, Artificial Sequence
  derived and/or modified sequence opt4 from GnT-V__Homo_sapiens__AAD22449
auggcccuguucacccccuggaagcugagcagccagaagcugggcuucuuccuggugaccuucggcuucaucuggggcaugaugcugcugcacuucaccauccagcagagaacccagcccgagagcagcagcaugcugagagagcagauccuggaccugagcaagagauacaucaaggcccuggccgaggagaacagaaacgugguggacggccccuacgccggcgugaugaccgccuacgaccugaagaagacccuggccgugcugcuggacaacauccugcagagaaucggcaagcuggagagcaagguggacaaccugguggugaacggcaccggcaccaacagcaccaacagcaccaccgccgugcccagccugguggcccuggagaagaucaacguggccgacaucaucaacggcgcccaggagaagugcgugcugccccccauggacggcuacccccacugcgagggcaagaucaaguggaugaaggacauguggagaagcgaccccugcuacgccgacuacggcguggacggcagcaccugcagcuucuucaucuaccugagcgagguggagaacuggugcccccaccugcccuggagagccaagaaccccuacgaggaggccgaccacaacagccuggccgagaucagaaccgacuucaacauccuguacagcaugaugaagaagcacgaggaguucagauggaugagacugagaaucagaagaauggccgacgccuggauccaggccaucaagagccuggccgagaagcagaaccuggagaagagaaagagaaagaaggugcuggugcaccugggccugcugaccaaggagagcggcuucaagaucgccgagaccgccuucagcggcggcccccugggcgagcuggugcaguggagcgaccugaucaccagccuguaccugcugggccacgacaucagaaucagcgccagccuggccgagcugaaggagaucaugaagaagguggugggcaacagaagcggcugccccaccgugggcgacagaaucguggagcugaucuacaucgacaucgugggccuggcccaguucaagaagacccugggccccagcugggugcacuaccagugcaugcugagagugcuggacagcuucggcaccgagcccgaguucaaccacgccaacuacgcccagagcaagggccacaagacccccuggggcaaguggaaccugaacccccagcaguucuacaccauguucccccacacccccgacaacagcuuccugggcuucgugguggagcagcaccugaacagcagcgacauccaccacaucaacgagaucaagagacagaaccagagccugguguacggcaagguggacagcuucuggaagaacaagaagaucuaccuggacaucauccacaccuacauggaggugcacgccaccguguacggcagcagcaccaagaacauccccagcuacgugaagaaccacggcauccugagcggcagagaccugcaguuccugcugagagagaccaagcuguucgugggccugggcuuccccuacgagggccccgccccccuggaggccaucgccaacggcugcgccuuccugaaccccaaguucaacccccccaagagcagcaagaacaccgacuucuucaucggcaagcccacccugagagagcugaccagccagcaccccuacgccgagguguucaucggcagaccccacguguggaccguggaccugaacaaccaggaggagguggaggacgccgugaaggccauccugaaccagaagaucgagcccuacaugcccuacgaguucaccugcgagggcaugcugcagagaaucaacgccuucaucgagaagcaggacuucugccacggccaggugauguggcccccccugagcgcccugcaggugaagcuggccgagcccggccagagcugcaagcaggugugccaggagagccagcugaucugcgagcccagcuucuuccagcaccugaacaaggacaaggacaugcugaaguacaaggugaccugccagagcagcgagcuggccaaggacauccuggugcccagcuucgaccccaagaacaagcacugcguguuccagggcgaccugcugcuguucagcugcgccggcgcccaccccagacaccagagagugugccccugcagagacuucaucaagggccagguggcccugugcaaggacugccuguga

SEQ ID NO: 1790 - RNA, 2226 nt, Artificial Sequence
  derived and/or modified sequence opt5 from GnT-V__Homo_sapiens__AAD22449
auggcccuguucacccccuggaagcucagcucccagaaacugggcuuuuuccuugugacauuuggguucaucuggggaaugaugcugcuccacuuuacgauucaacagagaacccagccugagucuagcuccaugcugcgggaacagauccuugaccugucuaagcgcuacauuaaagcucucgccgaggaaaacagaaaugucguugauggcccguaugcgggggugaugacagcuuacgaccugaagaaaacccuggccgugcuccuggauaacauccuucaacggauuggaaagcuggagagcaaggucgacaaucucgugguuaacggcacagggaccaauuccacaaacucuaccacggccgugcccagccuggucgcucuugaaaagaucaauguggccgauaucauuaacggagcucaggagaagugcguucugccucccauggacggcuauccucauugugagggcaaaaucaaguggaugaaagauauguggcgcuccgaccccugcuacgccgauuaugggguggacggaagcaccuguucuuucuuuauuuaccucuccgaagucgagaauuggugcccucaccucccguggagagcgaagaaccccuaugaagaggccgaucauaauagccuggcugagauccggacagacuucaacauucucuacucuaugaugaagaaacacgaagaguuucgcuggaugagacugcggauccgcagaauggccgaugcuuggauucaggccaucaagucccuugcggaaaaacagaaucuggagaagcggaaacgcaagaaagugcucgugcaucugggccuucugaccaaggaaagcggguucaagaucgccgagacagcuuuuucuggaggcccucucggggagcugguccaaugguccgaccugauuaccagccucuaccugcuuggacacgacaucagaauuuccgccucucuggcugaacucaaagagaucaugaagaaaguugugggcaaccggagcggcugucccacggugggggaucgcauugucgaacugaucuauaucgacauugugggacuugcccaguucaagaaaacacugggcccuuccuggguucacuaccagugcaugcucagagugcuggauagcuuugggaccgagcccgaguucaaucaugccaacuaugcucagucuaagggacacaagacaccguggggcaaauggaaccugaauccucaacaguucuacaccauguuuccccauaccccugacaacuccuuccucggguuugucguggaacagcaccugaauagcucugauauccaccauauuaacgagaucaagcggcaaaaucagagccuuguuuauggaaaaguggacuccuucuggaagaacaaaaagauuuaccuggauaucauccacacauauauggaaguccaugcgacgguguacggcucuagcaccaagaauauucccuccuacgucaaaaaccacggcauccucagcgggagagaccugcaguuucugcuucgcgagacaaagcuguucgugggacugggcuuucccuaugaagggccugccccgcuggaggcuauugccaauggaugugccuuccucaaccccaaauuuaauccucccaagucuuccaaaaacaccgauuucuuuaucggcaagccuacacugcgggaacuuaccagccagcaucccuacgcugagguuuucauugggagaccgcacguguggacggucgaccugaauaaccaagaggaaguggaggaugccguuaaggcgauccucaaucagaaaauugaaccuuauaugcccuacgaguuuacaugcgagggcaugcugcagcgcaucaacgcuuucaucgaaaagcaggacuucugucacggacaagugauguggccuccccugucugcccuucaggucaaacucgccgagccuggccaguccugcaaacaggugugucaagaaagccagcugauuugcgagcccuccuuuuuccagcaucugaacaaagacaaggauaugcucaaauauaaggugaccugccagucuagcgaacuggcuaaggacauccuuguuccguccuuugauccuaaaaauaagcacugugucuuccaaggggaccugcuccuguuuucuugcgccggagcucauccccggcaccagagagugugucccugccgcgauuucauuaaaggccagguggcccuguguaaggacugccuuuga

SEQ ID NO: 1791 - protein, 580 aa, Artificial Sequence
  GPC3__Homo_sapiens__I6QTG3
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 1792 - RNA, 1743 nt, Artificial Sequence
  GPC3__Homo_sapiens__EAX11770
auggccgggaccgugcgcaccgcgugcuuggugguggcgaugcugcucagcuuggacuucccgggacaggcgcagcccccgccgccgccgccggacgccaccugucaccaaguccgcuccuucuuccagagacugcagcccggacucaagugggugccagaaacucccgugccaggaucagauuugcaaguaugucucccuaagggcccaacaugcugcucaagaaagauggaagaaaaauaccaacuaacagcacgauugaacauggaacagcugcuucagucugcaaguauggagcucaaguucuuaauuauucagaaugcugcgguuuuccaagaggccuuugaaauuguuguucgccaugccaagaacuacaccaaugccauguucaagaacaacuacccaagccugacuccacaagcuuuugaguuugugggugaauuuuucacagaugugucucucuacaucuuggguucugacaucaauguagaugacauggucaaugaauuguuugacagccuguuuccagucaucuauacccagcuaaugaacccaggccugccugauucagccuuggacaucaaugagugccuccgaggagcaagacgugaccugaaaguauuugggaauuuccccaagcuuauuaugacccagguuuccaagucacugcaagucacuaggaucuuccuucaggcucugaaucuuggaauugaagugaucaacacaacugaucaccugaaguucaguaaggacuguggccgaaugcucaccagaaugugguacugcucuuacugccagggacugaugaugguuaaacccuguggcgguuacugcaauguggucaugcaaggcuguauggcaggugugguggagauugacaaguacuggagagaauacauucugucccuugaagaacuugugaauggcauguacagaaucuaugacauggagaacguacugcuuggucucuuuucaacaauccaugauucuauccaguauguccagaagaaugcaggaaagcugaccaccacuauuggcaaguuaugugcccauucucaacaacgccaauauagaucugcuuauuauccugaagaucucuuuauugacaagaaaguauuaaaaguugcucauguagaacaugaagaaaccuuauccagccgaagaagggaacuaauucagaaguugaagucuuucaucagcuucuauagugcuuugccuggcuacaucugcagccauagcccuguggcggaaaacgacacccuuugcuggaauggacaagaacucguggagagauacagccaaaaggcagcaaggaauggaaugaaaaaccaguucaaucuccaugagcugaaaaugaagggcccugagccaguggucagucaaauuauugacaaacugaagcacauuaaccagcuccugagaaccaugucuaugcccaaagguagaguucuggauaaaaaccuggaugaggaaggguuugaaaguggagacugcggugaugaugaagaugagugcauuggaggcucuggugauggaaugauaaaagugaagaaucagcuccgcuuccuugcagaacuggccuaugaucuggauguggaugaugcgccuggaaacagucagcaggcaacuccgaaggacaacgagauaagcaccuuucacaaccucgggaacguucauuccccgcugaagcuucucaccagcauggccaucucgguggugugcuucuucuuccuggugcacuga

SEQ ID NO: 1793 - RNA, 1743 nt, Artificial Sequence
  derived and/or modified sequence opt1 from GPC3__Homo_sapiens__EAX11770
auggccggcaccgugcgcaccgccugccuggucguggcgaugcuccugagccuggacuuccccgggcaggcccagccgcccccgccgccgcccgacgccacgugccaccaggugcgguccuucuuccagcgccuccagcccggccugaaguggguccccgagacccccgugcccgggagcgaccuccaggugugccugcccaagggcccgaccugcugcucccggaagauggaggagaaguaccagcugaccgcccgccugaacauggagcagcuccugcagagcgccuccauggagcugaaguuccucaucauccagaacgcggccgucuuccaggaggccuucgagaucguggugcggcacgccaagaacuacacgaacgcgauguucaagaacaacuaccccagccugacgccccaggccuucgaguucgucggggaguucuucaccgacgugucccuguacauccucggcagcgacaucaacguggacgacauggucaacgagcuguucgacucccuguuccccgugaucuacacccagcucaugaaccccggccugccggacagcgcccuggacaucaacgagugccuccgcggggcccggcgcgaccugaagguguucggcaacuuccccaagcugaucaugacccaggucuccaagagccuccaggugacccggaucuuccugcaggcccugaaccucgggaucgaggugaucaacaccaccgaccaccugaaguucuccaaggacugcggccgcaugcugacgcggaugugguacugcagcuacugccaggggcucaugauggucaagcccugcggcggcuacugcaacguggugaugcaggggugcauggcgggcgucguggagaucgacaaguacuggcgcgaguacauccugucccuggaggagcucgugaacgggauguaccggaucuacgacauggagaacguccugcugggccucuucagcaccauccacgacuccauccaguacgugcagaagaacgccggcaagcugaccaccacgaucgggaagcugugcgcccacagccagcagcgccaguaccgguccgccuacuaccccgaggaccucuucaucgacaagaagguccugaagguggcccacguggagcacgaggagacccugagcagccgccggcgcgagcucauccagaagcugaaguccuucaucagcuucuacuccgcgcugcccggcuacaucugcagccacucccccgucgccgagaacgacacccucugcuggaacgggcaggagcugguggagcgguacagccagaaggccgcccgcaacggcaugaagaaccaguucaaccugcacgagcucaagaugaaggggcccgagcccguggucucccagaucaucgacaagcugaagcacaucaaccagcugcugcggaccaugagcaugccgaagggccgcgugcucgacaagaaccuggacgaggagggcuucgaguccggggacugcggcgacgacgaggacgagugcaucgggggcagcggggacggcaugaucaaggugaagaaccagcugcgcuuccucgccgagcuggcguacgaccuggacgucgacgacgcccccggcaacucccagcaggccacgcccaaggacaacgagaucagcaccuuccacaaccucgggaacgugcacagcccccugaagcugcucaccuccauggccaucuccguggucugcuucuucuuccuggugcacuga

SEQ ID NO: 1794 - RNA, 1743 nt, Artificial Sequence
  derived and/or modified sequence opt2 from GPC3__Homo_sapiens__EAX11770
auggccggcaccguccgcaccgccugccucgucgucgccaugcuccucucccucgacuuccccggccaggcccagccccccccccccccccccgacgccaccugccaccagguccgcuccuucuuccagcgccuccagcccggccucaaguggguccccgagacccccguccccggcuccgaccuccaggucugccuccccaagggccccaccugcugcucccgcaagauggaggagaaguaccagcucaccgcccgccucaacauggagcagcuccuccaguccgccuccauggagcucaaguuccucaucauccagaacgccgccgucuuccaggaggccuucgagaucgucguccgccacgccaagaacuacaccaacgccauguucaagaacaacuaccccucccucaccccccaggccuucgaguucgucggcgaguucuucaccgacgucucccucuacauccucggcuccgacaucaacgucgacgacauggucaacgagcucuucgacucccucuuccccgucaucuacacccagcucaugaaccccggccuccccgacuccgcccucgacaucaacgagugccuccgcggcgcccgccgcgaccucaaggucuucggcaacuuccccaagcucaucaugacccaggucuccaagucccuccaggucacccgcaucuuccuccaggcccucaaccucggcaucgaggucaucaacaccaccgaccaccucaaguucuccaaggacugcggccgcaugcucacccgcaugugguacugcuccuacugccagggccucaugauggucaagcccugcggcggcuacugcaacgucgucaugcagggcugcauggccggcgucgucgagaucgacaaguacuggcgcgaguacauccucucccucgaggagcucgucaacggcauguaccgcaucuacgacauggagaacguccuccucggccucuucuccaccauccacgacuccauccaguacguccagaagaacgccggcaagcucaccaccaccaucggcaagcucugcgcccacucccagcagcgccaguaccgcuccgccuacuaccccgaggaccucuucaucgacaagaagguccucaaggucgcccacgucgagcacgaggagacccucuccucccgccgccgcgagcucauccagaagcucaaguccuucaucuccuucuacuccgcccuccccggcuacaucugcucccacucccccgucgccgagaacgacacccucugcuggaacggccaggagcucgucgagcgcuacucccagaaggccgcccgcaacggcaugaagaaccaguucaaccuccacgagcucaagaugaagggccccgagcccgucgucucccagaucaucgacaagcucaagcacaucaaccagcuccuccgcaccauguccaugcccaagggccgcguccucgacaagaaccucgacgaggagggcuucgaguccggcgacugcggcgacgacgaggacgagugcaucggcggcuccggcgacggcaugaucaaggucaagaaccagcuccgcuuccucgccgagcucgccuacgaccucgacgucgacgacgcccccggcaacucccagcaggccacccccaaggacaacgagaucuccaccuuccacaaccucggcaacguccacuccccccucaagcuccucaccuccauggccaucuccgucgucugcuucuucuuccucguccacuga

SEQ ID NO: 1795 - RNA, 1743 nt, Artificial Sequence
  derived and/or modified sequence opt3 from GPC3__Homo_sapiens__EAX11770
auggccggcaccgugagaacagcuugccuggucguugcaaugcuccuuagccuggacuuccccgggcaggcccaaccuccaccgcccccuccagaugcgacuugucaccaggugagguccuuuuuccagcgguugcagcccggauuaaaguggguaccugagacgccagugcccgguucugaccugcaagucugccuaccuaaaggcccaaccuguugcucacgcaagauggaagagaaauaccagcucacagcucgacugaacauggaacagcuucugcagagugccagcauggaguugaaguuucucaucauucaaaaugcagccguguuccaggaagcauuugagauaguugugcgucaugcuaaaaacuauacuaaugccauguucaagaacaauuacccgucccugacaccccaggcuuuugaguucgucggggaauuuuucaccgaugugucucuguauauccucggaucggacauuaacguagaugacaugguuaaugaguuauuugauucacuguucccugugaucuacacccagcuuaugaacccaggcuugcccgacagcgcccuggauauuaaugaaugucuaagaggugcgaggcgggaccucaaggucuuugggaacuucccuaaacugaucaugacucaagugaguaagucccuucaggugacacgcauauuccugcaggcauugaaucucggaaucgaggucauuaacaccacggaucaccugaaauuuucuaaggacugcggcagaauguuaacuaggaugugguauuguagcuacugccaaggccugaugaugguuaaaccaugugggggauauugcaaugugguaaugcaggguuguauggccggcguggucgagaucgauaaguacuggcgggaauacauucucucccuugaggaacuggugaacgggauguaucgcaucuacgacauggagaauguuuugcuaggacuguucucaaccauacaugacaguauucaguaugugcagaagaacgcuggcaaacucacaacuaccaucgguaagcugugcgcccacagccaacagcgacaguacagaucugcauauuaccccgaagaucuuuuuauugacaaaaagguccugaaaguggcucauguagagcacgaggaaacauuguccucaaggcggcgugagcucauccagaagcugaaaaguuucaucagcuuuuauucugccuuaccgggguacauuugcucccacagcccuguugcggaaaacgauacccuguguuggaauggacaagagcuaguggaacgcuacucgcagaaggccgcaagaaacggcaugaagaaucaguucaaccuccaugagcugaaaaugaagggccccgagccagucgugucucagauaaucgacaaacuuaagcacauuaaucaauugcugaggacgauguccaugccuaaagggcggguccucgauaagaaccuggacgaagagggauuugaaucaggugauugcggcgacgaugaggacgaauguaucgggggaaguggcgaugguaugauaaaggugaaaaaucagcuucgauuccuggcugaguuggccuaugaccucgacguugaugacgcucccgggaacagccagcaggccacuccaaaggauaaugagauuuccacauuucauaaccugggcaaugugcacucucccuuaaaacugcuaaccagcauggcaaucucaguagucugcuucuuuuuccucgugcacuga

SEQ ID NO: 1796 - RNA, 1743 nt, Artificial Sequence
  derived and/or modified sequence opt4 from GPC3__Homo_sapiens__EAX11770
auggccggcaccgugagaaccgccugccuggugguggccaugcugcugagccuggacuuccccggccaggcccagccccccccccccccccccgacgccaccugccaccaggugagaagcuucuuccagagacugcagcccggccugaagugggugcccgagacccccgugcccggcagcgaccugcaggugugccugcccaagggccccaccugcugcagcagaaagauggaggagaaguaccagcugaccgccagacugaacauggagcagcugcugcagagcgccagcauggagcugaaguuccugaucauccagaacgccgccguguuccaggaggccuucgagaucguggugagacacgccaagaacuacaccaacgccauguucaagaacaacuaccccagccugaccccccaggccuucgaguucgugggcgaguucuucaccgacgugagccuguacauccugggcagcgacaucaacguggacgacauggugaacgagcuguucgacagccuguuccccgugaucuacacccagcugaugaaccccggccugcccgacagcgcccuggacaucaacgagugccugagaggcgccagaagagaccugaagguguucggcaacuuccccaagcugaucaugacccaggugagcaagagccugcaggugaccagaaucuuccugcaggcccugaaccugggcaucgaggugaucaacaccaccgaccaccugaaguucagcaaggacugcggcagaaugcugaccagaaugugguacugcagcuacugccagggccugaugauggugaagcccugcggcggcuacugcaacguggugaugcagggcugcauggccggcgugguggagaucgacaaguacuggagagaguacauccugagccuggaggagcuggugaacggcauguacagaaucuacgacauggagaacgugcugcugggccuguucagcaccauccacgacagcauccaguacgugcagaagaacgccggcaagcugaccaccaccaucggcaagcugugcgcccacagccagcagagacaguacagaagcgccuacuaccccgaggaccuguucaucgacaagaaggugcugaagguggcccacguggagcacgaggagacccugagcagcagaagaagagagcugauccagaagcugaagagcuucaucagcuucuacagcgcccugcccggcuacaucugcagccacagccccguggccgagaacgacacccugugcuggaacggccaggagcugguggagagauacagccagaaggccgccagaaacggcaugaagaaccaguucaaccugcacgagcugaagaugaagggccccgagcccguggugagccagaucaucgacaagcugaagcacaucaaccagcugcugagaaccaugagcaugcccaagggcagagugcuggacaagaaccuggacgaggagggcuucgagagcggcgacugcggcgacgacgaggacgagugcaucggcggcagcggcgacggcaugaucaaggugaagaaccagcugagauuccuggccgagcuggccuacgaccuggacguggacgacgcccccggcaacagccagcaggccacccccaaggacaacgagaucagcaccuuccacaaccugggcaacgugcacagcccccugaagcugcugaccagcauggccaucagcguggugugcuucuucuuccuggugcacuga

SEQ ID NO: 1797 - RNA, 1743 nt, Artificial Sequence
  derived and/or modified sequence opt5 from GPC3__Homo_sapiens__EAX11770
auggccggcaccgugagaacagcuugccuggucguugccaugcuccugagccuugacuuccccgggcaggcgcaaccuccgcccccucccccugaugcuacgugucaccaggugcgguccuuuuuccagcgccugcagcccggacucaagugggugccugagaccccgguccccggcucugaccugcaagugugccuuccuaaagggcccacauguugcagcagaaagauggaagagaaauaccagcugaccgcccggcucaacauggaacagcugcugcaguccgccucuauggagcucaaguuucugaucauucaaaaugcugccguuuuccaggaggcuuuugaaaucgugguccgccaugccaaaaacuauacaaaugcgauguucaagaacaauuacccuagccuuacaccccaggccuuugaguucgugggagaauuuuucaccgauguuucccuguauauucucggcucugacaucaacguggaugacauggucaaugagcuguuugauagccuuuucccggugauuuacacccagcugaugaacccugggcuccccgacuccgcucuggauaucaaugaaugucugagaggagcccggcgcgaccucaagguguuuggcaacuucccuaaacugaucaugacgcaagucagcaagucucuucagguuaccagaauuuuccugcaggcucucaaucugggcaucgaggugauuaacacaaccgaucaccuuaaauuuuccaaggacugcgggcggaugcugacacgcaugugguauuguagcuacugccaaggacucaugauggugaaacccuguggcggguauugcaaugucgugaugcagggauguauggccggcguuguggagaucgauaaguacuggagagaauacauucugucucuggaggaacucgucaacgggauguaucggaucuacgacauggagaaugugcugcuuggacuguucuccaccauucaugacagcauccaguauguucagaagaacgcgggcaaacucacgacaaccaucggcaagcugugcgcccacucucaacagcgccaguacagauccgcuuauuaccccgaagaucuuuuuauugacaaaaaggugcugaaagucgcccauguggagcacgaggaaacacucagcucccggcgcagagagcugauccagaagcugaaaucuuucauuagcuuuuauuccgcucucccuggguacaucugcagccacucuccggucgccgaaaacgauacccuguguuggaauggacaagagcuuguggaacgguacucccagaaggccgcuagaaacggcaugaagaaucaguucaaccugcaugagcucaaaaugaaggggcccgagccuguugugagccagauuaucgacaaacugaagcacaucaaucaacugcuucgcaccaugucuaugcccaaaggacggguccucgauaagaaccuggacgaagagggcuuugaaagcggggauugcggagacgaugaggacgaauguauuggcggcuccggggauggaaugaucaaggugaaaaaucagcugagauuccucgcggagcuggccuaugaccuugacguugaugacgcuccuggcaacucucagcaggccacacccaaggauaaugagauuagcacguuucauaaccuggggaaugugcacuccccgcucaaacugcugaccagcauggccaucucugucgugugcuucuuuuuccuugugcacuga

SEQ ID NO: 1798 - protein, 580 aa, Artificial Sequence; identical to SEQ ID NO: 1791
  GPC3__Homo_sapiens__P51654

SEQ ID NO: 1799 - RNA, 1743 nt, Artificial Sequence
  GPC3__Homo_sapiens__AAA93471
auggccgggaccgugcgcaccgcgugcuuggugguggcgaugcugcucagcuuggacuucccgggacaggcgcagcccccgccgccgccgccggacgccaccugucaccaaguccgcuccuucuuccagagacugcagcccggacucaagugggugccagaaacucccgugccaggaucagauuugcaaguaugucucccuaagggcccaacaugcugcucaagaaagauggaagaaaaauaccaacuaacagcucgauugaacauggaacagcugcuucagucugcaaguauggagcucaaguucuuaauuauucagaaugcugcgguuuuccaagaggccuuugaaauuguuguucgccaugccaagaacuacaccaaugccauguucaagaacaacuacccaagccugacuccacaagcuuuugaguuugugggugaauuuuucacagaugugucucucuacaucuuggguucugacaucaauguagaugacauggucaaugaauuguuugacagccuguuuccagucaucuauacccagcuaaugaacccaggccugccugauucagccuuggacaucaaugagugccuccgaggagcaagacgugaccugaaaguauuugggaauuuccccaagcuuauuaugacccagguuuccaagucacugcaagucacuaggaucuuccuucaggcucugaaucuuggaauugaagugaucaacacaacugaucaccugaaguucaguaaggacuguggccgaaugcucaccagaaugugguacugcucuuacugccagggacugaugaugguuaaacccuguggcgguuacugcaauguggucaugcaaggcuguauggcaggugugguggagauugacaaguacuggagagaauacauucugucccuugaagaacuugugaauggcauguacagaaucuaugacauggagaacguacugcuuggucucuuuucaacaauccaugauucuauccaguauguccagaagaaugcaggaaagcugaccaccacuauuggcaaguuaugugcccauucucaacaacgccaauauagaucugcuuauuauccugaagaucucuuuauugacaagaaaguauuaaaaguugcucauguagaacaugaagaaaccuuauccagccgaagaagggaacuaauucagaaguugaagucuuucaucagcuucuauagugcuuugccuggcuacaucugcagccauagcccuguggcggaaaacgacacccuuugcuggaauggacaagaacucguggagagauacagccaaaaggcagcaaggaauggaaugaaaaaccaguucaaucuccaugagcugaaaaugaagggcccugagccaguggucagucaaauuauugacaaacugaagcacauuaaccagcuccugagaaccaugucuaugcccaaagguagaguucuggauaaaaaccuggaugaggaaggguuugaaaguggagacugcggugaugaugaagaugagugcauuggagggucuggugauggaaugauaaaagugaagaaucagcuccgcuuccuugcagaacuggccuaugaucuggauguggaugaugcgccuggaaacagucagcaggcaacuccgaaggacaacgagauaagcaccuuucacaaccucgggaacguucauuccccgcugaagcuucucaccagcauggccaucucgguggugugcuucuucuuccuggugcacuga

SEQ ID NO: 1800 - RNA, 1743 nt, Artificial Sequence; identical to SEQ ID NO: 1793
  derived and/or modified sequence opt1 from GPC3__Homo_sapiens__AAA93471

SEQ ID NO: 1801 - RNA, 1743 nt, Artificial Sequence; identical to SEQ ID NO: 1794
  derived and/or modified sequence opt2 from GPC3__Homo_sapiens__AAA93471

SEQ ID NO: 1802 - RNA, 1743 nt, Artificial Sequence; identical to SEQ ID NO: 1795
  derived and/or modified sequence opt3 from GPC3__Homo_sapiens__AAA93471

SEQ ID NO: 1803 - RNA, 1743 nt, Artificial Sequence; identical to SEQ ID NO: 1796
  derived and/or modified sequence opt4 from GPC3__Homo_sapiens__AAA93471

SEQ ID NO: 1804 - RNA, 1743 nt, Artificial Sequence; identical to SEQ ID NO: 1797
  derived and/or modified sequence opt5 from GPC3__Homo_sapiens__AAA93471

SEQ ID NO: 1805 - protein, 580 aa, Artificial Sequence [sequence omitted]

SEQ ID NO: 1806 - RNA, 1743 nt, Artificial Sequence
  GPC3__Homo_sapiens__AAH35972
auggccgggaccgugcgcaccgcgugcuuggugguggcgaugcugcucagcuuggacuucccgggacaggcgcagcccccgccgccgccgccggacgccaccugucaccaaguccgcuccuucuuccagagacugcagcccggacucaagugggugccagaaacucccgugccaggaucagauuugcaaguaugucucccuaagggcccaacaugcugcucaagaaagauggaagaaaaauaccaacuaacagcacgauugaacauggaacagcugcuucagucugcaaguauggagcucaaguucuuaauuauucagaaugcugcgguuuuccaagaggccuuugaaauuguuguucgccaugccaagaacuacaccaaugccauguucaagaacaacuacccaagccugacuccacaagcuuuugaguuugugggugaauuuuucacagaugugucucucuacaucuuggguucugacaucaauguagaugacauggucaaugaauuguuugacagccuguuuccagucaucuauacccagcuaaugaacccaggccugccugauucagccuuggacaucaaugagugccuccgaggagcaagacgugaccugaaaguauuugggaauuuccccaagcuuauuaugacccagguuuccaagucacugcaagucacuaggaucuuccuucaggcucugaaucuuggaauugaagugaucaacacaacugaucaccugaaguucaguaaggacuguggccgaaugcucaccagaaugugguacugcucuuacugccagggacugaugaugguuaaacccuguggcgguuacugcaauguggucaugcaaggcuguauggcaggugugguggagauugacaaguacuggagagaauacauucugucccuugaagaacuugugaauggcauguacagaaucuaugacauggagaacguacugcuuggucucuuuucaacaauccaugauucuauccaguauguccagaagaaugcaggaaagcugaccaccacuauuggcaaguuaugugcccauucucaacaacgccaauauagauuugcuuauuauccugaagaucucuuuauugacaagaaaguauuaaaaguugcucauguagaacaugaagaaaccuuauccagccgaagaagggaacuaauucagaaguugaagucuuucaucagcuucuauagugcuuugccuggcuacaucugcagccauagcccuguggcggaaaacgacacccuuugcuggaauggacaagaacucguggagagauacagccaaaaggcagcaaggaauggaaugaaaaaccaguucaaucuccaugagcugaaaaugaagggcccugagccaguggucagucaaauuauugacaaacugaagcacauuaaccagcuccugagaaccaugucuaugcccaaagguagaguucuggauaaaaaccuggaugaggaaggguuugaaaguggagacugcggugaugaugaagaugagugcauuggaggcucuggugauggaaugauaaaagugaagaaucagcuccgcuuccuugcagaacuggccuaugaucuggauguggaugaugcgccuggaaacagucagcaggcaacuccgaaggacaacgagauaagcaccuuucacaaccucgggaacguucauuccccgcugaagcuucucaccagcauggccaucucgguggugugcuucuucuuccuggugcacuga

SEQ ID NO: 1807 - RNA, 1743 nt, Artificial Sequence
  derived and/or modified sequence opt1 from GPC3__Homo_sapiens__AAH35972
auggccggcaccgugcgcaccgccugccuggucguggcgaugcuccugagccuggacuuccccgggcaggcccagccgcccccgccgccgcccgacgccacgugccaccaggugcgguccuucuuccagcgccuccagcccggccugaaguggguccccgagacccccgugcccgggagcgaccuccaggugugccugcccaagggcccgaccugcugcucccggaagauggaggagaaguaccagcugaccgcccgccugaacauggagcagcuccugcagagcgccuccauggagcugaaguuccucaucauccagaacgcggccgucuuccaggaggccuucgagaucguggugcggcacgccaagaacuacacgaacgcgauguucaagaacaacuaccccagccugacgccccaggccuucgaguucgucggggaguucuucaccgacgugucccuguacauccucggcagcgacaucaacguggacgacauggucaacgagcuguucgacucccuguuccccgugaucuacacccagcucaugaaccccggccugccggacagcgcccuggacaucaacgagugccuccgcggggcccggcgcgaccugaagguguucggcaacuuccccaagcugaucaugacccaggucuccaagagccuccaggugacccggaucuuccugcaggcccugaaccucgggaucgaggugaucaacaccaccgaccaccugaaguucuccaaggacugcggccgcaugcugacgcggaugugguacugcagcuacugccaggggcucaugauggucaagcccugcggcggcuacugcaacguggugaugcaggggugcauggcgggcgucguggagaucgacaaguacuggcgcgaguacauccugucccuggaggagcucgugaacgggauguaccggaucuacgacauggagaacguccugcugggccucuucagcaccauccacgacuccauccaguacgugcagaagaacgccggcaagcugaccaccacgaucgggaagcugugcgcccacagccagcagcgccaguaccgguucgccuacuaccccgaggaccucuucaucgacaagaagguccugaagguggcccacguggagcacgaggagacccuguccagccgccggcgcgagcucauccagaagcucaagagcuucaucuccuucuacagcgcgcugcccggcuacaucugcucccacagccccgucgccgagaacgacacccugugcuggaacgggcaggagcugguggagcgguacucccagaaggccgcccgcaacggcaugaagaaccaguucaaccugcacgagcucaagaugaaggggcccgagcccguggucagccagaucaucgacaagcugaagcacaucaaccagcugcugcggaccauguccaugccgaagggccgcgugcucgacaagaaccuggacgaggagggcuucgagagcggggacugcggcgacgacgaggacgagugcaucgggggcuccggggacggcaugaucaaggugaagaaccagcugcgcuuccucgccgagcuggcguacgaccuggacgucgacgacgcccccggcaacagccagcaggccacgcccaaggacaacgagaucuccaccuuccacaaccucgggaacgugcacagcccccugaagcugcucaccuccauggccaucagcguggucugcuucuucuuccuggugcacuga

SEQ ID NO: 1808 - RNA, 1743 nt, Artificial Sequence
  derived and/or modified sequence opt2 from GPC3__Homo_sapiens__AAH35972
auggccggcaccguccgcaccgccugccucgucgucgccaugcuccucucccucgacuuccccggccaggcccagccccccccccccccccccgacgccaccugccaccagguccgcuccuucuuccagcgccuccagcccggccucaaguggguccccgagacccccguccccggcuccgaccuccaggucugccuccccaagggccccaccugcugcucccgcaagauggaggagaaguaccagcucaccgcccgccucaacauggagcagcuccuccaguccgccuccauggagcucaaguuccucaucauccagaacgccgccgucuuccaggaggccuucgagaucgucguccgccacgccaagaacuacaccaacgccauguucaagaacaacuaccccucccucaccccccaggccuucgaguucgucggcgaguucuucaccgacgucucccucuacauccucggcuccgacaucaacgucgacgacauggucaacgagcucuucgacucccucuuccccgucaucuacacccagcucaugaaccccggccuccccgacuccgcccucgacaucaacgagugccuccgcggcgcccgccgcgaccucaaggucuucggcaacuuccccaagcucaucaugacccaggucuccaagucccuccaggucacccgcaucuuccuccaggcccucaaccucggcaucgaggucaucaacaccaccgaccaccucaaguucuccaaggacugcggccgcaugcucacccgcaugugguacugcuccuacugccagggccucaugauggucaagcccugcggcggcuacugcaacgucgucaugcagggcugcauggccggcgucgucgagaucgacaaguacuggcgcgaguacauccucucccucgaggagcucgucaacggcauguaccgcaucuacgacauggagaacguccuccucggccucuucuccaccauccacgacuccauccaguacguccagaagaacgccggcaagcucaccaccaccaucggcaagcucugcgcccacucccagcagcgccaguaccgcuucgccuacuaccccgaggaccucuucaucgacaagaagguccucaaggucgcccacgucgagcacgaggagacccucuccucccgccgccgcgagcucauccagaagcucaaguccuucaucuccuucuacuccgcccuccccggcuacaucugcucccacucccccgucgccgagaacgacacccucugcuggaacggccaggagcucgucgagcgcuacucccagaaggccgcccgcaacggcaugaagaaccaguucaaccuccacgagcucaagaugaagggccccgagcccgucgucucccagaucaucgacaagcucaagcacaucaaccagcuccuccgcaccauguccaugcccaagggccgcguccucgacaagaaccucgacgaggagggcuucgaguccggcgacugcggcgacgacgaggacgagugcaucggcggcuccggcgacggcaugaucaaggucaagaaccagcuccgcuuccucgccgagcucgccuacgaccucgacgucgacgacgcccccggcaacucccagcaggccacccccaaggacaacgagaucuccaccuuccacaaccucggcaacguccacuccccccucaagcuccucaccuccauggccaucuccgucgucugcuucuucuuccucguccacuga

SEQ ID NO: 1809 - RNA, 1743 nt, Artificial Sequence
  derived and/or modified sequence opt3 from GPC3__Homo_sapiens__AAH35972
auggccggcaccgugagaacagcuugccuggucguugcaaugcuccuuagccuggacuuccccgggcaggcccaaccuccaccgcccccuccagaugcgacuugucaccaggugagguccuuuuuccagcgguugcagcccggauuaaaguggguaccugagacgccagugcccgguucugaccugcaagucugccuaccuaaaggcccaaccuguugcucacgcaagauggaagagaaauaccagcucacagcucgacugaacauggaacagcuucugcagagugccagcauggaguugaaguuucucaucauucaaaaugcagccguguuccaggaagcauuugagauaguugugcgucaugcuaaaaacuauacuaaugccauguucaagaacaauuacccgucccugacaccccaggcuuuugaguucgucggggaauuuuucaccgaugugucucuguauauccucggaucggacauuaacguagaugacaugguuaaugaguuauuugauucacuguucccugugaucuacacccagcuuaugaacccaggcuugcccgacagcgcccuggauauuaaugaaugucuaagaggugcgaggcgggaccucaaggucuuugggaacuucccuaaacugaucaugacucaagugaguaagucccuucaggugacacgcauauuccugcaggcauugaaucucggaaucgaggucauuaacaccacggaucaccugaaauuuucuaaggacugcggcagaauguuaacuaggaugugguauuguagcuacugccaaggccugaugaugguuaaaccaugugggggauauugcaaugugguaaugcaggguuguauggccggcguggucgagaucgauaaguacuggcgggaauacauucucucccuugaggaacuggugaacgggauguaucgcaucuacgacauggagaauguuuugcuaggacuguucucaaccauacaugacaguauucaguaugugcagaagaacgcuggcaaacucacaacuaccaucgguaagcugugcgcccacagccaacagcgacaguacagauuugcauauuaccccgaagaucuuuucauugacaaaaagguccugaaaguggcucauguagagcacgaggaaacauugucuuccaggcggcgugagcucauccagaagcugaaaucauuuaucagcuucuauagugccuuaccgggguacauuugcucucacuccccuguugcggaaaacgauacccuguguuggaauggacaagagcuaguggaacgcuacagccagaaggccgcaagaaacggcaugaagaaucaguuuaaccuccaugagcugaaaaugaagggccccgagccagucgugucgcagauaaucgacaaacuuaagcacauuaaucaauugcugaggacgaugucuaugccuaaagggcggguccucgauaagaaccuggacgaagagggauucgaauccggugauugcggcgacgaugaggacgaauguaucgggggaucaggcgaugguaugauaaaggugaaaaaucagcuucgauuucuggcugaguuggccuaugaccucgacguugaugacgcucccgggaacagucagcaggccacuccaaaggauaaugagauuagcacauuccauaaccugggcaaugugcacucccccuuaaaacugcuaaccucuauggcaaucagcguagucugcuuuuucuuucucgugcacuga

SEQ ID NO: 1810 - RNA, 1743 nt, Artificial Sequence
  derived and/or modified sequence opt4 from GPC3__Homo_sapiens__AAH35972
auggccggcaccgugagaaccgccugccuggugguggccaugcugcugagccuggacuuccccggccaggcccagccccccccccccccccccgacgccaccugccaccaggugagaagcuucuuccagagacugcagcccggccugaagugggugcccgagacccccgugcccggcagcgaccugcaggugugccugcccaagggccccaccugcugcagcagaaagauggaggagaaguaccagcugaccgccagacugaacauggagcagcugcugcagagcgccagcauggagcugaaguuccugaucauccagaacgccgccguguuccaggaggccuucgagaucguggugagacacgccaagaacuacaccaacgccauguucaagaacaacuaccccagccugaccccccaggccuucgaguucgugggcgaguucuucaccgacgugagccuguacauccugggcagcgacaucaacguggacgacauggugaacgagcuguucgacagccuguuccccgugaucuacacccagcugaugaaccccggccugcccgacagcgcccuggacaucaacgagugccugagaggcgccagaagagaccugaagguguucggcaacuuccccaagcugaucaugacccaggugagcaagagccugcaggugaccagaaucuuccugcaggcccugaaccugggcaucgaggugaucaacaccaccgaccaccugaaguucagcaaggacugcggcagaaugcugaccagaaugugguacugcagcuacugccagggccugaugauggugaagcccugcggcggcuacugcaacguggugaugcagggcugcauggccggcgugguggagaucgacaaguacuggagagaguacauccugagccuggaggagcuggugaacggcauguacagaaucuacgacauggagaacgugcugcugggccuguucagcaccauccacgacagcauccaguacgugcagaagaacgccggcaagcugaccaccaccaucggcaagcugugcgcccacagccagcagagacaguacagauucgccuacuaccccgaggaccuguucaucgacaagaaggugcugaagguggcccacguggagcacgaggagacccugagcagcagaagaagagagcugauccagaagcugaagagcuucaucagcuucuacagcgcccugcccggcuacaucugcagccacagccccguggccgagaacgacacccugugcuggaacggccaggagcugguggagagauacagccagaaggccgccagaaacggcaugaagaaccaguucaaccugcacgagcugaagaugaagggccccgagcccguggugagccagaucaucgacaagcugaagcacaucaaccagcugcugagaaccaugagcaugcccaagggcagagugcuggacaagaaccuggacgaggagggcuucgagagcggcgacugcggcgacgacgaggacgagugcaucggcggcagcggcgacggcaugaucaaggugaagaaccagcugagauuccuggccgagcuggccuacgaccuggacguggacgacgcccccggcaacagccagcaggccacccccaaggacaacgagaucagcaccuuccacaaccugggcaacgugcacagcccccugaagcugcugaccagcauggccaucagcguggugugcuucuucuuccuggugcacuga

SEQ ID NO: 1811 - RNA, 1743 nt, Artificial Sequence
  derived and/or modified sequence opt5 from GPC3__Homo_sapiens__AAH35972
auggccggcaccgugagaacagcuugccuggucguugccaugcuccugagccuugacuuccccgggcaggcgcaaccuccgcccccucccccugaugcuacgugucaccaggugcgguccuuuuuccagcgccugcagcccggacucaagugggugccugagaccccgguccccggcucugaccugcaagugugccuuccuaaagggcccacauguugcagcagaaagauggaagagaaauaccagcugaccgcccggcucaacauggaacagcugcugcaguccgccucuauggagcucaaguuucugaucauucaaaaugcugccguuuuccaggaggcuuuugaaaucgugguccgccaugccaaaaacuauacaaaugcgauguucaagaacaauuacccuagccuuacaccccaggccuuugaguucgugggagaauuuuucaccgauguuucccuguauauucucggcucugacaucaacguggaugacauggucaaugagcuguuugauagccuuuucccggugauuuacacccagcugaugaacccugggcuccccgacuccgcucuggauaucaaugaaugucugagaggagcccggcgcgaccucaagguguuuggcaacuucccuaaacugaucaugacgcaagucagcaagucucuucagguuaccagaauuuuccugcaggcucucaaucugggcaucgaggugauuaacacaaccgaucaccuuaaauuuuccaaggacugcgggcggaugcugacacgcaugugguauuguagcuacugccaaggacucaugauggugaaacccuguggcggguauugcaaugucgugaugcagggauguauggccggcguuguggagaucgauaaguacuggagagaauacauucugucucuggaggaacucgucaacgggauguaucggaucuacgacauggagaaugugcugcuuggacuguucuccaccauucaugacagcauccaguauguucagaagaacgcgggcaaacucacgacaaccaucggcaagcugugcgcccacucucaacagcgccaguacagauuugcuuauuaccccgaagaucuuuucauugacaaaaaggugcugaaagucgcccauguggagcacgaggaaacacucuccagccggcgcagagagcugauccagaagcugaaauccuuuauuucuuucuauagcgcucucccuggguacaucugcucccacagcccggucgccgaaaacgauacccuguguuggaauggacaagagcuuguggaacgguacucucagaaggccgcuagaaacggcaugaagaaucaguuuaaccugcaugagcucaaaaugaaggggcccgagccuguugugucccagauuaucgacaaacugaagcacaucaaucaacugcuucgcaccaugagcaugcccaaaggacggguccucgauaagaaccuggacgaagagggcuucgaaucuggggauugcggagacgaugaggacgaauguauuggcggcagcggggauggaaugaucaaggugaaaaaucagcugagauuucucgcggagcuggccuaugaccuugacguugaugacgcuccuggcaacucccagcaggccacacccaaggauaaugagauuucuacguuccauaaccuggggaaugugcacagcccgcucaaacugcugaccuccauggccaucagcgucgugugcuuuuucuuucuugugcacuga

SEQ ID NO: 1812 - protein, 560 aa, Artificial Sequence
  GPNMB/m__Homo_sapiens__A0A024RA55
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 1813 - RNA, 1683 nt, Artificial Sequence
  GPNMB/m__Homo_sapiens__EAW93784
auggaaugucucuacuauuuccugggauuucugcuccuggcugcaagauugccacuugaugccgccaaacgauuucaugaugugcugggcaaugaaagaccuucugcuuacaugagggagcacaaucaauuaaauggcuggucuucugaugaaaaugacuggaaugaaaaacucuacccaguguggaagcggggagacaugagguggaaaaacuccuggaagggaggccgugugcaggcgguccugaccagugacucaccagcccucgugggcucaaauauaacauuugcggugaaccugauauucccuagaugccaaaaggaagaugccaauggcaacauagucuaugagaagaacugcagaaaugaggcugguuuaucugcugauccguauguuuacaacuggacagcauggucagaggacagugacggggaaaauggcaccggccaaagccaucauaacgucuucccugaugggaaaccuuuuccucaccaccccggauggagaagauggaauuucaucuacgucuuccacacacuuggucaguauuuccagaaauugggacgauguucagugagaguuucugugaacacagccaaugugacacuugggccucaacucauggaagugacugucuacagaagacauggacgggcauauguucccaucgcacaagugaaagauguguacgugguaacagaucagauuccuguguuugugacuauguuccagaagaacgaucgaaauucauccgacgaaaccuuccucaaagaucuccccauuauguuugauguccugauucaugauccuagccacuuccucaauuauucuaccauuaacuacaaguggagcuucggggauaauacuggccuguuuguuuccaccaaucauacugugaaucacacguaugugcucaauggaaccuucagccuuaaccucacugugaaagcugcagcaccaggaccuuguccgccaccgccaccaccacccagaccuucaaaacccaccccuucuuuaggaccugcuggugacaacccccuggagcugaguaggauuccugaugaaaacugccagauuaacagauauggccacuuucaagccaccaucacaauuguagagggaaucuuagagguuaacaucauccagaugacagacguccugaugccggugccauggccugaaagcucccuaauagacuuugucgugaccugccaagggagcauucccacggaggucuguaccaucauuucugaccccaccugcgagaucacccagaacacagucugcagcccuguggauguggaugagaugugucugcugacugugagacgaaccuucaaugggucugggacguacugugugaaccucacccugggggaugacacaagccuggcucucacgagcacccugauuucuguuccugacagagacccagccucgccuuuaaggauggcaaacagugcccugaucuccguuggcugcuuggccauauuugucacugugaucucccucuugguguacaaaaaacacaaggaauacaacccaauagaaaauaguccugggaauguggucagaagcaaaggccugagugucuuucucaaccgugcaaaagccguguucuucccgggaaaccaggaaaaggauccgcuacucaaaaaccaagaauuuaaaggaguuucuuaa

SEQ ID NO: 1814 - RNA, 1683 nt, Artificial Sequence
  derived and/or modified sequence opt1 from GPNMB/m__Homo_sapiens__EAW93784
auggagugccuguacuacuuccucggcuuccugcugcucgccgcccgccugccccuggacgcggccaagcgguuccacgacgugcucgggaacgagcgcccgagcgccuacaugcgggagcacaaccagcugaacggcugguccagcgacgagaacgacuggaacgagaagcuguaccccgucuggaagcgcggggacaugcgguggaagaacuccuggaagggcgggcgcgugcaggccgugcucaccagcgacucccccgcccuggucggcagcaacaucaccuucgcggugaaccugaucuucccccggugccagaaggaggacgccaacggcaacaucguguacgagaagaacugccgcaacgaggccgggcucuccgccgacccguacgucuacaacuggacggcguggagcgaggacuccgacggcgagaacgggaccggccagagccaccacaacguguuccccgacgggaagcccuucccccaccacccgggcuggcggcgcuggaacuucaucuacguguuccacacccugggccaguacuuccagaagcuggggcggugcuccguccgcgugagcgugaacaccgccaacgucacgcucggcccccagcugauggaggugaccguguaccggcgccacgggcgggccuacguccccaucgcccaggugaaggacguguacgucgugaccgaccagauccccguguucgucaccauguuccagaagaacgaccgcaacuccagcgacgagacguuccugaaggaccucccgaucauguucgacgugcugauccacgaccccucccacuuccugaacuacagcaccaucaacuacaagugguccuucggcgacaacaccggccucuucgugagcaccaaccacacggucaaccacaccuacgugcugaacgggaccuucucccugaaccucaccgucaaggccgcggcccccggccccugcccgcccccgccgcccccgccccggcccagcaagcccacgcccagccuggggcccgccggcgacaacccccuggagcucucccgcauccccgacgagaacugccagaucaaccgguacgggcacuuccaggccaccaucaccaucguggagggcauccuggaggugaacaucauccagaugaccgacguccugaugcccgugcccuggccggagagcucccucaucgacuucguggucacgugccagggcagcauccccaccgaggugugcaccaucaucuccgacccgaccugcgagaucacgcagaacaccgugugcagccccgucgacguggacgagaugugccugcugaccgugcgccggaccuucaacggguccggcacguacugcgucaaccucacccugggggacgacaccagccuggcccucaccuccacgcugaucagcgugcccgaccgcgaccccgcgagcccccugcgcauggccaacuccgcccucaucuccgugggcugccuggccaucuucgucaccgugaucagccugcucguguacaagaagcacaaggaguacaaccccaucgagaacuccccggggaacgucgugcggagcaagggccuguccguguuccugaaccgcgccaaggcggucuucuuccccggcaaccaggagaaggacccccuccugaagaaccaggaguucaagggggugagcuga

SEQ ID NO: 1815 - RNA, 1683 nt, Artificial Sequence
  derived and/or modified sequence opt2 from GPNMB/m__Homo_sapiens__EAW93784
auggagugccucuacuacuuccucggcuuccuccuccucgccgcccgccucccccucgacgccgccaagcgcuuccacgacguccucggcaacgagcgccccuccgccuacaugcgcgagcacaaccagcucaacggcugguccuccgacgagaacgacuggaacgagaagcucuaccccgucuggaagcgcggcgacaugcgcuggaagaacuccuggaagggcggccgcguccaggccguccucaccuccgacucccccgcccucgucggcuccaacaucaccuucgccgucaaccucaucuucccccgcugccagaaggaggacgccaacggcaacaucgucuacgagaagaacugccgcaacgaggccggccucuccgccgaccccuacgucuacaacuggaccgccugguccgaggacuccgacggcgagaacggcaccggccagucccaccacaacgucuuccccgacggcaagcccuucccccaccaccccggcuggcgccgcuggaacuucaucuacgucuuccacacccucggccaguacuuccagaagcucggccgcugcuccguccgcgucuccgucaacaccgccaacgucacccucggcccccagcucauggaggucaccgucuaccgccgccacggccgcgccuacguccccaucgcccaggucaaggacgucuacgucgucaccgaccagauccccgucuucgucaccauguuccagaagaacgaccgcaacuccuccgacgagaccuuccucaaggaccuccccaucauguucgacguccucauccacgaccccucccacuuccucaacuacuccaccaucaacuacaagugguccuucggcgacaacaccggccucuucgucuccaccaaccacaccgucaaccacaccuacguccucaacggcaccuucucccucaaccucaccgucaaggccgccgcccccggccccugcccccccccccccccccccccccgccccuccaagcccacccccucccucggccccgccggcgacaacccccucgagcucucccgcauccccgacgagaacugccagaucaaccgcuacggccacuuccaggccaccaucaccaucgucgagggcauccucgaggucaacaucauccagaugaccgacguccucaugcccguccccuggcccgaguccucccucaucgacuucgucgucaccugccagggcuccauccccaccgaggucugcaccaucaucuccgaccccaccugcgagaucacccagaacaccgucugcucccccgucgacgucgacgagaugugccuccucaccguccgccgcaccuucaacggcuccggcaccuacugcgucaaccucacccucggcgacgacaccucccucgcccucaccuccacccucaucuccguccccgaccgcgaccccgccuccccccuccgcauggccaacuccgcccucaucuccgucggcugccucgccaucuucgucaccgucaucucccuccucgucuacaagaagcacaaggaguacaaccccaucgagaacucccccggcaacgucguccgcuccaagggccucuccgucuuccucaaccgcgccaaggccgucuucuuccccggcaaccaggagaaggacccccuccucaagaaccaggaguucaagggcgucuccuga

SEQ ID NO: 1816 - RNA, 1683 nt, Artificial Sequence
  derived and/or modified sequence opt3 from GPNMB/m__Homo_sapiens__EAW93784
auggagugccuauacuauuuccucggcuuucuucuguuggccgcuagauuaccccuggacgcagccaagagguuccacgaugugcuagggaacgaacggccuagcgcguacaugcgcgagcauaaucagcucaacggaugguccucugacgaaaaugauuggaacgagaaacuguauccagucuggaagcgaggugacaugcguuggaaaaauucauggaagggcgggagaguucaagcugugcuuaccagugauagcccggcccugguaggauccaacaucacauuugcagugaauuugauuuuccccaggugucagaaagaagacgccaacggcaauauagucuacgagaagaacugccggaaugaggcuggucucucugcagauccuuauguguacaacuggacugccuggucggaagacucagauggggagaauggaacgggccagagccaccauaacguuuuuccagacggcaagcccuucccucaccauccaggguggcgcagauggaauuuuaucuauguguuccacacccugggacaguacuuucaaaaacuggguagguguaguguccggguguccguaaacacagcuaacguuacucucggcccccaguuaauggaagugaccgucuaccgccgacacgggagagccuaugugccuauugcgcaagugaaggaugucuacguugugacagaccagaucccaguauucgugaccauguuucagaaaaaugauaggaacucuagcgacgagacuuuccugaaggaccuuccgauuauguuugaugucuugauccaugaccccucccacuuccugaauuauucaacaauaaacuacaaauggaguuucggagauaauaccggccuauuugugagcacgaaccauacuguuaaucacaccuaugugcucaacgguacauucucucugaaucuuacugucaaggcagccgcuccugggccaugucccccuccacccccgccuccccggccauccaagccuacccccucacugggaccagccggcgacaaccccuuggagcucagccguaucccugaugaaaauugccagauuaaccgcuacggccacuuucaggcaacaaucaccauuguggaggggauccuggaaguaaauauaauucagaugacggacguuuuaaugccagugccguggcccgagaguucucugaucgauuucgucgugacuugccaaggauccauuccuacagaagucuguaccaucaucagcgacccaacuugcgagauuacacagaacaccguguguucgcccguugauguggacgagaugugccuccuuacgguaagaaggaccuuuaaugguucuggcacauauugugucaaccugacuuugggggaugacaccucccuagcucugacaucaacucucauaagugugccugaccgggauccagccagcccccugcgaauggcgaacuccgcccuuaucucuguuggaugccuggcaauuuucgugaccgucaucagcuugcucguguacaaaaagcauaaagaauacaauccgauagagaacucaccuggcaauguagugcgcaguaagggucuguccgucuuuuuaaacagagcuaaagccguuuucuuuccagggaaucaggaaaaggacccccugcugaaaaaccaagaguucaagggcgugagcuga

SEQ ID NO: 1817 - RNA, 1683 nt, Artificial Sequence
  derived and/or modified sequence opt4 from GPNMB/m__Homo_sapiens__EAW93784
auggagugccuguacuacuuccugggcuuccugcugcuggccgccagacugccccuggacgccgccaagagauuccacgacgugcugggcaacgagagacccagcgccuacaugagagagcacaaccagcugaacggcuggagcagcgacgagaacgacuggaacgagaagcuguaccccguguggaagagaggcgacaugagauggaagaacagcuggaagggcggcagagugcaggccgugcugaccagcgacagccccgcccuggugggcagcaacaucaccuucgccgugaaccugaucuuccccagaugccagaaggaggacgccaacggcaacaucguguacgagaagaacugcagaaacgaggccggccugagcgccgaccccuacguguacaacuggaccgccuggagcgaggacagcgacggcgagaacggcaccggccagagccaccacaacguguuccccgacggcaagcccuucccccaccaccccggcuggagaagauggaacuucaucuacguguuccacacccugggccaguacuuccagaagcugggcagaugcagcgugagagugagcgugaacaccgccaacgugacccugggcccccagcugauggaggugaccguguacagaagacacggcagagccuacgugcccaucgcccaggugaaggacguguacguggugaccgaccagauccccguguucgugaccauguuccagaagaacgacagaaacagcagcgacgagaccuuccugaaggaccugcccaucauguucgacgugcugauccacgaccccagccacuuccugaacuacagcaccaucaacuacaaguggagcuucggcgacaacaccggccuguucgugagcaccaaccacaccgugaaccacaccuacgugcugaacggcaccuucagccugaaccugaccgugaaggccgccgcccccggccccugccccccccccccccccccccccagacccagcaagcccacccccagccugggccccgccggcgacaacccccuggagcugagcagaauccccgacgagaacugccagaucaacagauacggccacuuccaggccaccaucaccaucguggagggcauccuggaggugaacaucauccagaugaccgacgugcugaugcccgugcccuggcccgagagcagccugaucgacuucguggugaccugccagggcagcauccccaccgaggugugcaccaucaucagcgaccccaccugcgagaucacccagaacaccgugugcagccccguggacguggacgagaugugccugcugaccgugagaagaaccuucaacggcagcggcaccuacugcgugaaccugacccugggcgacgacaccagccuggcccugaccagcacccugaucagcgugcccgacagagaccccgccagcccccugagaauggccaacagcgcccugaucagcgugggcugccuggccaucuucgugaccgugaucagccugcugguguacaagaagcacaaggaguacaaccccaucgagaacagccccggcaacguggugagaagcaagggccugagcguguuccugaacagagccaaggccguguucuuccccggcaaccaggagaaggacccccugcugaagaaccaggaguucaagggcgugagcuga

SEQ ID NO: 1818 - RNA, 1683 nt, Artificial Sequence
  derived and/or modified sequence opt5 from GPNMB/m__Homo_sapiens__EAW93784
auggagugccuguacuauuuccucggcuuucugcuucuggccgcuagacucccccuggacgccgcgaagcgguuccacgaugugcuugggaacgaacgcccuagcgcuuacaugagagagcauaaucagcugaacggaugguccucugacgaaaaugauuggaacgagaaacucuauccggucuggaagcggggcgacaugcgcuggaaaaauagcuggaaagggggaagaguucaagccgugcugaccuccgauucucccgcccuggugggcagcaacaucacauuugcugucaaucucauuuucccucggugucagaaagaagacgccaacgggaauaucguguacgagaagaacugccgcaaugaggcuggacuguccgccgaucccuauguuuacaacuggacggcguggucugaagacagcgauggcgagaauggcaccgggcagucccaccauaacguguuuccugacggaaagcccuucccucaccauccgggcuggagacgguggaauuuuauuuaugucuuccacacacuugggcaguacuuucaaaaacugggacgcuguagcgugagaguuucugugaacaccgccaacgucacacucggcccccagcugauggaagugaccguguaccggcgccacgggagagcuuaugucccuaucgcccagguuaaggauguguacguggucacagaccagauucccguguucguuaccauguuucaaaagaaugaucggaacuccagcgacgagacguuccuuaaggaccugccuaucauguuugaugugcucauccaugaccccucucacuuccugaauuauuccaccauuaacuacaaauggagcuucggagauaauacaggccuguuugucucuaccaaccauacagugaaucacaccuauguucucaacggcacguucucccugaaucuuacagugaaggcugccgcgccggggccuugucccccucccccucccccgccccgcccuagcaagcccaccccuucccugggacccgccggcgacaacccgcucgagcugucuagaaucccugaugaaaauugccagauuaaccgguacgggcacuuucaggcuacaaucaccauugucgagggaauccuugaagugaauauuauccagaugaccgacguccugaugcccgugccuuggcccgagagcucccucaucgauuucguugugacaugccaaggcagcauuccuacggaagucuguaccaucauuucugaccccacaugcgagaucacccagaacacaguguguuccccgguugauguggacgagaugugccugcugaccgucagacgcacguuuaaugggagcggaacauauugugugaaccucacccugggcgaugacaccucucuugcccugacaagcacccucauuuccgugccugaccgggaucccgcuucuccccugagaauggccaacagcgcccuuaucuccguuggcugccuggcuaucuucgucacagugauuagccuccugguguacaaaaagcauaaagaauacaauccuaucgagaacucuccggggaaugucgugcgcuccaagggacugagcguuuuucucaaccgggcgaaagccguguucuuucccggcaaucaggaaaaggacccucugcuuaaaaaccaagaguucaagggggucucuuga

SEQ ID NO: 1819 - protein, 572 aa, Artificial Sequence
  GPNMB/m__Homo_sapiens__Q14956
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 1820 - RNA, 1719 nt, Artificial Sequence
  GPNMB/m__Homo_sapiens__AAH32783
auggaaugucucuacuauuuccugggauuucugcuccuggcugcaagauugccacuugaugccgccaaacgauuucaugaugugcugggcaaugaaagaccuucugcuuacaugagggagcacaaucaauuaaauggcuggucuucugaugaaaaugacuggaaugaaaaacucuacccaguguggaagcggggagacaugagguggaaaaacuccuggaagggaggccgugugcaggcgguccugaccagugacucaccagcccucgugggcucaaauauaacauuugcggugaaccugauauucccuagaugccaaaaggaagaugccaauggcaacauagucuaugagaagaacugcagaaaugaggcugguuuaucugcugauccguauguuuacaacuggacagcauggucagaggacagugacggggaaaauggcaccggccaaagccaucauaacgucuucccugaugggaaaccuuuuccucaccaccccggauggagaagauggaauuucaucuacgucuuccacacacuuggucaguauuuccagaaauugggacgauguucagugagaguuucugugaacacagccaaugugacacuugggccucaacucauggaagugacugucuacagaagacauggacgggcauauguucccaucgcacaagugaaagauguguacgugguaacagaucagauuccuguguuugugacuauguuccagaagaacgaucgaaauucauccgacgaaaccuuccucaaagaucuccccauuauguuugauguccugauucaugauccuagccacuuccucaauuauucuaccauuaacuacaaguggagcuucggggauaauacuggccuguuuguuuccaccaaucauacugugaaucacacguaugugcucaauggaaccuucagccuuaaccucacugugaaagcugcagcaccaggaccuuguccgccaccgccaccaccacccagaccuucaaaacccaccccuucuuuagcaacuacucuaaaaucuuaugauucaaacaccccaggaccugcuggugacaacccccuggagcugaguaggauuccugaugaaaacugccagauuaacagauauggccacuuucaagccaccaucacaauuguagagggaaucuuagagguuaacaucauccagaugacagacguccugaugccggugccauggccugaaagcucccuaauagacuuugucgugaccugccaagggagcauucccacggaggucuguaccaucauuucugaccccaccugcgagaucacccagaacacagucugcagcccuguggauguggaugagaugugucugcugacugugagacgaaccuucaaugggucugggacguacugugugaaccucacccugggggaugacacaagccuggcucucacgagcacccugauuucuguuccugacagagacccagccucgccuuuaaggauggcaaacagcgcccugaucuccguuggcugcuuggccauauuugucacugugaucucccucuugguguacaaaaaacacaaggaauacaacccaauagaaaauaguccugggaauguggucagaagcaaaggccugagugucuuucucaaccgugcaaaagccguguucuucccgggaaaccaggaaaaggauccgcuacucaaaaaccaagaauuuaaaggaguuucuuaa

SEQ ID NO: 1821 - RNA, 1719 nt, Artificial Sequence
  derived and/or modified sequence opt1 from GPNMB/m__Homo_sapiens__AAH32783
auggagugccuguacuacuuccucggcuuccugcugcucgccgcccgccugccccuggacgcggccaagcgguuccacgacgugcucgggaacgagcgcccgagcgccuacaugcgggagcacaaccagcugaacggcugguccagcgacgagaacgacuggaacgagaagcuguaccccgucuggaagcgcggggacaugcgguggaagaacuccuggaagggcgggcgcgugcaggccgugcucaccagcgacucccccgcccuggucggcagcaacaucaccuucgcggugaaccugaucuucccccggugccagaaggaggacgccaacggcaacaucguguacgagaagaacugccgcaacgaggccgggcucuccgccgacccguacgucuacaacuggacggcguggagcgaggacuccgacggcgagaacgggaccggccagagccaccacaacguguuccccgacgggaagcccuucccccaccacccgggcuggcggcgcuggaacuucaucuacguguuccacacccugggccaguacuuccagaagcuggggcggugcuccguccgcgugagcgugaacaccgccaacgucacgcucggcccccagcugauggaggugaccguguaccggcgccacgggcgggccuacguccccaucgcccaggugaaggacguguacgucgugaccgaccagauccccguguucgucaccauguuccagaagaacgaccgcaacuccagcgacgagacguuccugaaggaccucccgaucauguucgacgugcugauccacgaccccucccacuuccugaacuacagcaccaucaacuacaagugguccuucggcgacaacaccggccucuucgugagcaccaaccacacggucaaccacaccuacgugcugaacgggaccuucucccugaaccucaccgucaaggccgcggcccccggccccugcccgcccccgccgcccccgccccggcccagcaagcccacgcccagccuggccaccacccugaaguccuacgacagcaacacccccgggcccgccggcgacaacccccucgagcugucccgcauccccgacgagaacugccagaucaaccgguacgggcacuuccaggccacgaucaccaucguggagggcauccuggaggugaacaucauccagaugaccgacguccucaugcccgugccguggcccgagagcucccugaucgacuucguggugaccugccagggcagcauccccacggaggucugcaccaucaucuccgacccgaccugcgagaucacccagaacacggugugcagccccgucgacguggacgagaugugccugcucaccgugcgccggaccuucaacggguccggcaccuacugcgucaaccugacgcugggggacgacaccagccucgcgcugaccuccacccugaucagcgugcccgaccgcgaccccgccagcccccuccgcauggccaacuccgcccugaucuccgugggcugccuggccaucuucgucacggugaucagccuccugguguacaagaagcacaaggaguacaacccgaucgagaacucccccgggaacgucgugcggagcaagggccuguccguguuccucaaccgcgcgaaggccgucuucuuccccggcaaccaggagaaggacccccugcugaagaaccaggaguucaagggggugagcuga

SEQ ID NO: 1822 - RNA, 1719 nt, Artificial Sequence
  derived and/or modified sequence opt2 from GPNMB/m__Homo_sapiens__AAH32783
auggagugccucuacuacuuccucggcuuccuccuccucgccgcccgccucccccucgacgccgccaagcgcuuccacgacguccucggcaacgagcgccccuccgccuacaugcgcgagcacaaccagcucaacggcugguccuccgacgagaacgacuggaacgagaagcucuaccccgucuggaagcgcggcgacaugcgcuggaagaacuccuggaagggcggccgcguccaggccguccucaccuccgacucccccgcccucgucggcuccaacaucaccuucgccgucaaccucaucuucccccgcugccagaaggaggacgccaacggcaacaucgucuacgagaagaacugccgcaacgaggccggccucuccgccgaccccuacgucuacaacuggaccgccugguccgaggacuccgacggcgagaacggcaccggccagucccaccacaacgucuuccccgacggcaagcccuucccccaccaccccggcuggcgccgcuggaacuucaucuacgucuuccacacccucggccaguacuuccagaagcucggccgcugcuccguccgcgucuccgucaacaccgccaacgucacccucggcccccagcucauggaggucaccgucuaccgccgccacggccgcgccuacguccccaucgcccaggucaaggacgucuacgucgucaccgaccagauccccgucuucgucaccauguuccagaagaacgaccgcaacuccuccgacgagaccuuccucaaggaccuccccaucauguucgacguccucauccacgaccccucccacuuccucaacuacuccaccaucaacuacaagugguccuucggcgacaacaccggccucuucgucuccaccaaccacaccgucaaccacaccuacguccucaacggcaccuucucccucaaccucaccgucaaggccgccgcccccggccccugcccccccccccccccccccccccgccccuccaagcccacccccucccucgccaccacccucaaguccuacgacuccaacacccccggccccgccggcgacaacccccucgagcucucccgcauccccgacgagaacugccagaucaaccgcuacggccacuuccaggccaccaucaccaucgucgagggcauccucgaggucaacaucauccagaugaccgacguccucaugcccguccccuggcccgaguccucccucaucgacuucgucgucaccugccagggcuccauccccaccgaggucugcaccaucaucuccgaccccaccugcgagaucacccagaacaccgucugcucccccgucgacgucgacgagaugugccuccucaccguccgccgcaccuucaacggcuccggcaccuacugcgucaaccucacccucggcgacgacaccucccucgcccucaccuccacccucaucuccguccccgaccgcgaccccgccuccccccuccgcauggccaacuccgcccucaucuccgucggcugccucgccaucuucgucaccgucaucucccuccucgucuacaagaagcacaaggaguacaaccccaucgagaacucccccggcaacgucguccgcuccaagggccucuccgucuuccucaaccgcgccaaggccgucuucuuccccggcaaccaggagaaggacccccuccucaagaaccaggaguucaagggcgucuccuga

SEQ ID NO: 1823 - RNA, 1719 nt, Artificial Sequence
  derived and/or modified sequence opt3 from GPNMB/m__Homo_sapiens__AAH32783
auggagugccuguacuauuuccucggcuuucuucuguuggccgcuagauuaccccuggacgcagccaagagguuccacgaugugcuagggaacgaacggccuagcgcguacaugcgcgagcauaaucagcucaacggaugguccucugacgaaaaugauuggaacgagaaacuguauccagucuggaagcgaggugacaugcguuggaaaaauucauggaagggcgggagaguucaagcugugcuuaccagugauagcccggcccugguaggauccaacaucacauuugcagugaauuugauuuuccccaggugucagaaagaagacgccaacggcaauauagucuacgagaagaacugccggaaugaggcuggucucucugcagauccuuauguguacaacuggacugccuggucggaagacucagauggggagaauggaacgggccagagccaccauaacguuuuuccagacggcaagcccuucccucaccauccaggguggcgcagauggaauuuuaucuauguguuccacacccugggacaguacuuucaaaaacuggguagguguaguguccggguguccguaaacacagcuaacguuacucucggcccccaguuaauggaagugaccgucuaccgccgacacgggagagccuaugugccuauugcgcaagugaaggaugucuacguugugacagaccagaucccaguauucgugaccauguuucagaaaaaugauaggaacucuagcgacgagacuuuccugaaggaccuuccgauuauguuugaugucuugauccaugaccccucccacuuccugaauuauucaacaauaaacuacaaauggaguuucggagauaauaccggccuauuugugagcacgaaccauacuguuaaucacaccuaugugcucaacgguacauucucucugaaucuuacugucaaggcagccgcuccugggccaugucccccuccacccccgccuccccggccauccaagccuacccccucacuggccacaaccuugaaaagcuacgacaguaacacgccaggacccgcaggcgauaauccucucgagcugucucguaucccagacgaaaacugccagauuaaucgcuauggccacuuucaggcuacuaucacaauuguggaggggaucuuagaaguaaacauaauucagaugaccgauguucugaugccggugcccuggccugaguccagccucaucgacuucgucgugacuugccaaggaucgauuccaacagaagucuguaccaucaucucugaucccacgugcgagauuacccagaauacaguguguuccccuguugacguggaugagaugugccuucugacuguaagaaggaccuuuaacgguucaggcacauacugugucaacuugacucuaggggacgacaccagucuggcccucacaagcacccugauauccgugccagaucgggaccccgcgucuccgcuucgaauggccaauagcgcacugaucucaguuggaugcuuggcuauuuucgugacugucaucagucuccugguguacaagaaacauaaggaauauaacccuauagaaaauuccccaggcaacguagugcgcagcaaagguuuaucuguuuuucugaauagagccaaggcugucuucuuucccgggaaccaggagaaagauccucuacucaagaaucaagaguucaagggcgugucauga

SEQ ID NO: 1824 - RNA, 1719 nt, Artificial Sequence
  derived and/or modified sequence opt4 from GPNMB/m__Homo_sapiens__AAH32783
auggagugccuguacuacuuccugggcuuccugcugcuggccgccagacugccccuggacgccgccaagagauuccacgacgugcugggcaacgagagacccagcgccuacaugagagagcacaaccagcugaacggcuggagcagcgacgagaacgacuggaacgagaagcuguaccccguguggaagagaggcgacaugagauggaagaacagcuggaagggcggcagagugcaggccgugcugaccagcgacagccccgcccuggugggcagcaacaucaccuucgccgugaaccugaucuuccccagaugccagaaggaggacgccaacggcaacaucguguacgagaagaacugcagaaacgaggccggccugagcgccgaccccuacguguacaacuggaccgccuggagcgaggacagcgacggcgagaacggcaccggccagagccaccacaacguguuccccgacggcaagcccuucccccaccaccccggcuggagaagauggaacuucaucuacguguuccacacccugggccaguacuuccagaagcugggcagaugcagcgugagagugagcgugaacaccgccaacgugacccugggcccccagcugauggaggugaccguguacagaagacacggcagagccuacgugcccaucgcccaggugaaggacguguacguggugaccgaccagauccccguguucgugaccauguuccagaagaacgacagaaacagcagcgacgagaccuuccugaaggaccugcccaucauguucgacgugcugauccacgaccccagccacuuccugaacuacagcaccaucaacuacaaguggagcuucggcgacaacaccggccuguucgugagcaccaaccacaccgugaaccacaccuacgugcugaacggcaccuucagccugaaccugaccgugaaggccgccgcccccggccccugccccccccccccccccccccccagacccagcaagcccacccccagccuggccaccacccugaagagcuacgacagcaacacccccggccccgccggcgacaacccccuggagcugagcagaauccccgacgagaacugccagaucaacagauacggccacuuccaggccaccaucaccaucguggagggcauccuggaggugaacaucauccagaugaccgacgugcugaugcccgugcccuggcccgagagcagccugaucgacuucguggugaccugccagggcagcauccccaccgaggugugcaccaucaucagcgaccccaccugcgagaucacccagaacaccgugugcagccccguggacguggacgagaugugccugcugaccgugagaagaaccuucaacggcagcggcaccuacugcgugaaccugacccugggcgacgacaccagccuggcccugaccagcacccugaucagcgugcccgacagagaccccgccagcccccugagaauggccaacagcgcccugaucagcgugggcugccuggccaucuucgugaccgugaucagccugcugguguacaagaagcacaaggaguacaaccccaucgagaacagccccggcaacguggugagaagcaagggccugagcguguuccugaacagagccaaggccguguucuuccccggcaaccaggagaaggacccccugcugaagaaccaggaguucaagggcgugagcuga

SEQ ID NO: 1825 - RNA, 1719 nt, Artificial Sequence
  derived and/or modified sequence opt5 from GPNMB/m__Homo_sapiens__AAH32783
auggagugccuguacuauuuccucggcuuucugcuucuggccgcuagacucccccuggacgccgcgaagcgguuccacgaugugcuugggaacgaacgcccuagcgcuuacaugagagagcauaaucagcugaacggaugguccucugacgaaaaugauuggaacgagaaacucuauccggucuggaagcggggcgacaugcgcuggaaaaauagcuggaaagggggaagaguucaagccgugcugaccuccgauucucccgcccuggugggcagcaacaucacauuugcugucaaucucauuuucccucggugucagaaagaagacgccaacgggaauaucguguacgagaagaacugccgcaaugaggcuggacuguccgccgaucccuauguuuacaacuggacggcguggucugaagacagcgauggcgagaauggcaccgggcagucccaccauaacguguuuccugacggaaagcccuucccucaccauccgggcuggagacgguggaauuuuauuuaugucuuccacacacuugggcaguacuuucaaaaacugggacgcuguagcgugagaguuucugugaacaccgccaacgucacacucggcccccagcugauggaagugaccguguaccggcgccacgggagagcuuaugucccuaucgcccagguuaaggauguguacguggucacagaccagauucccguguucguuaccauguuucaaaagaaugaucggaacuccagcgacgagacguuccuuaaggaccugccuaucauguuugaugugcucauccaugaccccucucacuuccugaauuauuccaccauuaacuacaaauggagcuucggagauaauacaggccuguuugucucuaccaaccauacagugaaucacaccuauguucucaacggcacguucucccugaaucuuacagugaaggcugccgcgccggggccuugucccccucccccucccccgccccgcccuagcaagcccaccccuucccuggccacaacccucaaaucuuacgacagcaacacccccggaccggcuggcgauaauccucuggagcuuuccagaauccccgacgaaaacugccagauuaaucgguaugggcacuuucaggccacaaucacgauugucgagggaauccuggaagugaacauuauccagaugaccgauguccucaugccugugcccuggccugagagcucucugaucgacuucguugugacaugccaaggcuccauucccaccgaagucuguacaaucauuagcgauccgaccugcgagaucacgcagaauacaguguguucuccuguugacguggaugagaugugccugcucaccgucagacgcaccuuuaacgggagcggaacauacugugugaaccugacccuuggcgacgacacaucccuggcucucacgucuacccugauuagcgugcccgaucgggaccccgccuccccucuuagaauggccaauagcgcucugaucucuguuggcugccucgcgaucuucgucacagugauuucccugcugguguacaagaaacauaaggaauauaacccgaucgagaauagccccgggaacgucgugcgcucuaaaggacucuccguuuuucugaaucgggccaaggcuguguucuuuccuggcaaccaggaaaaagauccccuucugaagaaucaagaguucaagggggucagcuga

SEQ ID NO: 1826 - protein, 206 aa, Artificial Sequence [sequence omitted]

SEQ ID NO: 1827 - RNA, 621 nt, Artificial Sequence
  GPNMB/m__Homo_sapiens__CAD43718
auggaaugucucuacuauuuccugggauuucugcuccuggcugcaagauugccacuugaugccgccaaacgauuucaugaugugcugggcaaugaaagaccuucugcuuacaugagggagcacaaucaauuaaauggcuggucuucugaugaaaaugacuggaaugaaaaacucuacccaguguggaagcggggagacaugagguggaaaaacuccuggaagggaggccgugugcaggcgguccugaccagugacucaccagcccucgugggcucaaauauaacauuugcggugaaccugauauucccuagaugccaaaaggaagaugccaauggcaacauagucuaugagaagaacugcagaaaugaggcugguuuaucugcugauccguauguuuacaacuggacagcauggucagaggacagugacggggaaaauggcaccggccaaagccaucauaacgucuucccugaugggaaaccuuuuccucaccaccccggauggagaagauggaauuucaucuacgucuuccacacacuugauuggcuuuuacaaaccccuaagcuucuucuuuaccuuuccuuaaaauuucaaccuucucuuuucuuacucuauaauuga

SEQ ID NO: 1828 - RNA, 621 nt, Artificial Sequence
  derived and/or modified sequence opt1 from GPNMB/m__Homo_sapiens__CAD43718
auggagugccuguacuacuuccucggcuuccugcugcucgccgcccgccugccccuggacgcggccaagcgguuccacgacgugcucgggaacgagcgcccgagcgccuacaugcgggagcacaaccagcugaacggcugguccagcgacgagaacgacuggaacgagaagcuguaccccgucuggaagcgcggggacaugcgguggaagaacuccuggaagggcgggcgcgugcaggccgugcucaccagcgacucccccgcccuggucggcagcaacaucaccuucgcggugaaccugaucuucccccggugccagaaggaggacgccaacggcaacaucguguacgagaagaacugccgcaacgaggccgggcucuccgccgacccguacgucuacaacuggacggcguggagcgaggacuccgacggcgagaacgggaccggccagagccaccacaacguguuccccgacgggaagcccuucccccaccacccgggcuggcggcgcuggaacuucaucuacguguuccacacccuggacuggcugcuccagacccccaagcugcugcucuaccugucccugaaguuccagcccagccucuuccugcuguacaacuga

SEQ ID NO: 1829 - RNA, 621 nt, Artificial Sequence
  derived and/or modified sequence opt2 from GPNMB/m__Homo_sapiens__CAD43718
auggagugccucuacuacuuccucggcuuccuccuccucgccgcccgccucccccucgacgccgccaagcgcuuccacgacguccucggcaacgagcgccccuccgccuacaugcgcgagcacaaccagcucaacggcugguccuccgacgagaacgacuggaacgagaagcucuaccccgucuggaagcgcggcgacaugcgcuggaagaacuccuggaagggcggccgcguccaggccguccucaccuccgacucccccgcccucgucggcuccaacaucaccuucgccgucaaccucaucuucccccgcugccagaaggaggacgccaacggcaacaucgucuacgagaagaacugccgcaacgaggccggccucuccgccgaccccuacgucuacaacuggaccgccugguccgaggacuccgacggcgagaacggcaccggccagucccaccacaacgucuuccccgacggcaagcccuucccccaccaccccggcuggcgccgcuggaacuucaucuacgucuuccacacccucgacuggcuccuccagacccccaagcuccuccucuaccucucccucaaguuccagcccucccucuuccuccucuacaacuga

SEQ ID NO: 1830 - RNA, 621 nt, Artificial Sequence
  derived and/or modified sequence opt3 from GPNMB/m__Homo_sapiens__CAD43718
auggagugccuguacuauuuccucggcuuucuucuguuggccgcuagauuaccccuggacgcagccaagagguuccacgaugugcuagggaacgaacggccuagcgcguacaugcgcgagcauaaucagcucaacggaugguccucugacgaaaaugauuggaacgagaaacuguauccagucuggaagcgaggugacaugcguuggaaaaauucauggaagggcgggagaguucaagcugugcuuaccagugauagcccggcccugguaggauccaacaucacauuugcagugaauuugauuuuccccaggugucagaaagaagacgccaacggcaauauagucuacgagaagaacugccggaaugaggcuggucucucugcagauccuuauguguacaacuggacugccuggucggaagacucagauggggagaauggaacgggccagagccaccauaacguuuuuccagacggcaagcccuucccucaccauccaggguggcgcagauggaauuuuaucuauguguuccacacccuggauuggcugcuccagacacccaaauuacugcuuuacuugagucugaaguuucaaccuucccuauuccuccuguacaacuga

SEQ ID NO: 1831 - RNA, 621 nt, Artificial Sequence
  derived and/or modified sequence opt4 from GPNMB/m__Homo_sapiens__CAD43718
auggagugccuguacuacuuccugggcuuccugcugcuggccgccagacugccccuggacgccgccaagagauuccacgacgugcugggcaacgagagacccagcgccuacaugagagagcacaaccagcugaacggcuggagcagcgacgagaacgacuggaacgagaagcuguaccccguguggaagagaggcgacaugagauggaagaacagcuggaagggcggcagagugcaggccgugcugaccagcgacagccccgcccuggugggcagcaacaucaccuucgccgugaaccugaucuuccccagaugccagaaggaggacgccaacggcaacaucguguacgagaagaacugcagaaacgaggccggccugagcgccgaccccuacguguacaacuggaccgccuggagcgaggacagcgacggcgagaacggcaccggccagagccaccacaacguguuccccgacggcaagcccuucccccaccaccccggcuggagaagauggaacuucaucuacguguuccacacccuggacuggcugcugcagacccccaagcugcugcuguaccugagccugaaguuccagcccagccuguuccugcuguacaacuga

SEQ ID NO: 1832 - RNA, 621 nt, Artificial Sequence
  derived and/or modified sequence opt5 from GPNMB/m__Homo_sapiens__CAD43718
auggagugccuguacuauuuccucggcuuucugcuucuggccgcuagacucccccuggacgccgcgaagcgguuccacgaugugcuugggaacgaacgcccuagcgcuuacaugagagagcauaaucagcugaacggaugguccucugacgaaaaugauuggaacgagaaacucuauccggucuggaagcggggcgacaugcgcuggaaaaauagcuggaaagggggaagaguucaagccgugcugaccuccgauucucccgcccuggugggcagcaacaucacauuugcugucaaucucauuuucccucggugucagaaggaagacgccaacgggaauaucguguacgagaagaacugccgcaaugaggcuggacuguccgccgaucccuauguuuacaacuggacggcguggucugaagacagcgauggcgagaauggcaccgggcagucccaccauaacguguuuccugacggaaagcccuucccucaccauccgggcuggagacgguggaauuuuauuuaugucuuccacacacuugauuggcugcuccagacccccaaacugcuucuguaccucagccugaaguuucaaccuucucuguuccuccuguacaacuga

SEQ ID NO: 1833 - protein, 206 aa, Artificial Sequence
  GPNMB/m__Homo_sapiens__Q96F58
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGWLLQTPKLLLYLSLKFQPSLFLLYN

SEQ ID NO: 1834 - RNA, 621 nt, Artificial Sequence
  GPNMB/m__Homo_sapiens__AAH11595
auggaaugucucuacuauuuccugggauuucugcuccuggcugcaagauugccacuugaugccgccaaacgauuucaugaugugcugggcaaugaaagaccuucugcuuacaugagggagcacaaucaauuaaauggcuggucuucugaugaaaaugacuggaaugaaaaacucuacccaguguggaagcggggagacaugagguggaaaaacuccuggaagggaggccgugugcaggcgguccugaccagugacucaccagcccucgugggcucaaauauaacauuugcggugaaccugauauucccuagaugccaaaaggaagaugccaauggcaacauagucuaugagaagaacugcagaaaugaggcugguuuaucugcugauccauauguuuacaacuggacagcauggucagaggacagugacggggaaaauggcaccggccaaagccaucauaacgucuucccugaugggaaaccuuuuccucaccaccccggauggagaagauggaauuucaucuacgucuuccacacacuugguuggcuuuuacaaaccccuaagcuucuucuuuaccuuuccuuaaaauuucaaccuucucuuuucuuacucuauaauuga

SEQ ID NO: 1835 - RNA, 621 nt, Artificial Sequence
  derived and/or modified sequence opt1 from GPNMB/m__Homo_sapiens__AAH11595
auggagugccuguacuacuuccucggcuuccugcugcucgccgcccgccugccccuggacgcggccaagcgguuccacgacgugcucgggaacgagcgcccgagcgccuacaugcgggagcacaaccagcugaacggcugguccagcgacgagaacgacuggaacgagaagcuguaccccgucuggaagcgcggggacaugcgguggaagaacuccuggaagggcgggcgcgugcaggccgugcucaccagcgacucccccgcccuggucggcagcaacaucaccuucgcggugaaccugaucuucccccggugccagaaggaggacgccaacggcaacaucguguacgagaagaacugccgcaacgaggccgggcucuccgccgacccguacgucuacaacuggacggcguggagcgaggacuccgacggcgagaacgggaccggccagagccaccacaacguguuccccgacgggaagcccuucccccaccacccgggcuggcggcgcuggaacuucaucuacguguuccacacccugggcuggcugcuccagacccccaagcugcugcucuaccugucccugaaguuccagcccagccucuuccugcuguacaacuga

SEQ ID NO: 1836 - RNA, 621 nt, Artificial Sequence
  derived and/or modified sequence opt2 from GPNMB/m__Homo_sapiens__AAH11595
auggagugccucuacuacuuccucggcuuccuccuccucgccgcccgccucccccucgacgccgccaagcgcuuccacgacguccucggcaacgagcgccccuccgccuacaugcgcgagcacaaccagcucaacggcugguccuccgacgagaacgacuggaacgagaagcucuaccccgucuggaagcgcggcgacaugcgcuggaagaacuccuggaagggcggccgcguccaggccguccucaccuccgacucccccgcccucgucggcuccaacaucaccuucgccgucaaccucaucuucccccgcugccagaaggaggacgccaacggcaacaucgucuacgagaagaacugccgcaacgaggccggccucuccgccgaccccuacgucuacaacuggaccgccugguccgaggacuccgacggcgagaacggcaccggccagucccaccacaacgucuuccccgacggcaagcccuucccccaccaccccggcuggcgccgcuggaacuucaucuacgucuuccacacccucggcuggcuccuccagacccccaagcuccuccucuaccucucccucaaguuccagcccucccucuuccuccucuacaacuga

SEQ ID NO: 1837 - RNA, 621 nt, Artificial Sequence
  derived and/or modified sequence opt3 from GPNMB/m__Homo_sapiens__AAH11595
auggagugccuguacuauuuccucggcuuucuucuguuggccgcuagauuaccccuggacgcagccaagagguuccacgaugugcuagggaacgaacggccuagcgcguacaugcgcgagcauaaucagcucaacggaugguccucugacgaaaaugauuggaacgagaaacuguauccagucuggaagcgaggugacaugcguuggaaaaauucauggaagggcgggagaguucaagcugugcuuaccagugauagcccggcccugguaggauccaacaucacauuugcagugaauuugauuuuccccaggugucagaaagaagacgccaacggcaauauagucuacgagaagaacugccggaaugaggcuggucucucugcagauccuuauguguacaacuggacugccuggucggaagacucagauggggagaauggaacgggccagagccaccauaacguuuuuccagacggcaagcccuucccucaccauccaggguggcgcagauggaauuuuaucuauguguuccacacccugggauggcugcuccagacacccaaauuacugcuuuacuugagucugaaguuucaaccuucccuauuccuccuguacaacuga

SEQ ID NO: 1838 - RNA, 621 nt, Artificial Sequence
  derived and/or modified sequence opt4 from GPNMB/m__Homo_sapiens__AAH11595
auggagugccuguacuacuuccugggcuuccugcugcuggccgccagacugccccuggacgccgccaagagauuccacgacgugcugggcaacgagagacccagcgccuacaugagagagcacaaccagcugaacggcuggagcagcgacgagaacgacuggaacgagaagcuguaccccguguggaagagaggcgacaugagauggaagaacagcuggaagggcggcagagugcaggccgugcugaccagcgacagccccgcccuggugggcagcaacaucaccuucgccgugaaccugaucuuccccagaugccagaaggaggacgccaacggcaacaucguguacgagaagaacugcagaaacgaggccggccugagcgccgaccccuacguguacaacuggaccgccuggagcgaggacagcgacggcgagaacggcaccggccagagccaccacaacguguuccccgacggcaagcccuucccccaccaccccggcuggagaagauggaacuucaucuacguguuccacacccugggcuggcugcugcagacccccaagcugcugcuguaccugagccugaaguuccagcccagccuguuccugcuguacaacuga

SEQ ID NO: 1839 - RNA, 621 nt, Artificial Sequence
  derived and/or modified sequence opt5 from GPNMB/m__Homo_sapiens__AAH11595
auggagugccuguacuauuuccucggcuuucugcuucuggccgcuagacucccccuggacgccgcgaagcgguuccacgaugugcuugggaacgaacgcccuagcgcuuacaugagagagcauaaucagcugaacggaugguccucugacgaaaaugauuggaacgagaaacucuauccggucuggaagcggggcgacaugcgcuggaaaaauagcuggaaagggggaagaguucaagccgugcugaccuccgauucucccgcccuggugggcagcaacaucacauuugcugucaaucucauuuucccucggugucagaaggaagacgccaacgggaauaucguguacgagaagaacugccgcaaugaggcuggacuguccgccgaucccuauguuuacaacuggacggcguggucugaagacagcgauggcgagaauggcaccgggcagucccaccauaacguguuuccugacggaaagcccuucccucaccauccgggcuggagacgguggaauuuuauuuaugucuuccacacacuuggguggcugcuccagacccccaaacugcuucuguaccucagccugaaguuucaaccuucucuguuccuccuguacaacuga

SEQ ID NO: 1840 - protein, 879 aa, Artificial Sequence
  GRM3__Homo_sapiens__Q14832
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 1841 - RNA, 2640 nt, Artificial Sequence
  GRM3__Homo_sapiens__CCDS5600.1
augaagauguugacaagacugcaaguucuuaccuuagcuuuguuuucaaagggauuuuuacucucuuuaggggaccauaacuuucuaaggagagagauuaaaauagaaggugaccuuguuuuagggggccuguuuccuauuaacgaaaaaggcacuggaacugaagaaugugggcgaaucaaugaagaccgagggauucaacgccuggaagccauguuguuugcuauugaugaaaucaacaaagaugauuacuugcuaccaggagugaaguuggguguucacauuuuggauacauguucaagggauaccuaugcauuggagcaaucacuggaguuugucagggcaucuuugacaaaaguggaugaagcugaguauauguguccugauggauccuaugccauucaagaaaacaucccacuucucauugcaggggucauugguggcucuuauagcaguguuuccauacagguggcaaaccugcugcggcucuuccagaucccucagaucagcuacgcauccaccagcgccaaacucagugauaagucgcgcuaugauuacuuugccaggaccgugccccccgacuucuaccaggccaaagccauggcugagaucuugcgcuucuucaacuggaccuacguguccacaguagccuccgagggugauuacggggagacagggaucgaggccuucgagcaggaagcccgccugcgcaacaucugcaucgcuacggcggagaaggugggccgcuccaacauccgcaaguccuacgacagcgugauccgagaacuguugcagaagcccaacgcgcgcgucgugguccucuucaugcgcagcgacgacucgcgggagcucauugcagccgccagccgcgccaaugccuccuucaccuggguggccagcgacggcuggggcgcgcaggagagcaucaucaagggcagcgagcauguggccuacggcgccaucacccuggagcuggccucccagccuguccgccaguucgaccgcuacuuccagagccucaaccccuacaacaaccaccgcaaccccugguuccgggacuucugggagcaaaaguuucagugcagccuccagaacaaacgcaaccacaggcgcgucugcgacaagcaccuggccaucgacagcagcaacuacgagcaagaguccaagaucauguuuguggugaacgcgguguaugccauggcccacgcuuugcacaaaaugcagcgcacccucugucccaacacuaccaagcuuugugaugcuaugaagauccuggaugggaagaaguuguacaaggauuacuugcugaaaaucaacuucacggcuccauucaacccaaauaaagaugcagauagcauagucaaguuugacacuuuuggagauggaauggggcgauacaacguguucaauuuccaaaauguagguggaaaguauuccuacuugaaaguuggucacugggcagaaaccuuaucgcuagaugucaacucuauccacuggucccggaacucaguccccacuucccagugcagcgaccccugugcccccaaugaaaugaagaauaugcaaccaggggaugucugcugcuggauuugcauccccugugaacccuacgaauaccuggcugaugaguuuaccuguauggauugugggucuggacaguggcccacugcagaccuaacuggaugcuaugaccuuccugaggacuacaucaggugggaagacgccugggccauuggcccagucaccauugccugucuggguuuuauguguacaugcaugguuguaacuguuuuuaucaagcacaacaacacacccuuggucaaagcaucgggccgagaacucugcuacaucuuauuguuugggguuggccugucauacugcaugacauucuucuucauugccaagccaucaccagucaucugugcauugcgccgacucgggcuggggaguuccuucgcuaucuguuacucagcccugcugaccaagacaaacugcauugcccgcaucuucgauggggucaagaauggcgcucagaggccaaaauucaucagccccaguucucagguuuucaucugccugggucugauccuggugcaaauugugauggugucuguguggcucauccuggaggccccaggcaccaggagguauacccuugcagagaagcgggaaacagucauccuaaaaugcaaugucaaagauuccagcauguugaucucucuuaccuacgaugugauccuggugaucuuaugcacuguguacgccuucaaaacgcggaagugcccagaaaauuucaacgaagcuaaguucauagguuuuaccauguacaccacgugcaucaucugguuggccuuccucccuauauuuuaugugacaucaagugacuacagagugcagacgacaaccaugugcaucucugucagccugaguggcuuuguggucuugggcuguuuguuugcacccaagguucacaucauccuguuucaaccccagaagaauguugucacacacagacugcaccucaacagguucagugucaguggaacugggaccacauacucucaguccucugcaagcacguaugugccaacggugugcaaugggcgggaaguccucgacuccaccaccucaucucuguga

SEQ ID NO: 1842 - RNA, 2640 nt, Artificial Sequence
  derived and/or modified sequence opt1 from GRM3__Homo_sapiens__CCDS5600.1
augaagaugcugacccgccuccaggugcugacccuggcccucuucagcaagggcuuccugcugucccucggggaccacaacuuccugcggcgcgagaucaagaucgagggcgaccugguccucgggggccuguuccccaucaacgagaaggggacgggcaccgaggagugcggccggaucaacgaggaccgcgggauccagcggcuggaggccaugcuguucgcgaucgacgagaucaacaaggacgacuaccuccugccgggcgugaagcucggggugcacauccuggacacgugcagccgcgacaccuacgcccuggagcagucccucgaguucguccgggccagccugaccaagguggacgaggccgaguacaugugccccgacggcuccuacgccauccaggagaacaucccccugcucaucgcgggggugaucggcggcagcuacuccagcgucuccauccagguggccaaccugcugcgccucuuccagaucccccagaucagcuacgccuccaccagcgccaagcuguccgacaagagccgguacgacuacuucgcgcgcaccgugccgcccgacuucuaccaggccaaggccauggccgagauccugcgguucuucaacuggaccuacgucuccacgguggccagcgagggggacuacggcgagaccgggaucgaggcguucgagcaggaggcccgccuccggaacaucugcaucgccaccgccgagaaggugggccgcuccaacauccgcaagagcuacgacuccgucauccgggagcugcugcagaagcccaacgcccggguggugguccucuucaugcgcagcgacgacagccgggagcugaucgcggccgccucccgcgccaacgccagcuucaccuggguggcguccgacggcuggggcgcccaggagagcaucaucaagggguccgagcacguggccuacggggccaucacgcuggagcucgccagccagcccguccggcaguucgaccgcuacuuccagucccugaacccguacaacaaccaccgcaaccccugguuccgggacuucugggagcagaaguuccagugcagccugcagaacaagcgcaaccaccggcgcgugugcgacaagcaccucgcgaucgacuccagcaacuacgagcaggaguccaagaucauguucguggucaacgccguguacgccauggcccacgcgcugcacaagaugcagcggacccugugccccaacaccaccaagcucugcgacgccaugaagauccuggacggcaagaagcuguacaaggacuaccuccugaagaucaacuucacggcccccuucaacccgaacaaggacgccgacagcaucgugaaguucgacaccuucggggacggcaugggccgcuacaacgucuucaacuuccagaacgucgggggcaaguacuccuaccugaagguggggcacugggccgagacccucagccuggacgugaacuccauccacuggagccggaacuccgugcccaccagccagugcuccgaccccugcgcgcccaacgagaugaagaacaugcagccgggcgacgucugcugcuggaucugcauccccugcgagcccuacgaguaccuggccgacgaguucacgugcauggacugcgggagcggccaguggcccaccgccgaccucaccggcugcuacgaccugccggaggacuacauccgcugggaggacgccugggccaucgggcccgugaccaucgcgugccugggcuucaugugcacgugcaugguggucaccguguucaucaagcacaacaacacgccccuggugaaggccagcgggcgggagcucugcuacauccugcuguucggcgucgggcucuccuacugcaugaccuucuucuucaucgccaagcccagcccggugaucugcgcccugcgccggcugggccucggcuccagcuucgccaucugcuacuccgcgcugcugaccaagaccaacugcaucgcccgcaucuucgacggggugaagaacggcgcccagcggcccaaguucaucagccccuccagccaggucuucaucugccucgggcugauccuggugcagaucgugauggucuccguguggcucauccuggaggcccccggcacccgccgguacacccuggcggagaagcgcgagacggugauccucaagugcaacgucaaggacagcuccaugcugaucagccugaccuacgacgugauccucgugauccugugcaccgucuacgccuucaagacccggaagugcccggagaacuucaacgaggccaaguucaucggcuucacgauguacacgaccugcaucaucuggcuggccuuccuccccaucuucuacgugaccuccagcgacuaccgcgugcagaccaccaccaugugcaucuccgucagccuguccggguucguggugcugggcugccucuucgcccccaagguccacaucauccuguuccagccgcagaagaacguggugacccaccggcugcaccucaaccgcuucagcgucagcgggaccggcacgaccuacucccagagcuccgcgagcaccuacgugcccaccgugugcaacgggcgcgagguccuggacuccacgaccagcucccuguga

SEQ ID NO: 1843 - RNA, 2640 nt, Artificial Sequence
  derived and/or modified sequence opt2 from GRM3__Homo_sapiens__CCDS5600.1
augaagaugcucacccgccuccagguccucacccucgcccucuucuccaagggcuuccuccucucccucggcgaccacaacuuccuccgccgcgagaucaagaucgagggcgaccucguccucggcggccucuuccccaucaacgagaagggcaccggcaccgaggagugcggccgcaucaacgaggaccgcggcauccagcgccucgaggccaugcucuucgccaucgacgagaucaacaaggacgacuaccuccuccccggcgucaagcucggcguccacauccucgacaccugcucccgcgacaccuacgcccucgagcagucccucgaguucguccgcgccucccucaccaaggucgacgaggccgaguacaugugccccgacggcuccuacgccauccaggagaacaucccccuccucaucgccggcgucaucggcggcuccuacuccuccgucuccauccaggucgccaaccuccuccgccucuuccagaucccccagaucuccuacgccuccaccuccgccaagcucuccgacaagucccgcuacgacuacuucgcccgcaccgucccccccgacuucuaccaggccaaggccauggccgagauccuccgcuucuucaacuggaccuacgucuccaccgucgccuccgagggcgacuacggcgagaccggcaucgaggccuucgagcaggaggcccgccuccgcaacaucugcaucgccaccgccgagaaggucggccgcuccaacauccgcaaguccuacgacuccgucauccgcgagcuccuccagaagcccaacgcccgcgucgucguccucuucaugcgcuccgacgacucccgcgagcucaucgccgccgccucccgcgccaacgccuccuucaccugggucgccuccgacggcuggggcgcccaggaguccaucaucaagggcuccgagcacgucgccuacggcgccaucacccucgagcucgccucccagcccguccgccaguucgaccgcuacuuccagucccucaaccccuacaacaaccaccgcaaccccugguuccgcgacuucugggagcagaaguuccagugcucccuccagaacaagcgcaaccaccgccgcgucugcgacaagcaccucgccaucgacuccuccaacuacgagcaggaguccaagaucauguucgucgucaacgccgucuacgccauggcccacgcccuccacaagaugcagcgcacccucugccccaacaccaccaagcucugcgacgccaugaagauccucgacggcaagaagcucuacaaggacuaccuccucaagaucaacuucaccgcccccuucaaccccaacaaggacgccgacuccaucgucaaguucgacaccuucggcgacggcaugggccgcuacaacgucuucaacuuccagaacgucggcggcaaguacuccuaccucaaggucggccacugggccgagacccucucccucgacgucaacuccauccacuggucccgcaacuccguccccaccucccagugcuccgaccccugcgcccccaacgagaugaagaacaugcagcccggcgacgucugcugcuggaucugcauccccugcgagcccuacgaguaccucgccgacgaguucaccugcauggacugcggcuccggccaguggcccaccgccgaccucaccggcugcuacgaccuccccgaggacuacauccgcugggaggacgccugggccaucggccccgucaccaucgccugccucggcuucaugugcaccugcauggucgucaccgucuucaucaagcacaacaacaccccccucgucaaggccuccggccgcgagcucugcuacauccuccucuucggcgucggccucuccuacugcaugaccuucuucuucaucgccaagcccucccccgucaucugcgcccuccgccgccucggccucggcuccuccuucgccaucugcuacuccgcccuccucaccaagaccaacugcaucgcccgcaucuucgacggcgucaagaacggcgcccagcgccccaaguucaucucccccuccucccaggucuucaucugccucggccucauccucguccagaucgucauggucuccgucuggcucauccucgaggcccccggcacccgccgcuacacccucgccgagaagcgcgagaccgucauccucaagugcaacgucaaggacuccuccaugcucaucucccucaccuacgacgucauccucgucauccucugcaccgucuacgccuucaagacccgcaagugccccgagaacuucaacgaggccaaguucaucggcuucaccauguacaccaccugcaucaucuggcucgccuuccuccccaucuucuacgucaccuccuccgacuaccgcguccagaccaccaccaugugcaucuccgucucccucuccggcuucgucguccucggcugccucuucgcccccaagguccacaucauccucuuccagccccagaagaacgucgucacccaccgccuccaccucaaccgcuucuccgucuccggcaccggcaccaccuacucccaguccuccgccuccaccuacguccccaccgucugcaacggccgcgagguccucgacuccaccaccuccucccucuga

SEQ ID NO: 1844 - RNA, 2640 nt, Artificial Sequence
  derived and/or modified sequence opt3 from GRM3__Homo_sapiens__CCDS5600.1
augaagaugcugaccagacuccaggugcuuacacuggccuuguucagcaaaggcuuuuuacugucccuaggggaccacaacuuccucaggcgggagaucaagauugaaggagaucugguccuugguggccuguuucccauaaaugagaaagggacuggaacggaagagugcggccgcaucaacgaagaccgagguauucaacguuuggaggcuaugcuguucgcaaucgaugagauuaauaaggacgauuaccuccugccugggguuaaacucggagugcauaucuuagacaccuguucuagagauacauaugcccuggaacagucacuugaguuuguaagggcgaguuugacuaagguggacgaagcugaguacaugugcccagauggcagcuaugccauacaggagaacaucccgcugcuaauugcaggcgucaucgggggauccuacucuucggugucaauucagguugccaaucuccugcggcuuuuccaaaucccccagauaagcuaugcuaguaccuccgcaaagcugucugacaaaagccgcuacgauuauuuugccagaacagugccuccagacuucuaccaggcuaaggccauggcggaaauuuugagguuuuucaacuggaccuacgucuccacuguggcaucagagggugauuauggcgaaacagggaucgaggccuuugaacaggaggcucggcuccgcaauauuuguaucgccaccgcagagaaaguaggacgaaguaacaucagaaagagcuacgacucuguuauuagggaacuguuacaaaaacccaaugcucggguggucgugcuguucaugcguuccgacgauucacgcgagcucauagccgcggccagcagagcaaacgcuaguuuuacguggguggccucugacggcuggggugcucaggaauccaucauuaaggggagcgagcacgucgccuauggagcaaucacucuugaacuggccucgcagccuguuaggcaguucgaucgguacuuccaaucuuugaauccauauaacaaucaucgaaaccccugguuucgcgacuucugggagcagaaguuucagugcucccuacaaaauaaaagaaaccacaggcgggugugugauaagcaucuggcuauagacucaaguaacuacgagcaggaaagcaaaauuauguucguagugaaugcggucuaugcaauggcccacgcucuccacaagaugcagcgcacccugugcccuaacacaacuaaacuuugugaugccaugaagauccuggacggcaaaaaguuguacaaggauuaccuccugaaaaucaauuuuaccgcaccauucaacccgaauaaggacgccgauuccauugugaaauuugacacauucggcgacgggaugggaagauauaacguuuuuaauuuccagaacguggguggcaaguacucuuauuuaaaagucgggcauugggcugagacccugagccuagauguaaauucaauccacuggaguaggaacuccgugcccacgagccaaugcucugacccuugugccccaaaugaaaugaagaacaugcagcccggagauguuugcuguuggauuugcauaccuugcgagccauacgaauaucucgcagacgaguuuacuuguauggauugcggcucaggucaguggcccacagcggaccugaccggguguuacgaucuuccggaggacuauauccguugggaagaugcuugggccauuggcccugugacuaucgcaugcuugggauucauguguacaugcauggucgugaccgucuuuaucaagcauaauaacacgccccuggugaaagccaguggccgggagcucuguuacauucugcuuuucgggguuggacugagcuacugcaugaccuucuuuuucauagcuaagccauccccugugaucugugccuugcgaagacucggucuggggucuucguuugcaauuugcuauagcgcuuuacugacaaaaacuaauuguaucgccaggauuuucgacggcguaaagaacggagcgcagcgccccaaauuuaucuccccaucaagucaagucuucauaugccuaggccucauccuggugcagauuguuauggugucugucuggcuuaucuuggaagcccccgguacccggagauacacacuggcugagaagagggagacugugauucucaagugcaacguaaaagauagcuccaugcugaucucauuaaccuaugacgugauacugguuauucuuuguacagucuacgcauuuaagacccgcaaaugcccugaaaauuucaacgaggccaaguuuaucggguucacuauguauacgacauguauuaucugguuggcuuuucucccaauauucuacgugaccagcucugauuaucgagugcagacuaccacaaugugcaucuccgucagucugagcggcuuuguugugcuaggaugucuguucgccccgaaagugcacauuauccucuuccagccccaaaagaauguagucacccaccggcugcaucuuaaccguuuuucuguguccggcacugggacaacguacucacagaguagcgcaucgaccuacguuccuacugugugcaauggaagagaagucuuggacuccacaaccucuagccuguga

SEQ ID NO: 1845 - RNA, 2640 nt, Artificial Sequence
  derived and/or modified sequence opt4 from GRM3__Homo_sapiens__CCDS5600.1
augaagaugcugaccagacugcaggugcugacccuggcccuguucagcaagggcuuccugcugagccugggcgaccacaacuuccugagaagagagaucaagaucgagggcgaccuggugcugggcggccuguuccccaucaacgagaagggcaccggcaccgaggagugcggcagaaucaacgaggacagaggcauccagagacuggaggccaugcuguucgccaucgacgagaucaacaaggacgacuaccugcugcccggcgugaagcugggcgugcacauccuggacaccugcagcagagacaccuacgcccuggagcagagccuggaguucgugagagccagccugaccaagguggacgaggccgaguacaugugccccgacggcagcuacgccauccaggagaacaucccccugcugaucgccggcgugaucggcggcagcuacagcagcgugagcauccagguggccaaccugcugagacuguuccagaucccccagaucagcuacgccagcaccagcgccaagcugagcgacaagagcagauacgacuacuucgccagaaccgugccccccgacuucuaccaggccaaggccauggccgagauccugagauucuucaacuggaccuacgugagcaccguggccagcgagggcgacuacggcgagaccggcaucgaggccuucgagcaggaggccagacugagaaacaucugcaucgccaccgccgagaaggugggcagaagcaacaucagaaagagcuacgacagcgugaucagagagcugcugcagaagcccaacgccagagugguggugcuguucaugagaagcgacgacagcagagagcugaucgccgccgccagcagagccaacgccagcuucaccuggguggccagcgacggcuggggcgcccaggagagcaucaucaagggcagcgagcacguggccuacggcgccaucacccuggagcuggccagccagcccgugagacaguucgacagauacuuccagagccugaaccccuacaacaaccacagaaaccccugguucagagacuucugggagcagaaguuccagugcagccugcagaacaagagaaaccacagaagagugugcgacaagcaccuggccaucgacagcagcaacuacgagcaggagagcaagaucauguucguggugaacgccguguacgccauggcccacgcccugcacaagaugcagagaacccugugccccaacaccaccaagcugugcgacgccaugaagauccuggacggcaagaagcuguacaaggacuaccugcugaagaucaacuucaccgcccccuucaaccccaacaaggacgccgacagcaucgugaaguucgacaccuucggcgacggcaugggcagauacaacguguucaacuuccagaacgugggcggcaaguacagcuaccugaaggugggccacugggccgagacccugagccuggacgugaacagcauccacuggagcagaaacagcgugcccaccagccagugcagcgaccccugcgcccccaacgagaugaagaacaugcagcccggcgacgugugcugcuggaucugcauccccugcgagcccuacgaguaccuggccgacgaguucaccugcauggacugcggcagcggccaguggcccaccgccgaccugaccggcugcuacgaccugcccgaggacuacaucagaugggaggacgccugggccaucggccccgugaccaucgccugccugggcuucaugugcaccugcaugguggugaccguguucaucaagcacaacaacaccccccuggugaaggccagcggcagagagcugugcuacauccugcuguucggcgugggccugagcuacugcaugaccuucuucuucaucgccaagcccagccccgugaucugcgcccugagaagacugggccugggcagcagcuucgccaucugcuacagcgcccugcugaccaagaccaacugcaucgccagaaucuucgacggcgugaagaacggcgcccagagacccaaguucaucagccccagcagccagguguucaucugccugggccugauccuggugcagaucgugauggugagcguguggcugauccuggaggcccccggcaccagaagauacacccuggccgagaagagagagaccgugauccugaagugcaacgugaaggacagcagcaugcugaucagccugaccuacgacgugauccuggugauccugugcaccguguacgccuucaagaccagaaagugccccgagaacuucaacgaggccaaguucaucggcuucaccauguacaccaccugcaucaucuggcuggccuuccugcccaucuucuacgugaccagcagcgacuacagagugcagaccaccaccaugugcaucagcgugagccugagcggcuucguggugcugggcugccuguucgcccccaaggugcacaucauccuguuccagccccagaagaacguggugacccacagacugcaccugaacagauucagcgugagcggcaccggcaccaccuacagccagagcagcgccagcaccuacgugcccaccgugugcaacggcagagaggugcuggacagcaccaccagcagccuguga

SEQ ID NO: 1846 - RNA, 2640 nt, Artificial Sequence
  derived and/or modified sequence opt5 from GRM3__Homo_sapiens__CCDS5600.1
augaagaugcugaccagacuccaggugcugacacuugcccuguucagcaaaggcuuucuccugucccuuggggaccacaacuuccugcggcgcgagaucaagauugaaggagaucucguccugggcgggcuguuucccaucaaugagaaaggaacgggcaccgaagagugcgggagaauuaacgaagaccggggaauccaacgccucgaggcuaugcuguucgccauugaugagaucaauaaggacgauuaccuucugccuggcguuaaacucggcgugcauauccuggacacauguucuagagauaccuaugcgcuugaacagagccuggaguuugugcgggcuucccucacaaaggucgacgaagccgaguacaugugcccggaugggucuuaugccauucaggagaacaucccccugcugauugcuggagugaucggcgggagcuacuccucuguuagcauucagguggccaaucuccugcgccuuuuccaaaucccucagauuuccuaugcuagcaccucugccaagcuguccgacaaaagcagauacgauuauuuugcgcggacagugcccccugacuucuaccaggccaaggcuauggccgaaauccuccgcuuuuucaacuggaccuacgucucuacgguugcuuccgagggagauuauggcgaaaccgggaucgaggccuuugaacaggaggcgagacugcggaauauuuguaucgccacagcugagaaagugggacgcagcaacauuagaaagucuuacgacuccgucauccgggaacuucugcaaaaacccaaugcccgcguggugguccucuucaugagaagcgacgauucccgggagcugauugcugccgccucuagagcuaacgcgagcuuuaccuggguugccuccgacggcuggggcgcucaggaaagcaucaucaaggggucugagcacguggccuauggagccauuacacuggaacucgcuucccagccugugcgccaguucgaucgguacuuccaaagccugaauccguauaacaaucauagaaaccccugguuucgcgacuucugggagcagaaguuucagugcucucuucaaaauaaacggaaccacagacgcgucugugauaagcaucuggccaucgacagcuccaacuacgagcaggaaucuaaaauuauguucgugguuaaugcgguguaugcuauggcccacgcccuccacaagaugcagcggacccugugcccuaacacgacaaaacuuugugaugcuaugaagauccuggacggcaaaaagcucuacaaggauuaccugcugaaaauuaauuuuaccgcccccuucaacccuaauaaggacgcugauagcaucgucaaauuugacacauucggggacggaaugggcagauauaacguguuuaauuuccagaacguugggggaaaguacuccuaucucaaagugggccauugggccgagacccugagccuugaugucaauucuauccacuggucccgcaacagcgugcccaccucucaaugcuccgacccgugugcgccuaaugaaaugaagaacaugcagcccggcgaugucugcuguuggauuugcaucccuugcgagcccuacgaauaucuggccgacgaguuuacauguauggauugcgggagcggacaguggcccacggcugaccucaccggcuguuacgaucugccugaggacuauauucggugggaagaugccugggcuaucgggccggugacaauugccugccugggauucauguguaccugcaugguugugacagucuuuaucaagcauaauaacacgccccuugugaaagcguccggcagagagcucuguuacauucugcuguucgggguuggccucucuuacugcaugaccuucuuuuucaucgccaagccuagccccgugaucugugcucugcgccggcuuggacugggcuccucuuuugccauuugcuauagcgcucuccugacaaaaaccaauuguaucgccagaauuuucgacggggucaagaacggagcccagcggccuaaauuuaucucccccagcucucaaguguucauuugccugggccuuauccucgugcagaucguuauggucuccguguggcugauucuggaagcuccggggacccgcagauacacacucgcggagaagcgggagaccgugauccugaagugcaacgucaaagauagcucuaugcuuauuucccugacauaugacgugauccucguuauucuguguacgguguacgccuuuaagaccagaaaaugcccugaaaauuucaacgaggcuaaguuuaucggauucacaauguauaccacauguaucauuuggcuggccuuucuucccaucuucuacgucaccagcucugauuaucgcgugcagacgaccacaaugugcauuagcguuucccucagcggcuuugugguccuggggugucuguucgccccuaaagugcacaucauucucuuccagccccaaaagaauguugugacccaccggcugcaucuuaacagauuuucugucuccggcacaggaaccacguacagccaguccucugcuagcacauacgugccuaccgugugcaauggccgcgaaguccuggacuccacaaccucuagccucuga

SEQ ID NO: 1847 - protein, 648 aa, Artificial Sequence
  HAGE__Homo_sapiens__Q9NXZ2
MSHHGGAPKASTWVVASRRSSTVSRAPERRPAEELNRTGPEGYSVGRGGRWRGTSRPPEAVAAGHEELPLCFALKSHFVGAVIGRGGSKIKNIQSTTNTTIQIIQEQPESLVKIFGSKAMQTKAKAVIDNFVKKLEENYNSECGIDTAFQPSVGKDGSTDNNVVAGDRPLIDWDQIREEGLKWQKTKWADLPPIKKNFYKESTATSAMSKVEADSWRKENFNITWDDLKDGEKRPIPNPTCTFDDAFQCYPEVMENIKKAGFQKPTPIQSQAWPIVLQGIDLIGVAQTGTGKTLCYLMPGFIHLVLQPSLKGQRNRPGMLVLTPTRELALQVEGECCKYSYKGLRSVCVYGGGNRDEQIEELKKGVDIIIATPGRLNDLQMSNFVNLKNITYLVLDEADKMLDMGFEPQIMKILLDVRPDRQTVMTSATWPHSVHRLAQSYLKEPMIVYVGTLDLVAVSSVKQNIIVTTEEEKWSHMQTFLQSMSSTDKVIVFVSRKAVADHLSSDLILGNISVESLHGDREQRDREKALENFKTGKVRILIATDLASRGLDVHDVTHVYNFDFPRNIEEYVHRIGRTGRAGRTGVSITTLTRNDWRVASELINILERANQSIPEELVSMAERFKAHQQKREMERKMERPQGRPKKFH

SEQ ID NO: 1848 - RNA, 1947 nt, Artificial Sequence
  HAGE__Homo_sapiens__CCDS4977.1
augucccaccacggaggagcucccaaggccucuacgugggucguugcuagucggcgaagcucgacagugucccgagcgccagagaggaggccggcggaggaguugaaucgaacagguccugagggauauagugucggcagagguggucgcuggagaggcaccucuaggcccccggaggccguggccgcuggucacgaggaacugccgcuguguuuugcuuugaagagccacuuuguuggcgcgguaaucggucguggugggucaaaaauaaagaauauacaaaguacaacaaacaccacaauccaaauaauacaagaacaaccagaaucauuagucaaaauuuuuggcagcaaggcaaugcaaacgaaagcaaaagcagugauagacaauuuuguuaaaaagcuagaagaaaauuacaauucagaaugcggaauugauacugcauuccaaccuucuguuggaaaagauggaagcacagauaacaauguuguugcaggagaucggccauugauagauugggaucaaauuagagaggaagguuugaaauggcaaaaaacaaagugggcagauuuaccaccaauuaagaaaaacuuuuauaaagaguccacugccacaagugccaugucaaaaguagaagcagauaguuggaggaaagaaaauuuuaauauaacgugggaugacuugaaggauggggagaaacgaccuauccccaauccuaccugcacauuugaugacgccuuucaauguuauccugagguuauggaaaacauuaaaaaggcagguuuucaaaagccaacaccuauucagucacaggcauggcccauuguguugcaaggaauagaucuuauaggaguagcccagacuggaacaggaaagacauuguguuauuuaaugccuggauuuauucaucugguccuucaacccagccuuaaaggucaaaggaauagacccggcauguuaguucuaacucccacucgggaauuagcacuucaaguagaaggagaauguugcaaauauucauauaaagggcuucggaguguuuguguauauggugguggaaauagagaugaacaaauagaagagcuuaaaaaagguguagauaucauaauugcaacucccggaagauugaaugaucugcaaaugaguaacuucgucaaucugaagaauauaaccuacuugguuuuagaugaagcagacaagauguuggacaugggauuugaaccccagauaaugaagauuuuguuagaugugcgcccagauaggcagacaguuaugaccagugcuacauggccucauucaguucaucgccucgcacaaucuuauuugaaagaaccaaugauugucuauguugguacauuggaucuaguugcuguaaguucagugaagcaaaauauaauuguaaccaccgaggaagagaaauggagucacaugcaaacuuuucuacagaguaugucauccacagacaaagucauugucuucguuucucgaaaagcuguugcggaucacuuaucaagugaccuaauacuuggaaauauaucaguagagucucugcauggagauagagaacagagagaucgggagaaagcauuagagaacuuuaaaacaggcaaagugagaauacuaauugcaacugaucuagccucuagaggacuugauguccaugacguuacacaugucuauaauuuugacuuuccacggaauauugaagaauacguacaccgaauagggcgcacgggaagagcagggaggacugguguuuccauuacaacuuugacuagaaaugauuggaggguugccucugaauugauuaauauucuggaaagagcaaaucagaguauuccagaggagcuuguaucaauggcugagagguuuaaggcacaucaacagaaaagggaaauggaaagaaaaauggaaagaccucaaggaaggcccaagaaguuucauuaa

SEQ ID NO: 1849 - RNA, 1947 nt, Artificial Sequence
  derived and/or modified sequence opt1 from HAGE__Homo_sapiens__CCDS4977.1
augagccaccacggcggggcccccaaggccuccaccuggguggucgcgagccgccgguccagcaccgugucccgcgccccggagcggcgccccgccgaggagcugaaccggacgggccccgagggguacagcgugggccgcgggggccgguggcgcggcaccucccggcccccggaggccgucgccgcggggcacgaggagcucccccugugcuucgcccucaagagccacuucgugggcgccgugaucgggcgcggcggguccaagaucaagaacauccagagcaccaccaacacgaccauccagaucauccaggagcagcccgagucccuggucaagaucuucggcagcaaggccaugcagaccaaggcgaaggccgugaucgacaacuucgugaagaagcuggaggagaacuacaacuccgagugcggcaucgacaccgccuuccagcccagcgucgggaaggacggcuccacggacaacaacgugguggccggggaccggccgcugaucgacugggaccagauccgcgaggagggccucaaguggcagaagaccaagugggccgaccugccgcccaucaagaagaacuucuacaaggagagcaccgcgaccuccgccaugagcaaggucgaggccgacuccuggcggaaggagaacuucaacaucacgugggacgaccugaaggacggcgagaagcgccccauccccaacccgaccugcaccuucgacgacgccuuccagugcuaccccgaggugauggagaacaucaagaaggccggguuccagaagcccacccccauccagagccaggcguggcccaucgugcuccagggcaucgaccugaucggggucgcccagacgggcaccgggaagacccugugcuaccucaugcccggcuucauccaccuggugcugcagcccagccucaagggccagcggaaccgcccggggaugcuggugcugacccccacgcgggagcucgcccugcaggucgagggcgagugcugcaaguacuccuacaaggggcugcgcagcgugugcguguacggcgggggcaaccgggacgagcagaucgaggagcucaagaagggcgucgacaucaucaucgccacccccgggcgccugaacgaccugcagauguccaacuucgugaaccucaagaacaucaccuaccuggugcuggacgaggccgacaagaugcucgacaugggcuucgagccccagaucaugaagauccugcuggacguccggccggaccgccagaccgugaugacgagcgcgaccuggccccacuccguccaccgccucgcccagagcuaccugaaggagcccaugaucguguacguggggacccuggaccucgucgccguguccagcgugaagcagaacaucaucgucaccacggaggaggagaaguggucccacaugcagaccuuccugcagagcauguccagcaccgacaaggugaucguguucgucucccggaaggccguggccgaccaccugagcuccgaccucauccugggcaacaucagcguggagucccugcacggggaccgcgagcagcgggaccgcgagaaggcgcucgagaacuucaagaccggcaagguccggauccugaucgccacggaccuggccagccgcggccucgacgugcacgacgugacccacgucuacaacuucgacuucccccggaacaucgaggaguacgugcaccgcaucgggcggaccggccgcgccgggcggaccggcguguccaucacgacccugacccgcaacgacuggcgggucgcgagcgagcugaucaacauccucgagcgcgccaaccagagcaucccggaggagcugguguccauggccgagcgguucaaggcccaccagcagaagcgcgagauggagcggaagauggagcgcccccagggccggcccaagaaguuccacuga

SEQ ID NO: 1850 - RNA, 1947 nt, Artificial Sequence
  derived and/or modified sequence opt2 from HAGE__Homo_sapiens__CCDS4977.1
augucccaccacggcggcgcccccaaggccuccaccugggucgucgccucccgccgcuccuccaccgucucccgcgcccccgagcgccgccccgccgaggagcucaaccgcaccggccccgagggcuacuccgucggccgcggcggccgcuggcgcggcaccucccgcccccccgaggccgucgccgccggccacgaggagcucccccucugcuucgcccucaagucccacuucgucggcgccgucaucggccgcggcggcuccaagaucaagaacauccaguccaccaccaacaccaccauccagaucauccaggagcagcccgagucccucgucaagaucuucggcuccaaggccaugcagaccaaggccaaggccgucaucgacaacuucgucaagaagcucgaggagaacuacaacuccgagugcggcaucgacaccgccuuccagcccuccgucggcaaggacggcuccaccgacaacaacgucgucgccggcgaccgcccccucaucgacugggaccagauccgcgaggagggccucaaguggcagaagaccaagugggccgaccucccccccaucaagaagaacuucuacaaggaguccaccgccaccuccgccauguccaaggucgaggccgacuccuggcgcaaggagaacuucaacaucaccugggacgaccucaaggacggcgagaagcgccccauccccaaccccaccugcaccuucgacgacgccuuccagugcuaccccgaggucauggagaacaucaagaaggccggcuuccagaagcccacccccauccagucccaggccuggcccaucguccuccagggcaucgaccucaucggcgucgcccagaccggcaccggcaagacccucugcuaccucaugcccggcuucauccaccucguccuccagcccucccucaagggccagcgcaaccgccccggcaugcucguccucacccccacccgcgagcucgcccuccaggucgagggcgagugcugcaaguacuccuacaagggccuccgcuccgucugcgucuacggcggcggcaaccgcgacgagcagaucgaggagcucaagaagggcgucgacaucaucaucgccacccccggccgccucaacgaccuccagauguccaacuucgucaaccucaagaacaucaccuaccucguccucgacgaggccgacaagaugcucgacaugggcuucgagccccagaucaugaagauccuccucgacguccgccccgaccgccagaccgucaugaccuccgccaccuggccccacuccguccaccgccucgcccaguccuaccucaaggagcccaugaucgucuacgucggcacccucgaccucgucgccgucuccuccgucaagcagaacaucaucgucaccaccgaggaggagaaguggucccacaugcagaccuuccuccaguccauguccuccaccgacaaggucaucgucuucgucucccgcaaggccgucgccgaccaccucuccuccgaccucauccucggcaacaucuccgucgagucccuccacggcgaccgcgagcagcgcgaccgcgagaaggcccucgagaacuucaagaccggcaagguccgcauccucaucgccaccgaccucgccucccgcggccucgacguccacgacgucacccacgucuacaacuucgacuucccccgcaacaucgaggaguacguccaccgcaucggccgcaccggccgcgccggccgcaccggcgucuccaucaccacccucacccgcaacgacuggcgcgucgccuccgagcucaucaacauccucgagcgcgccaaccaguccauccccgaggagcucgucuccauggccgagcgcuucaaggcccaccagcagaagcgcgagauggagcgcaagauggagcgcccccagggccgccccaagaaguuccacuga

SEQ ID NO: 1851 - RNA, 1947 nt, Artificial Sequence
  derived and/or modified sequence opt3 from HAGE__Homo_sapiens__CCDS4977.1
augagccaccauggcggggcccccaaggcuuccaccuggguggucgcaucuagaaggucaaguacaguuagccgggccccugagcgccgaccagcggaagaacugaaccguacuggaccggaagguuacuccgugggcagagggggaagguggcggggcacgucuaggcccccugaggcuguagccgcaggucacgaggagcucccacuuugcuucgcccugaaaucgcauuuugugggggcugucaucggaagaggcggcucaaagauuaaaaauauacagagcaccacaaacacuaccauccaaauuauccaggagcagcccgaaaguuuggugaagauuuucggguccaaagcaaugcagacaaaggccaaggcuguuaucgacaauuuugugaaaaaguuagaggaaaacuauaauucugaguguggaauagauaccgccuuccaaccuagcgucgguaaagacggcuccacugauaacaaugugguagcgggggacaggccacugaucgauugggaccagauucgggaggaaggacuaaaguggcagaaaacaaagugggcagaucucccucccaucaagaaaaacuuuuacaaggagucaaccgccacgagugcuaugagcaaaguugaagccgacucuuggcgcaaggagaauuucaacauuacuugggaugaccugaaagauggcgaaaagcgaccaaucccgaauccuaccugcacauuugacgaugcauuccaguguuaucccgaggugauggagaacauuaaaaaggcugguuuucaaaagccaacucccauacagucccaggccuggccuaucguccuucaggggauugaccugaucggaguggcgcaaaccggcacaggcaaaaccuugugcuaccucaugccaggguucauccaccuggugcugcagcccucacucaagggacagagaaauaggccggguauguuaguccugacgccuacucgggaacuugccuugcaaguugagggcgaauguugcaaauauagcuacaaggggcugcguaguguguguguauauggaggcgguaaccgcgacgagcagauugaagaguugaaaaaggggguggauauaaucauugcaacacccggcagacucaaugaccugcagaugucuaacuuugucaaccuuaagaauaucaccuaccugguguuggaugaggcugacaaaaugcucgauaugggauucgaaccacagauaaugaagauucuguuagacguuaggccugaucggcaaacugugaugacauccgccaccuggccccauagcguccaccgacuggcucagucguaccucaaagagccaaugaucguguauguaggcacgcuugaccugguugccgugucuuccgucaagcagaacaucauugugaccacagaagaggaaaaauggucacacaugcagacuuuucuacaaaguaugagcuccaccgauaaggucaucguguucguuucucgcaaggcaguggccgaccaucuaagcucagaucugauucucgggaauauaaguguagagucccugcacggagacagagagcagagggaccgggaaaaagcucuugagaacuucaagacagguaaaguccgcauccugauugcgacugauuuggcaagcagaggccucgacgugcaugauguuacccacguguacaauuuugacuuccccaggaacaucgaagaguauguccaccguaucgggcggacaggacgagccggcagaaccggugugucuauuacuacgcugacaaggaaugauuggcgcguagcuucagaguuaauaaacauccuggaacgggccaaucagaguauuccugaggagcuagugagcauggcagaaagauuuaaggcccaucagcaaaaacgcgaaauggagcgcaagauggagcgaccacaggggcggccgaagaaauuccacuga

SEQ ID NO: 1852 - RNA, 1947 nt, Artificial Sequence
  derived and/or modified sequence opt4 from HAGE__Homo_sapiens__CCDS4977.1
augagccaccacggcggcgcccccaaggccagcaccugggugguggccagcagaagaagcagcaccgugagcagagcccccgagagaagacccgccgaggagcugaacagaaccggccccgagggcuacagcgugggcagaggcggcagauggagaggcaccagcagaccccccgaggccguggccgccggccacgaggagcugccccugugcuucgcccugaagagccacuucgugggcgccgugaucggcagaggcggcagcaagaucaagaacauccagagcaccaccaacaccaccauccagaucauccaggagcagcccgagagccuggugaagaucuucggcagcaaggccaugcagaccaaggccaaggccgugaucgacaacuucgugaagaagcuggaggagaacuacaacagcgagugcggcaucgacaccgccuuccagcccagcgugggcaaggacggcagcaccgacaacaacgugguggccggcgacagaccccugaucgacugggaccagaucagagaggagggccugaaguggcagaagaccaagugggccgaccugccccccaucaagaagaacuucuacaaggagagcaccgccaccagcgccaugagcaagguggaggccgacagcuggagaaaggagaacuucaacaucaccugggacgaccugaaggacggcgagaagagacccauccccaaccccaccugcaccuucgacgacgccuuccagugcuaccccgaggugauggagaacaucaagaaggccggcuuccagaagcccacccccauccagagccaggccuggcccaucgugcugcagggcaucgaccugaucggcguggcccagaccggcaccggcaagacccugugcuaccugaugcccggcuucauccaccuggugcugcagcccagccugaagggccagagaaacagacccggcaugcuggugcugacccccaccagagagcuggcccugcagguggagggcgagugcugcaaguacagcuacaagggccugagaagcgugugcguguacggcggcggcaacagagacgagcagaucgaggagcugaagaagggcguggacaucaucaucgccacccccggcagacugaacgaccugcagaugagcaacuucgugaaccugaagaacaucaccuaccuggugcuggacgaggccgacaagaugcuggacaugggcuucgagccccagaucaugaagauccugcuggacgugagacccgacagacagaccgugaugaccagcgccaccuggccccacagcgugcacagacuggcccagagcuaccugaaggagcccaugaucguguacgugggcacccuggaccugguggccgugagcagcgugaagcagaacaucaucgugaccaccgaggaggagaaguggagccacaugcagaccuuccugcagagcaugagcagcaccgacaaggugaucguguucgugagcagaaaggccguggccgaccaccugagcagcgaccugauccugggcaacaucagcguggagagccugcacggcgacagagagcagagagacagagagaaggcccuggagaacuucaagaccggcaaggugagaauccugaucgccaccgaccuggccagcagaggccuggacgugcacgacgugacccacguguacaacuucgacuuccccagaaacaucgaggaguacgugcacagaaucggcagaaccggcagagccggcagaaccggcgugagcaucaccacccugaccagaaacgacuggagaguggccagcgagcugaucaacauccuggagagagccaaccagagcauccccgaggagcuggugagcauggccgagagauucaaggcccaccagcagaagagagagauggagagaaagauggagagaccccagggcagacccaagaaguuccacuga

SEQ ID NO: 1853 - RNA, 1947 nt, Artificial Sequence
  derived and/or modified sequence opt5 from HAGE__Homo_sapiens__CCDS4977.1
augagccaccauggcggggcccccaaggcuuccaccuggguggucgccucuagacggagcuccacaguuucucgcgcgccugagagacggccggcugaagaacugaaccgcacgggacccgaaggcuacagcguggggagaggaggccgguggcgcgggaccuccagaccucccgaggccguggccgcuggacacgaggagcucccucugugcuucgcccuuaaaucucauuuugucggcgcugugaucggccgcgggggaagcaagauuaaaaauauccaguccacaaccaacacaaccauucaaaucauucaggagcagcccgaaagccugguuaagaucuucggcucuaaagccaugcagacaaaggcgaaggccgugaucgacaauuuugucaaaaagcucgaggaaaacuauaauuccgagugugggauugauaccgcuuuccaaccuagcgugggaaaagacggcucuacggauaacaauguuguggccggggaccggccgcugaucgauugggaccagauuagagaggaaggacuuaaguggcagaaaaccaagugggcugaucugcccccuaucaagaaaaacuuuuacaaggaguccacagccaccagcgcgaugucuaaagucgaagccgacuccuggcggaaggagaauuucaacauuacaugggaugaccucaaagauggcgaaaagcgccccaucccuaauccgaccugcacguuugacgaugcuuuccaguguuaucccgaggugauggagaacauuaaaaaggccggcuuucaaaagccuacacccauccagagccaggcuuggccuaucgugcugcaggggauugaccugaucggagucgcccaaaccggcacagggaaaacccucugcuaccugaugcccggauucauucaccuuguucugcagcccucccucaagggccagagaaaucggccugggaugcuggugcuuaccccgacacgcgaacuggcccuccaaguggagggagaauguugcaaauauucuuacaagggccugagaagcgucuguguguauggcgggggaaaccgggacgagcagaucgaggaacugaaaaagggcguugauauuaucaucgcuacgcccgggagacucaaugaccugcagauguccaacuuugugaaccuuaagaauauuaccuaccugguccucgaugaggcggacaaaaugcuggauaugggauucgaaccucagaucaugaagauucuucuggacgugcgccccgaucggcaaacaguuaugaccagcgccacauggccucauucugugcacagacucgcucaguccuaccugaaagagcccaugaucgucuaugugggcacccuggaccucgucgccgugagcucuguuaagcagaacauuaucgugacgacagaagaggaaaaauggagccacaugcagaccuuucugcaauccaugucuagcaccgauaaggucaucguguucguuucccgcaaggccguggcugaccaucuuagcucugaucugauucucgggaauaucuccgucgagagccugcacggcgaccgggagcagagagaccgcgaaaaagcccuugagaacuucaagacaggaaaagugcggauucugaucgcgaccgaucucgcuucuagaggccuggacgugcaugauguuacacacgucuacaauuuugacuucccgcgcaacauugaagaguaugugcaccggaucgggagaacgggacgcgccggccggaccgggguguccauuacaacccugacaagaaaugauuggcgggucgccagcgagcucaucaacauccuggaacgcgcuaaucaguccauuccugaggaacuugugucuauggccgagagauuuaaggcucaucagcaaaaacgggaaauggagagaaagauggagcgcccccagggacggccuaagaaauuccacuga

SEQ ID NO: 1854 - protein, 402 aa, Artificial Sequence
  hepsin__Homo_sapiens__B2ZDQ2
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQ

SEQ ID NO: 1855 - RNA, 1209 nt, Artificial Sequence
  hepsin__Homo_sapiens__ACD02430
auggcgcagaaggaggguggccggacugugccaugcugcuccagacccaagguggcagcucucacugcggggacccugcuacuucugacagccaucggggcggcauccugggccauuguggcuguucuccucaggagugaccaggagccgcuguacccagugcaggucagcucugcggacgcucggcucauggucuuugacaagacggaagggacguggcggcugcugugcuccucgcgcuccaacgccaggguagccggacucagcugcgaggagaugggcuuccucagggcacugacccacuccgagcuggacgugcgaacggcgggcgccaauggcacgucgggcuucuucuguguggacgaggggaggcugccccacacccagaggcugcuggaggucaucuccgugugugauugccccagaggccguuucuuggccgccaucugccaagacuguggccgcaggaagcugcccguggaccgcaucgugggaggccgggacaccagcuugggccgguggccguggcaagucagccuucgcuaugauggagcacaccucugugggggaucccugcucuccggggacugggugcugacagccgcccacugcuucccggagcggaaccggguccugucccgauggcgaguguuugccggugccguggcccaggccucuccccacggucugcagcugggggugcaggcuguggucuaccacgggggcuaucuucccuuucgggaccccaacagcgaggagaacagcaacgauauugcccugguccaccucuccaguccccugccccucacagaauacauccagccugugugccucccagcugccggccaggcccugguggauggcaagaucuguaccgugacgggcuggggcaacacgcaguacuauggccaacaggccgggguacuccaggaggcucgaguccccauaaucagcaaugaugucugcaauggcgcugacuucuauggaaaccagaucaagcccaagauguucugugcuggcuaccccgaggguggcauugaugccugccagggcgacagcgguggucccuuugugugugaggacagcaucucucggacgccacguuggcggcuguguggcauugugaguuggggcacuggcugugcccuggcccagaagccaggcgucuacaccaaagucagugacuuccgggaguggaucuuccaguga

SEQ ID NO: 1856 - RNA, 1209 nt, Artificial Sequence
  derived and/or modified sequence opt1 from hepsin__Homo_sapiens__ACD02430
auggcccagaaggagggcgggcgcaccgugcccugcugcagccggccgaaggucgccgcgcugaccgccggcacgcuccugcugcucaccgccaucggggccgccuccugggcgaucguggccgugcugcugcgcagcgaccaggagccccucuaccccguccagguguccagcgccgacgcccggcugaugguguucgacaagaccgagggcaccuggcgccugcucugcuccagccgguccaacgcgcgcgucgccgggcugagcugcgaggagaugggcuuccugcgggcccucacgcacuccgagcuggacgugcgcaccgccggcgccaacgggaccagcggcuucuucugcguggacgaggggcggcugccccacacccagcgccuccuggaggucaucuccgugugcgacugcccgcggggccgcuuccuggcggccaucugccaggacugcgggcggcgcaagcuccccguggaccggaucgucggcggccgcgacacgagccuggggcgguggcccuggcaggucucccugcgcuacgacggcgcccaccucugcgggggcagccugcuguccggcgacugggugcucaccgccgcccacugcuuccccgagcggaaccgcgugcugagccgguggcgcguguucgcgggggccguggcccaggccuccccgcacggccugcagcucgggguccaggccgugguguaccacggcggguaccugcccuuccgcgaccccaacagcgaggagaacuccaacgacaucgcgcugguccaccucagcagcccccugccgcugaccgaguacauccagcccgugugccuccccgccgccggccaggcccugguggacggcaagaucugcaccgucacgggguggggcaacacccaguacuacgggcagcaggccggcgugcugcaggaggcgcggguccccaucaucuccaacgacgugugcaacggggccgacuucuacggcaaccagaucaagccgaagauguucugcgccggcuaccccgagggcgggaucgacgccugccagggggacagcggcgggcccuucgugugcgaggacuccaucagccgcacgccccgguggcgccucugcggcaucgucuccuggggcaccgggugcgcgcuggcccagaagccgggcguguacaccaaggugagcgacuuccgggaguggaucuuccaguga

SEQ ID NO: 1857 - RNA, 1209 nt, Artificial Sequence
  derived and/or modified sequence opt2 from hepsin__Homo_sapiens__ACD02430
auggcccagaaggagggcggccgcaccguccccugcugcucccgccccaaggucgccgcccucaccgccggcacccuccuccuccucaccgccaucggcgccgccuccugggccaucgucgccguccuccuccgcuccgaccaggagccccucuaccccguccaggucuccuccgccgacgcccgccucauggucuucgacaagaccgagggcaccuggcgccuccucugcuccucccgcuccaacgcccgcgucgccggccucuccugcgaggagaugggcuuccuccgcgcccucacccacuccgagcucgacguccgcaccgccggcgccaacggcaccuccggcuucuucugcgucgacgagggccgccucccccacacccagcgccuccucgaggucaucuccgucugcgacugcccccgcggccgcuuccucgccgccaucugccaggacugcggccgccgcaagcuccccgucgaccgcaucgucggcggccgcgacaccucccucggccgcuggcccuggcaggucucccuccgcuacgacggcgcccaccucugcggcggcucccuccucuccggcgacuggguccucaccgccgcccacugcuuccccgagcgcaaccgcguccucucccgcuggcgcgucuucgccggcgccgucgcccaggccuccccccacggccuccagcucggcguccaggccgucgucuaccacggcggcuaccuccccuuccgcgaccccaacuccgaggagaacuccaacgacaucgcccucguccaccucuccuccccccucccccucaccgaguacauccagcccgucugccuccccgccgccggccaggcccucgucgacggcaagaucugcaccgucaccggcuggggcaacacccaguacuacggccagcaggccggcguccuccaggaggcccgcguccccaucaucuccaacgacgucugcaacggcgccgacuucuacggcaaccagaucaagcccaagauguucugcgccggcuaccccgagggcggcaucgacgccugccagggcgacuccggcggccccuucgucugcgaggacuccaucucccgcaccccccgcuggcgccucugcggcaucgucuccuggggcaccggcugcgcccucgcccagaagcccggcgucuacaccaaggucuccgacuuccgcgaguggaucuuccaguga

SEQ ID NO: 1858 - RNA, 1209 nt, Artificial Sequence
  derived and/or modified sequence opt3 from hepsin__Homo_sapiens__ACD02430
auggcccagaaggagggcgggagaaccgugcccugcuguagcaggccuaaagucgcugcacugacagccggaacucuccuucuguugacggcgaucggugcugccuccugggcaauuguugccguguuacugcggucugaccaagaaccacuauacccgguacaggugucaagugcugaugcacgccucauggucuucgacaagaccgagggcacauggcgacugcuuugcagcucccguucuaacgccagaguggcugggcugucgugugaagagaugggauuuuugagggcccucacucacucagaacuggauguucggaccgcgggcgcaaaugguacaagcggguucuuuugcguggacgagggacgccugccccauacccagagacucuuagaggucauaagugugugugauugcccuaggggccgguuccuggccgcuaucugucaggacugcggccgccgaaaacuuccaguagauagaauuguugggggaagggacacuuccuugggucgguggcccuggcaagugucucugcguuaugauggcgcccaccuaugugggggaagccuccuguccggcgacuggguccuuacagcagcucauugcuuuccugaacgcaacagagugcugucaagguggcggguguucgccggugcggucgcccaggcaaguccacacggguugcagcucggaguucaggcugugguauaccauggcggcuaucugcccuuucgagauccuaauagcgaggaaaacucuaaugacaucgccuuagugcaccuguccucaccacucccgcuuaccgaguacauucaacccgucugucugccugcugccgggcaggcauugguggauggaaagaucugcacgguuacugguuggggcaacacccaguauuacgggcagcaagccggagugcuacaggaggcucgcgucccaauaaucagcaaugacgugugcaacggcgcggacuucuaugguaaucagauuaaacccaagauguuuugugcaggguacccugaaggcggaaucgaugccugccaaggcgacagugggggaccauucguaugugaggauucuauuuccagaacacccagguggcggcugugcgguaucguuagcuggggcacugggugugcucucgcccagaagccgggaguguacaccaaagucucggacuuucgcgaauggauauuccaguga

SEQ ID NO: 1859 - RNA, 1209 nt, Artificial Sequence
  derived and/or modified sequence opt4 from hepsin__Homo_sapiens__ACD02430
auggcccagaaggagggcggcagaaccgugcccugcugcagcagacccaagguggccgcccugaccgccggcacccugcugcugcugaccgccaucggcgccgccagcugggccaucguggccgugcugcugagaagcgaccaggagccccuguaccccgugcaggugagcagcgccgacgccagacugaugguguucgacaagaccgagggcaccuggagacugcugugcagcagcagaagcaacgccagaguggccggccugagcugcgaggagaugggcuuccugagagcccugacccacagcgagcuggacgugagaaccgccggcgccaacggcaccagcggcuucuucugcguggacgagggcagacugccccacacccagagacugcuggaggugaucagcgugugcgacugccccagaggcagauuccuggccgccaucugccaggacugcggcagaagaaagcugcccguggacagaaucgugggcggcagagacaccagccugggcagauggcccuggcaggugagccugagauacgacggcgcccaccugugcggcggcagccugcugagcggcgacugggugcugaccgccgcccacugcuuccccgagagaaacagagugcugagcagauggagaguguucgccggcgccguggcccaggccagcccccacggccugcagcugggcgugcaggccgugguguaccacggcggcuaccugcccuucagagaccccaacagcgaggagaacagcaacgacaucgcccuggugcaccugagcagcccccugccccugaccgaguacauccagcccgugugccugcccgccgccggccaggcccugguggacggcaagaucugcaccgugaccggcuggggcaacacccaguacuacggccagcaggccggcgugcugcaggaggccagagugcccaucaucagcaacgacgugugcaacggcgccgacuucuacggcaaccagaucaagcccaagauguucugcgccggcuaccccgagggcggcaucgacgccugccagggcgacagcggcggccccuucgugugcgaggacagcaucagcagaacccccagauggagacugugcggcaucgugagcuggggcaccggcugcgcccuggcccagaagcccggcguguacaccaaggugagcgacuucagagaguggaucuuccaguga

SEQ ID NO: 1860 - RNA, 1209 nt, Artificial Sequence
  derived and/or modified sequence opt5 from hepsin__Homo_sapiens__ACD02430
auggcccagaaggagggcgggagaaccgugcccugcuguagccggccuaaagucgcugcccugacagcgggaacgcuccugcuucugaccgcuaucggcgccgccuccugggcuauuguugccgugcuccugcgcucugaccaagaaccgcuuuaccccgugcaggucagcuccgcugaugccagacugaugguguucgacaagacagaggggaccuggcggcuccugugcucuagccgcuccaacgcgagaguugccggacugucuugugaagagaugggcuuucuccgggcucugacacacagcgaacuugaugugcgcaccgccggggcuaauggaacauccggcuucuuuugcgucgacgagggcagacugccucauacccagcggcuccuggaggugaucagcguuugugauugcccccgcgggagauuccuugccgcgauuugucaggacugcggacggcgcaaacugccuguggauagaaucgucggcgggcgggacacgucucucggacgcuggcccuggcaagugucccugagauaugauggcgcccaccugugugggggaagccuccugucuggcgacugggugcuuaccgcugcccauugcuuuccugaacggaacagaguccugucccgcuggcggguuuucgcuggcgccguggcccaggcuagcccgcacgggcuccagcugggagugcaggcggucguguaccauggcggguaucuucccuuuagagauccuaauucugaggaaaacuccaaugacauugcccugguucaccucagcucuccccugccucugacagaguacauccaacccgugugucucccggcugccggacaggcccuggucgauggcaagaucugcaccgugacaggguggggaaacacccaguauuacggccagcaagcuggcguucuucaggaggcccgcgugccuauuaucuccaaugacgucugcaacggggcggacuucuauggaaaucagauuaaacccaagauguuuugugcuggcuacccugaagggggaaucgaugccugccaaggcgacagcgggggccccuucgugugugaggauuccauuagccggacgcccagauggcgccugugcggaaucgucucuuggggcacagggugugcccucgcucagaagccuggaguguacaccaaaguuuccgacuuucgggaauggauuuuccaguga

SEQ ID NO: 1861 - protein, 417 aa, Artificial Sequence
  hepsin__Homo_sapiens__P05981
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 1862 - RNA, 1254 nt, Artificial Sequence
  hepsin__Homo_sapiens__AAA36013
auggcgcagaaggaggguggccggacugugccaugcugcuccagacccaagguggcagcucucacugcggggacccugcuacuucugacagccaucggggcggcauccugggccauuguggcuguucuccucaggagugaccaggagccgcuguacccagugcaggucagcucugcggacgcucggcucauggucuuugacaagacggaagggacguggcggcugcugugcuccucgcgcuccaacgccaggguagccggacucagcugcgaggagaugggcuuccucagggcacugacccacuccgagcuggacgugcgaacggcgggcgccaauggcacgucgggcuucuucuguguggacgaggggaggcugccccacacccagaggcugcuggaggucaucuccgugugugauugccccagaggccguuucuuggccgccaucugccaagacuguggccgcaggaagcugcccguggaccgcaucgugggaggccgggacaccagcuugggccgguggccguggcaagucagccuucgcuaugauggagcacaccucugugggggaucccugcucuccggggacugggugcugacagccgcccacugcuucccggagcggaaccggguccugucccgauggcgaguguuugccggugccguggcccaggccucuccccacggucugcagcugggggugcaggcuguggucuaccacgggggcuaucuucccuuucgggaccccaacagcgaggagaacagcaacgauauugcccugguccaccucuccaguccccugccccucacagaauacauccagccugugugccucccagcugccggccaggcccugguggauggcaagaucuguaccgugacgggcuggggcaacacgcaguacuauggccaacaggccgggguacuccaggaggcucgaguccccauaaucagcaaugaugucugcaauggcgcugacuucuauggaaaccagaucaagcccaagauguucugugcuggcuaccccgaggguggcauugaugccugccagggcgacagcgguggucccuuugugugugaggacagcaucucucggacgccacguuggcggcuguguggcauugugaguuggggcacuggcugugcccuggcccagaagccaggcgucuacaccaaagucagugacuuccgggaguggaucuuccaggccauaaagacucacuccgaagccagcggcauggugacccagcucuga

SEQ ID NO: 1863 - RNA, 1254 nt, Artificial Sequence
  derived and/or modified sequence opt1 from hepsin__Homo_sapiens__AAA36013
auggcccagaaggagggcgggcgcaccgugcccugcugcagccggccgaaggucgccgcgcugaccgccggcacgcuccugcugcucaccgccaucggggccgccuccugggcgaucguggccgugcugcugcgcagcgaccaggagccccucuaccccguccagguguccagcgccgacgcccggcugaugguguucgacaagaccgagggcaccuggcgccugcucugcuccagccgguccaacgcgcgcgucgccgggcugagcugcgaggagaugggcuuccugcgggcccucacgcacuccgagcuggacgugcgcaccgccggcgccaacgggaccagcggcuucuucugcguggacgaggggcggcugccccacacccagcgccuccuggaggucaucuccgugugcgacugcccgcggggccgcuuccuggcggccaucugccaggacugcgggcggcgcaagcuccccguggaccggaucgucggcggccgcgacacgagccuggggcgguggcccuggcaggucucccugcgcuacgacggcgcccaccucugcgggggcagccugcuguccggcgacugggugcucaccgccgcccacugcuuccccgagcggaaccgcgugcugagccgguggcgcguguucgcgggggccguggcccaggccuccccgcacggccugcagcucgggguccaggccgugguguaccacggcggguaccugcccuuccgcgaccccaacagcgaggagaacuccaacgacaucgcgcugguccaccucagcagcccccugccgcugaccgaguacauccagcccgugugccuccccgccgccggccaggcccugguggacggcaagaucugcaccgucacgggguggggcaacacccaguacuacgggcagcaggccggcgugcugcaggaggcgcggguccccaucaucuccaacgacgugugcaacggggccgacuucuacggcaaccagaucaagccgaagauguucugcgccggcuaccccgagggcgggaucgacgccugccagggggacagcggcgggcccuucgugugcgaggacuccaucagccgcacgccccgguggcgccucugcggcaucgucuccuggggcaccgggugcgcgcuggcccagaagccgggcguguacaccaaggugagcgacuuccgggaguggaucuuccaggccaucaagacccacuccgaggccagcgggauggucacccagcuguga

SEQ ID NO: 1864 - RNA, 1254 nt, Artificial Sequence
  derived and/or modified sequence opt2 from hepsin__Homo_sapiens__AAA36013
auggcccagaaggagggcggccgcaccguccccugcugcucccgccccaaggucgccgcccucaccgccggcacccuccuccuccucaccgccaucggcgccgccuccugggccaucgucgccguccuccuccgcuccgaccaggagccccucuaccccguccaggucuccuccgccgacgcccgccucauggucuucgacaagaccgagggcaccuggcgccuccucugcuccucccgcuccaacgcccgcgucgccggccucuccugcgaggagaugggcuuccuccgcgcccucacccacuccgagcucgacguccgcaccgccggcgccaacggcaccuccggcuucuucugcgucgacgagggccgccucccccacacccagcgccuccucgaggucaucuccgucugcgacugcccccgcggccgcuuccucgccgccaucugccaggacugcggccgccgcaagcuccccgucgaccgcaucgucggcggccgcgacaccucccucggccgcuggcccuggcaggucucccuccgcuacgacggcgcccaccucugcggcggcucccuccucuccggcgacuggguccucaccgccgcccacugcuuccccgagcgcaaccgcguccucucccgcuggcgcgucuucgccggcgccgucgcccaggccuccccccacggccuccagcucggcguccaggccgucgucuaccacggcggcuaccuccccuuccgcgaccccaacuccgaggagaacuccaacgacaucgcccucguccaccucuccuccccccucccccucaccgaguacauccagcccgucugccuccccgccgccggccaggcccucgucgacggcaagaucugcaccgucaccggcuggggcaacacccaguacuacggccagcaggccggcguccuccaggaggcccgcguccccaucaucuccaacgacgucugcaacggcgccgacuucuacggcaaccagaucaagcccaagauguucugcgccggcuaccccgagggcggcaucgacgccugccagggcgacuccggcggccccuucgucugcgaggacuccaucucccgcaccccccgcuggcgccucugcggcaucgucuccuggggcaccggcugcgcccucgcccagaagcccggcgucuacaccaaggucuccgacuuccgcgaguggaucuuccaggccaucaagacccacuccgaggccuccggcauggucacccagcucuga

SEQ ID NO: 1865 - RNA, 1254 nt, Artificial Sequence
  derived and/or modified sequence opt3 from hepsin__Homo_sapiens__AAA36013
auggcccagaaggagggcgggagaaccgugcccugcuguagcaggccuaaagucgcugcacugacagccggaacucuccuucuguugacggcgaucggugcugccuccugggcaauuguugccguguuacugcggucugaccaagaaccacuauacccgguacaggugucaagugcugaugcacgccucauggucuucgacaagaccgagggcacauggcgacugcuuugcagcucccguucuaacgccagaguggcugggcugucgugugaagagaugggauuuuugagggcccucacucacucagaacuggauguucggaccgcgggcgcaaaugguacaagcggguucuuuugcguggacgagggacgccugccccauacccagagacucuuagaggucauaagugugugugauugcccuaggggccgguuccuggccgcuaucugucaggacugcggccgccgaaaacuuccaguagauagaauuguugggggaagggacacuuccuugggucgguggcccuggcaagugucucugcguuaugauggcgcccaccuaugugggggaagccuccuguccggcgacuggguccuuacagcagcucauugcuuuccugaacgcaacagagugcugucaagguggcggguguucgccggugcggucgcccaggcaaguccacacggguugcagcucggaguucaggcugugguauaccauggcggcuaucugcccuuucgagauccuaauagcgaggaaaacucuaaugacaucgccuuagugcaccuguccucaccacucccgcuuaccgaguacauucaacccgucugucugccugcugccgggcaggcauugguggauggaaagaucugcacgguuacugguuggggcaacacccaguauuacgggcagcaagccggagugcuacaggaggcucgcgucccaauaaucagcaaugacgugugcaacggcgcggacuucuaugguaaucagauuaaacccaagauguuuugugcaggguacccugaaggcggaaucgaugccugccaaggcgacagugggggaccauucguaugugaggauucuauuuccagaacacccagguggcggcugugcgguaucguuagcuggggcacugggugugcucucgcccagaagccgggaguguacaccaaagucucggacuuucgcgaauggauauuccaggcaauuaagacacacucugaggccuccggcauggugacccagcuguga

SEQ ID NO: 1866 - RNA, 1254 nt, Artificial Sequence
  derived and/or modified sequence opt4 from hepsin__Homo_sapiens__AAA36013
auggcccagaaggagggcggcagaaccgugcccugcugcagcagacccaagguggccgcccugaccgccggcacccugcugcugcugaccgccaucggcgccgccagcugggccaucguggccgugcugcugagaagcgaccaggagccccuguaccccgugcaggugagcagcgccgacgccagacugaugguguucgacaagaccgagggcaccuggagacugcugugcagcagcagaagcaacgccagaguggccggccugagcugcgaggagaugggcuuccugagagcccugacccacagcgagcuggacgugagaaccgccggcgccaacggcaccagcggcuucuucugcguggacgagggcagacugccccacacccagagacugcuggaggugaucagcgugugcgacugccccagaggcagauuccuggccgccaucugccaggacugcggcagaagaaagcugcccguggacagaaucgugggcggcagagacaccagccugggcagauggcccuggcaggugagccugagauacgacggcgcccaccugugcggcggcagccugcugagcggcgacugggugcugaccgccgcccacugcuuccccgagagaaacagagugcugagcagauggagaguguucgccggcgccguggcccaggccagcccccacggccugcagcugggcgugcaggccgugguguaccacggcggcuaccugcccuucagagaccccaacagcgaggagaacagcaacgacaucgcccuggugcaccugagcagcccccugccccugaccgaguacauccagcccgugugccugcccgccgccggccaggcccugguggacggcaagaucugcaccgugaccggcuggggcaacacccaguacuacggccagcaggccggcgugcugcaggaggccagagugcccaucaucagcaacgacgugugcaacggcgccgacuucuacggcaaccagaucaagcccaagauguucugcgccggcuaccccgagggcggcaucgacgccugccagggcgacagcggcggccccuucgugugcgaggacagcaucagcagaacccccagauggagacugugcggcaucgugagcuggggcaccggcugcgcccuggcccagaagcccggcguguacaccaaggugagcgacuucagagaguggaucuuccaggccaucaagacccacagcgaggccagcggcauggugacccagcuguga

SEQ ID NO: 1867 - RNA, 1254 nt, Artificial Sequence
  derived and/or modified sequence opt5 from hepsin__Homo_sapiens__AAA36013
auggcccagaaggagggcgggagaaccgugcccugcuguagccggccuaaagucgcugcccugacagcgggaacgcuccugcuucugaccgcuaucggcgccgccuccugggcuauuguugccgugcuccugcgcucugaccaagaaccgcuuuaccccgugcaggucagcuccgcugaugccagacugaugguguucgacaagacagaggggaccuggcggcuccugugcucuagccgcuccaacgcgagaguugccggacugucuugugaagagaugggcuuucuccgggcucugacacacagcgaacuugaugugcgcaccgccggggcuaauggaacauccggcuucuuuugcgucgacgagggcagacugccucauacccagcggcuccuggaggugaucagcguuugugauugcccccgcgggagauuccuugccgcgauuugucaggacugcggacggcgcaaacugccuguggauagaaucgucggcgggcgggacacgucucucggacgcuggcccuggcaagugucccugagauaugauggcgcccaccugugugggggaagccuccugucuggcgacugggugcuuaccgcugcccauugcuuuccugaacggaacagaguccugucccgcuggcggguuuucgcuggcgccguggcccaggcuagcccgcacgggcuccagcugggagugcaggcggucguguaccauggcggguaucuucccuuuagagauccuaauucugaggaaaacuccaaugacauugcccugguucaccucagcucuccccugccucugacagaguacauccaacccgugugucucccggcugccggacaggcccuggucgauggcaagaucugcaccgugacaggguggggaaacacccaguauuacggccagcaagcuggcguucuucaggaggcccgcgugccuauuaucuccaaugacgucugcaacggggcggacuucuauggaaaucagauuaaacccaagauguuuugugcuggcuacccugaagggggaaucgaugccugccaaggcgacagcgggggccccuucgugugugaggauuccauuagccggacgcccagauggcgccugugcggaaucgucucuuggggcacagggugugcccucgcucagaagccuggaguguacaccaaaguuuccgacuuucgggaauggauuuuccaggccaucaagacacacagcgaggcuucuggcauggugacccagcuguga

SEQ ID NO: 1868 - protein, 979 aa, Artificial Sequence
  Her2/neu__Homo_sapiens__B4DTR1
MELAALCRWGLLLALLPPGAASTQDNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 1869 - RNA, 2940 nt, Artificial Sequence
  Her2/neu__Homo_sapiens__BAG62073
auggagcuggcggccuugugccgcugggggcuccuccucgcccucuugccccccggagccgcgagcacccaagacaacuaccuuucuacggacgugggauccugcacccucgucugcccccugcacaaccaagaggugacagcagaggauggaacacagcggugugagaagugcagcaagcccugugcccgagugugcuauggucugggcauggagcacuugcgagaggugagggcaguuaccagugccaauauccaggaguuugcuggcugcaagaagaucuuugggagccuggcauuucugccggagagcuuugauggggacccagccuccaacacugccccgcuccagccagagcagcuccaaguguuugagacucuggaagagaucacagguuaccuauacaucucagcauggccggacagccugccugaccucagcgucuuccagaaccugcaaguaauccggggacgaauucugcacaauggcgccuacucgcugacccugcaagggcugggcaucagcuggcuggggcugcgcucacugagggaacugggcaguggacuggcccucauccaccauaacacccaccucugcuucgugcacacggugcccugggaccagcucuuucggaacccgcaccaagcucugcuccacacugccaaccggccagaggacgagugugugggcgagggccuggccugccaccagcugugcgcccgagggcacugcugggguccagggcccacccagugugucaacugcagccaguuccuucggggccaggagugcguggaggaaugccgaguacugcaggggcuccccagggaguaugugaaugccaggcacuguuugccgugccacccugagugucagccccagaauggcucagugaccuguuuuggaccggaggcugaccaguguguggccugugcccacuauaaggacccucccuucugcguggcccgcugccccagcggugugaaaccugaccucuccuacaugcccaucuggaaguuuccagaugaggagggcgcaugccagccuugccccaucaacugcacccacuccuguguggaccuggaugacaagggcugccccgccgagcagagagccagcccucugacguccaucaucucugcggugguuggcauucugcuggucguggucuuggggguggucuuugggauccucaucaagcgacggcagcagaagauccggaaguacacgaugcggagacugcugcaggaaacggagcugguggagccgcugacaccuagcggagcgaugcccaaccaggcgcagaugcggauccugaaagagacggagcugaggaaggugaaggugcuuggaucuggcgcuuuuggcacagucuacaagggcaucuggaucccugauggggagaaugugaaaauuccaguggccaucaaaguguugagggaaaacacaucccccaaagccaacaaagaaaucuuagacgaagcauacgugauggcuggugugggcuccccauaugucucccgccuucugggcaucugccugacauccacggugcagcuggugacacagcuuaugcccuauggcugccucuuagaccauguccgggaaaaccgcggacgccugggcucccaggaccugcugaacugguguaugcagauugccaaggggaugagcuaccuggaggaugugcggcucguacacagggacuuggccgcucggaacgugcuggucaagagucccaaccaugucaaaauuacagacuucgggcuggcucggcugcuggacauugacgagacagaguaccaugcagaugggggcaaggugcccaucaaguggauggcgcuggaguccauucuccgccggcgguucacccaccagagugauguguggaguuauggugugacugugugggagcugaugacuuuuggggccaaaccuuacgaugggaucccagcccgggagaucccugaccugcuggaaaagggggagcggcugccccagccccccaucugcaccauugaugucuacaugaucauggucaaauguuggaugauugacucugaaugucggccaagauuccgggaguuggugucugaauucucccgcauggccagggacccccagcgcuuuguggucauccagaaugaggacuugggcccagccagucccuuggacagcaccuucuaccgcucacugcuggaggacgaugacaugggggaccugguggaugcugaggaguaucugguaccccagcagggcuucuucuguccagacccugccccgggcgcugggggcaugguccaccacaggcaccgcagcucaucuaccaggaguggcgguggggaccugacacuagggcuggagcccucugaagaggaggcccccaggucuccacuggcacccuccgaaggggcuggcuccgauguauuugauggugaccugggaaugggggcagccaaggggcugcaaagccuccccacacaugaccccagcccucuacagcgguacagugaggaccccacaguaccccugcccucugagacugauggcuacguugccccccugaccugcagcccccagccugaauaugugaaccagccagauguucggccccagcccccuucgccccgagagggcccucugccugcugcccgaccugcuggugccacucuggaaaggcccaagacucucuccccagggaagaauggggucgucaaagacguuuuugccuuugggggugccguggagaaccccgaguacuugacaccccagggaggagcugccccucagccccacccuccuccugccuucagcccagccuucgacaaccucuauuacugggaccaggacccaccagagcggggggcuccacccagcaccuucaaagggacaccuacggcagagaacccagaguaccugggucuggacgugccaguguga

SEQ ID NO: 1870 - RNA, 2940 nt, Artificial Sequence
  derived and/or modified sequence opt1 from Her2/neu__Homo_sapiens__BAG62073
auggagcuggccgcccucugccgcuggggccugcugcucgcgcugcugcccccgggggccgccagcacccaggacaacuaccucuccaccgacgugggcagcugcacgcuggucugcccccugcacaaccaggaggugaccgccgaggacgggacccagcggugcgagaagugcuccaagcccugcgcccgcgugugcuacggccucgggauggagcaccuccgggagguccgcgcggugaccagcgccaacauccaggaguucgccggcugcaagaagaucuucggcucccuggccuuccugcccgagagcuucgacggggacccggcguccaacacggcgccccugcagcccgagcagcuccagguguucgagacccuggaggagaucaccggcuaccuguacaucagcgccuggcccgacucccugccggaccucagcgucuuccagaaccuccaggugauccgggggcgcauccugcacaacggcgccuacucccugacccugcaggggcugggcaucagcuggcucggccugcggucccugcgcgagcucgggagcggccuggcccugauccaccacaacacgcaccucugcuucgugcacaccguccccugggaccagcuguuccggaacccccaccaggcccugcuccacaccgccaaccgccccgaggacgagugcgugggggagggccuggccugccaccagcugugcgcccggggccacugcugggggccgggccccacccagugcgugaacugcucccaguuccuccgcgggcaggagugcgucgaggagugccgggugcugcagggccugccccgcgaguacgugaacgcccggcacugccuccccugccacccggagugccagccccagaacgggagcgucacgugcuucggccccgaggcggaccagugcguggccugcgcccacuacaaggacccgcccuucugcguggcccgcugccccuccggcgucaagcccgaccugagcuacaugcccaucuggaaguuccccgacgaggagggggccugccagcccugccccaucaacugcacccacuccugcguggaccuggacgacaagggcugccccgcggagcagcgggccagcccgcucaccagcaucaucuccgccguggucgggauccugcugguggugguccucggcguggucuucgggauccugaucaagcgccggcagcagaagauccgcaaguacaccaugcggcgccugcuccaggagacggagcugguggagccccugacccccagcggcgccaugccgaaccaggcccagaugcgcauccugaaggagaccgagcuccggaaggugaagguccugggcuccggggcguucggcaccguguacaaggggaucuggauccccgacggcgagaacgugaagauccccgucgccaucaaggugcugcgcgagaacacgagccccaaggccaacaaggagauccucgacgaggccuacgugauggcgggggucggcuccccguacgugagccggcugcugggcaucugccucaccuccaccgugcagcuggucacccagcugaugcccuacgggugccuccuggaccacgugcgcgagaaccggggccgccuggggagccaggaccuccugaacuggugcaugcagaucgccaagggcauguccuaccuggaggacgugcggcucguccaccgcgaccuggccgcccggaacgugcuggucaagagccccaaccacgugaagaucacggacuucggccucgcccgccugcuggacaucgacgagaccgaguaccacgcggacgggggcaaggugcccaucaaguggauggcccucgaguccauccugcggcgccgguucacccaccagagcgacgugugguccuacggggucaccgugugggagcugaugacguucggcgccaagccguacgacgggauccccgcccgcgagauccccgaccuccuggagaagggcgagcggcugccccagccgcccaucugcaccaucgacguguacaugaucauggucaagugcuggaugaucgacagcgagugccgcccccgguuccgcgagcucguguccgaguucagccggauggcccgcgacccccagcgcuucguggucauccagaacgaggaccugggcccggcgagcccccuggacuccaccuucuaccggucccuccuggaggacgacgacaugggggaccugguggacgccgaggaguaccucgugccccagcagggcuucuucugccccgacccggcccccggggccggcgggaugguccaccaccgccaccggagcagcuccacccgcagcggcggcggggaccugacgcugggccucgagcccuccgaggaggaggcgccccggagcccgcuggcccccuccgagggggccggcagcgacguguucgacggggaccugggcaugggcgccgccaaggggcuccagucccugcccacccacgacccgagcccccugcagcgcuacuccgaggaccccaccgugccccucccgagcgagaccgacggcuacgucgcgccccugacgugcuccccgcagcccgaguacgugaaccagcccgacgugcggccccagccgcccagcccccgcgaggggccccugcccgccgcccggcccgccggcgccacccucgagcgcccgaagacccugucccccgggaagaacggcgucgugaaggacguguucgcguucggcggggccgucgagaaccccgaguaccugacgccccagggcggggccgccccgcagccccacccgccgcccgccuucagccccgcguucgacaaccucuacuacugggaccaggacccgcccgagcggggcgccccgcccuccaccuucaagggcacccccaccgccgagaaccccgaguaccuggggcuggacgugcccguguga

SEQ ID NO: 1871 - RNA, 2940 nt, Artificial Sequence
  derived and/or modified sequence opt2 from Her2/neu__Homo_sapiens__BAG62073
auggagcucgccgcccucugccgcuggggccuccuccucgcccuccucccccccggcgccgccuccacccaggacaacuaccucuccaccgacgucggcuccugcacccucgucugcccccuccacaaccaggaggucaccgccgaggacggcacccagcgcugcgagaagugcuccaagcccugcgcccgcgucugcuacggccucggcauggagcaccuccgcgagguccgcgccgucaccuccgccaacauccaggaguucgccggcugcaagaagaucuucggcucccucgccuuccuccccgaguccuucgacggcgaccccgccuccaacaccgccccccuccagcccgagcagcuccaggucuucgagacccucgaggagaucaccggcuaccucuacaucuccgccuggcccgacucccuccccgaccucuccgucuuccagaaccuccaggucauccgcggccgcauccuccacaacggcgccuacucccucacccuccagggccucggcaucuccuggcucggccuccgcucccuccgcgagcucggcuccggccucgcccucauccaccacaacacccaccucugcuucguccacaccguccccugggaccagcucuuccgcaacccccaccaggcccuccuccacaccgccaaccgccccgaggacgagugcgucggcgagggccucgccugccaccagcucugcgcccgcggccacugcuggggccccggccccacccagugcgucaacugcucccaguuccuccgcggccaggagugcgucgaggagugccgcguccuccagggccucccccgcgaguacgucaacgcccgccacugccuccccugccaccccgagugccagccccagaacggcuccgucaccugcuucggccccgaggccgaccagugcgucgccugcgcccacuacaaggacccccccuucugcgucgcccgcugccccuccggcgucaagcccgaccucuccuacaugcccaucuggaaguuccccgacgaggagggcgccugccagcccugccccaucaacugcacccacuccugcgucgaccucgacgacaagggcugccccgccgagcagcgcgccuccccccucaccuccaucaucuccgccgucgucggcauccuccucgucgucguccucggcgucgucuucggcauccucaucaagcgccgccagcagaagauccgcaaguacaccaugcgccgccuccuccaggagaccgagcucgucgagccccucacccccuccggcgccaugcccaaccaggcccagaugcgcauccucaaggagaccgagcuccgcaaggucaagguccucggcuccggcgccuucggcaccgucuacaagggcaucuggauccccgacggcgagaacgucaagauccccgucgccaucaagguccuccgcgagaacaccucccccaaggccaacaaggagauccucgacgaggccuacgucauggccggcgucggcucccccuacgucucccgccuccucggcaucugccucaccuccaccguccagcucgucacccagcucaugcccuacggcugccuccucgaccacguccgcgagaaccgcggccgccucggcucccaggaccuccucaacuggugcaugcagaucgccaagggcauguccuaccucgaggacguccgccucguccaccgcgaccucgccgcccgcaacguccucgucaagucccccaaccacgucaagaucaccgacuucggccucgcccgccuccucgacaucgacgagaccgaguaccacgccgacggcggcaagguccccaucaaguggauggcccucgaguccauccuccgccgccgcuucacccaccaguccgacgucugguccuacggcgucaccgucugggagcucaugaccuucggcgccaagcccuacgacggcauccccgcccgcgagauccccgaccuccucgagaagggcgagcgccucccccagccccccaucugcaccaucgacgucuacaugaucauggucaagugcuggaugaucgacuccgagugccgcccccgcuuccgcgagcucgucuccgaguucucccgcauggcccgcgacccccagcgcuucgucgucauccagaacgaggaccucggccccgccuccccccucgacuccaccuucuaccgcucccuccucgaggacgacgacaugggcgaccucgucgacgccgaggaguaccucgucccccagcagggcuucuucugccccgaccccgcccccggcgccggcggcaugguccaccaccgccaccgcuccuccuccacccgcuccggcggcggcgaccucacccucggccucgagcccuccgaggaggaggccccccgcuccccccucgcccccuccgagggcgccggcuccgacgucuucgacggcgaccucggcaugggcgccgccaagggccuccagucccuccccacccacgaccccuccccccuccagcgcuacuccgaggaccccaccgucccccuccccuccgagaccgacggcuacgucgccccccucaccugcuccccccagcccgaguacgucaaccagcccgacguccgcccccagccccccuccccccgcgagggcccccuccccgccgcccgccccgccggcgccacccucgagcgccccaagacccucucccccggcaagaacggcgucgucaaggacgucuucgccuucggcggcgccgucgagaaccccgaguaccucaccccccagggcggcgccgccccccagccccaccccccccccgccuucucccccgccuucgacaaccucuacuacugggaccaggacccccccgagcgcggcgccccccccuccaccuucaagggcacccccaccgccgagaaccccgaguaccucggccucgacguccccgucuga

SEQ ID NO: 1872 - RNA, 2940 nt, Artificial Sequence
  derived and/or modified sequence opt3 from Her2/neu__Homo_sapiens__BAG62073
auggagcuggccgcucucugcagauggggccuucuguuggcauuacugcccccuggggccgcgagcacccaggacaacuaccuauccacagaugugggaucuuguacucucgucugcccacugcacaaucaagaaguuacggcugaggacgguacccagaggugugaaaagugcucaaaaccgugugcccgggugugcuauggccuugggauggagcaucugcgcgaaguacgagcagugacaagugccaacauccaggaguucgcuggauguaagaaaauuuuuggcagcuuggcauuccuccccgaguccuuugauggugacccugccucuaauacugcuccacugcagcccgaacaacugcaggucuucgagacccucgaagagauaacaggguacuuauauaucucggccuggccugauucacugccagaccuuagcguguuucagaacuugcagguuauucguggaagaauccugcacaauggcgcguacagucuaacccuccaaggccuggggauuuccuggcuuggacugaggucuuugcgggagcucgguagcggccuggcauuaauccaucacaacacucaucugugcuucgugcacacaguccccugggaucagcucuuucgcaauccucaccaggcccuucugcauaccgcuaacagaccagaagacgagugugugggggaaggauuggccugccaccagcuaugugcaaggggccauugcugggguccggggcccacgcaaugcguaaauuguucccaguuccugcggggacaggagugcguugaagagugucgcgugcuccaaggccugccucgagaguaugucaacgcuagacacugccuuccaugucaccccgaaugccagccucagaauggcucagugacuuguuuugggccagaggccgaucagugcguggcgugugcccauuacaaggaucccccguucugcgucgcaagguguccuaguggaguuaaacccgaccugagcuauaugccaauauggaaguuuccugacgaagagggugcuugccaacccugcccaaucaacuguacccacucuugcguggauuuggacgacaagggcugucccgccgaacagcgggcuuccccucucacaucaauuaucagcgccguaguggggauucuguuagucgugguucugggaguggucuucggcauccuaauaaaacgucgccagcagaagauuagaaaauacacuaugaggcggcuccugcaagagaccgagcuuguggaaccauugacaccgaguggugcaaugcccaaucaggcccagaugcgaauccugaaggagaccgaacuccgcaaaguaaagguucuggggucuggcgcuuuuggaacgguguacaagggcauuuggaucccugauggggagaacgucaaaaucccaguggcgauuaagguccuuagagaaaauacuucccccaaagcaaacaaggagauacuggacgaggccuaugugauggcuggaguugguagcccuuacgugucgagguugcucggcaucugccugacaucuaccguacaguuagucacucaacugaugccauaugggugucuacucgaucaugugcgggaaaaccgcggaagacugggcucccaggaccuuuugaauuggugcaugcagauugccaaagguaugucauaccuggaggauguuaggcucgugcaccgugaccuggcagcccggaacgucuuagugaagagucccaaucauguaaaaaucacagauuucgggcuggcucgacuuuuggacauagaugaaaccgaguaucacgccgacggcggaaaggugccgauuaaguggauggcacucgagagcauccugagaaggcgcuucacgcaccaguccgauguuuggucuuacggcgucaccgugugggaacuaaugacauuuggggcgaaaccuuaugacggaaucccagcucgggagauucccgaccugcucgaaaagggugagagacugccucaacccccaaucuguacuauugauguguacaugauaauggucaaaugcuggaugaucgacagcgaauguaggccucgcuuccgagagcuuguuucagaguuuagucggauggcccgugauccccagagauucguggugauucagaacgaagacuugggcccagcauccccgcuggauagcaccuuuuacaggucuuuacucgaggacgaugacaugggggaucugguagacgccgaagaguaucuugucccucaacagggauucuuuugccccgauccagcucccggcgccggugggauggugcaucaccgccaucggucaaguagcacaagauccggcggaggcgaccugacuuuggggcucgaaccuucugaggaggaagcaccaaggucgccccuggcuccuagcgagggagccggcuccgauguuuucgacggugaccuagggaugggagcggccaagggccugcagucacucccgacccacgauccaaguccccugcagcgauacucugaagacccuacagugccacuucccagcgagaccgaugguuaugucgcuccuuugacuuguuccccgcaacccgaauacgugaaucagccagacguucgcccucagcccccaucaccucgggagggcccccugccagcagccagaccggcuggggccacguuagagaggccuaaaacacucagccccggaaagaacggcgugguaaaggaugucuuugcauucgggggagcgguggaaaauccagaguaucugacuccccagggcggugccgcuccucaaccacacccucccccggccuuuucuccagcauucgacaaccuuuacuauugggaucaggaucccccugaacguggggcucccccauccaccuuuaaaggaaccccuacagccgagaaucccgaguaccugggccuagacgugccagucuga

SEQ ID NO: 1873 - RNA, 2940 nt, Artificial Sequence
  derived and/or modified sequence opt4 from Her2/neu__Homo_sapiens__BAG62073
auggagcuggccgcccugugcagauggggccugcugcuggcccugcugccccccggcgccgccagcacccaggacaacuaccugagcaccgacgugggcagcugcacccuggugugcccccugcacaaccaggaggugaccgccgaggacggcacccagagaugcgagaagugcagcaagcccugcgccagagugugcuacggccugggcauggagcaccugagagaggugagagccgugaccagcgccaacauccaggaguucgccggcugcaagaagaucuucggcagccuggccuuccugcccgagagcuucgacggcgaccccgccagcaacaccgccccccugcagcccgagcagcugcagguguucgagacccuggaggagaucaccggcuaccuguacaucagcgccuggcccgacagccugcccgaccugagcguguuccagaaccugcaggugaucagaggcagaauccugcacaacggcgccuacagccugacccugcagggccugggcaucagcuggcugggccugagaagccugagagagcugggcagcggccuggcccugauccaccacaacacccaccugugcuucgugcacaccgugcccugggaccagcuguucagaaacccccaccaggcccugcugcacaccgccaacagacccgaggacgagugcgugggcgagggccuggccugccaccagcugugcgccagaggccacugcuggggccccggccccacccagugcgugaacugcagccaguuccugagaggccaggagugcguggaggagugcagagugcugcagggccugcccagagaguacgugaacgccagacacugccugcccugccaccccgagugccagccccagaacggcagcgugaccugcuucggccccgaggccgaccagugcguggccugcgcccacuacaaggacccccccuucugcguggccagaugccccagcggcgugaagcccgaccugagcuacaugcccaucuggaaguuccccgacgaggagggcgccugccagcccugccccaucaacugcacccacagcugcguggaccuggacgacaagggcugccccgccgagcagagagccagcccccugaccagcaucaucagcgccguggugggcauccugcuggugguggugcugggcgugguguucggcauccugaucaagagaagacagcagaagaucagaaaguacaccaugagaagacugcugcaggagaccgagcugguggagccccugacccccagcggcgccaugcccaaccaggcccagaugagaauccugaaggagaccgagcugagaaaggugaaggugcugggcagcggcgccuucggcaccguguacaagggcaucuggauccccgacggcgagaacgugaagauccccguggccaucaaggugcugagagagaacaccagccccaaggccaacaaggagauccuggacgaggccuacgugauggccggcgugggcagccccuacgugagcagacugcugggcaucugccugaccagcaccgugcagcuggugacccagcugaugcccuacggcugccugcuggaccacgugagagagaacagaggcagacugggcagccaggaccugcugaacuggugcaugcagaucgccaagggcaugagcuaccuggaggacgugagacuggugcacagagaccuggccgccagaaacgugcuggugaagagccccaaccacgugaagaucaccgacuucggccuggccagacugcuggacaucgacgagaccgaguaccacgccgacggcggcaaggugcccaucaaguggauggcccuggagagcauccugagaagaagauucacccaccagagcgacguguggagcuacggcgugaccgugugggagcugaugaccuucggcgccaagcccuacgacggcauccccgccagagagauccccgaccugcuggagaagggcgagagacugccccagccccccaucugcaccaucgacguguacaugaucauggugaagugcuggaugaucgacagcgagugcagacccagauucagagagcuggugagcgaguucagcagaauggccagagacccccagagauucguggugauccagaacgaggaccugggccccgccagcccccuggacagcaccuucuacagaagccugcuggaggacgacgacaugggcgaccugguggacgccgaggaguaccuggugccccagcagggcuucuucugccccgaccccgcccccggcgccggcggcauggugcaccacagacacagaagcagcagcaccagaagcggcggcggcgaccugacccugggccuggagcccagcgaggaggaggcccccagaagcccccuggcccccagcgagggcgccggcagcgacguguucgacggcgaccugggcaugggcgccgccaagggccugcagagccugcccacccacgaccccagcccccugcagagauacagcgaggaccccaccgugccccugcccagcgagaccgacggcuacguggccccccugaccugcagcccccagcccgaguacgugaaccagcccgacgugagaccccagccccccagccccagagagggcccccugcccgccgccagacccgccggcgccacccuggagagacccaagacccugagccccggcaagaacggcguggugaaggacguguucgccuucggcggcgccguggagaaccccgaguaccugaccccccagggcggcgccgccccccagccccaccccccccccgccuucagccccgccuucgacaaccuguacuacugggaccaggacccccccgagagaggcgccccccccagcaccuucaagggcacccccaccgccgagaaccccgaguaccugggccuggacgugcccguguga

SEQ ID NO: 1874 - RNA, 2940 nt, Artificial Sequence
  derived and/or modified sequence opt5 from Her2/neu__Homo_sapiens__BAG62073
auggagcuggccgcucucugcagauggggccugcuucuggcccuccugcccccuggggcggcuagcacccaggacaacuaccuuuccacagaugugggaucuuguacgcuggucugcccgcuccacaaucaagaaguuaccgccgaggacggcacacagcggugugaaaagugcagcaaacccugugcccgcgugugcuaugggcugggaauggagcaccugagagaagugcgggcugucaccuccgccaacauccaggaguucgcuggcuguaagaaaauuuuugggucucucgccuuccugccugagagcuuugauggagaccccgcguccaauacagccccucuucagcccgaacaacuccagguguucgagacccuggaagagaucacaggcuaccuguauauuucugcuuggccugauagccuuccggaccuguccguuuuucagaaccuccaggugauccgcggccggauucugcacaauggggccuacagccugacccuccaaggacugggcaucucuuggcuugggcugcggucccuccgcgagcugggaagcggccuugcucugauccaucacaacacgcaucucugcuucguccacaccgugcccugggaucagcuguuuagaaauccucaccaggcccugcuccauacagcgaaccggcccgaagacgaguguguuggggaaggacuggccugccaccagcuuugugcucgcggccauugcuggggcccugggcccacccaaugcgugaauuguucucaguuccugagaggacaggagugcgucgaagagugucgggugcuccaaggccugccgcgcgaguaugugaacgccagacacugccuuccuugucaccccgaaugccagccucagaauggguccgucacauguuuuggacccgaggcugaucagugcguugccugugcccauuacaaggaucccccuuucugcguggcucgguguccgagcggcgugaaacccgaccugucuuauaugccuauuuggaaguuucccgacgaagagggggcgugccaaccuugccccaucaacuguacccacuccugcgucgaucucgacgacaagggauguccggccgaacagcgcgcuagcccucugacguccauuaucucugccgugguuggcauucugcucguggucgugcugggcguuguguucgggauccuuauuaaaagacggcagcagaagaucagaaaauacacaaugcgccggcugcuccaagagaccgagcuggucgaaccccugacaccuagcggagccaugcccaaucaggcucagaugagaauccuuaaggagaccgaacuccgcaaagugaagguccugggcuccggggccuuuggaaccguguacaagggcauuuggaucccugauggggagaacguuaaaauucccguggcgaucaagguccugcgggaaaauacaagcccgaaagcuaacaaggagauucucgacgaggccuaugugauggccggcguuggaucuccuuacguguccagacugcuuggcaucugccugacgagcaccguccagcucgugacacaacugaugcccuaugggugucugcuugaucaugugcgcgaaaaccggggaagacucggcucucaggaccugcugaauuggugcaugcagaucgcuaaagggaugagcuaccucgaggauguucgccugguccaccgggaccuugccgcuagaaacgugcuggugaagucccccaaucaugucaaaauuaccgauuucggacucgcccgccugcuggacaucgaugaaacagaguaucacgcggacggcgggaaggugccuauuaaguggauggcccuugagucuauccuccggagacgguucacccaccagagcgauguuugguccuacggcgugacggucugggaacugaugacauuuggagcuaaaccguaugacggcauucccgcccgcgagaucccugaccugcucgaaaagggggagagacugccccaaccucccaucuguaccauugauguguacaugaucaugguuaaaugcuggaugauugacagcgaaugucggccuagauuccgcgagcuugugucugaguuuucccggauggcuagagauccccagcgcuucgucgugauccagaacgaagaccugggaccggccagcccucucgauucuaccuuuuacagaucccugcuggaggacgaugacaugggcgaucuuguugacgcggaagaguaucucgugccccaacagggguucuuuugcccugaucccgccccgggagcuggcgggaugguccaucaccggcaucgcagcuccucuacaagaagcggcggaggcgaccugacccuggggcucgaaccuuccgaggaggaagcccccagaucuccucuggcucccagcgagggagccggcuccgauguguucgacggggaccuuggaaugggcgccgcuaaggggcugcagagccuccccacacacgauccuucuccgcugcagcgcuacuccgaagaccccacggugccucugcccagcgagaccgauggcuaugucgcgccucuuacauguucuccccaaccugaauacguuaaucagccggacgugagaccccagccucccuccccucgggagggaccccugccggccgcucgcccugccggcgccacccucgagagacccaaaacacugagccccgggaagaacggaguggucaaggauguguuugcuuucggcggggccguugaaaauccugaguaucucacgccccagggaggcgcggcuccucaaccgcaucccccucccgccuuuucuccugccuucgacaaccuguacuauugggaucaggaucccccggaacggggcgcuccucccagcaccuuuaaagggaccccuacagccgagaaucccgaguaccuuggacuggacgugccugucuga

SEQ ID NO: 1875 - protein, 87 aa, Artificial Sequence
  Her2/neu__Homo_sapiens__L8E8G2
MMRMKTFVMIHFHLMNGGKAKLYSRPHAKLLPEQRVTDKTGAPVEWPGQTQCSTETQTLAAMPAQAVMRVTCTVVDMHKSECAPAQT

SEQ ID NO: 1876 - RNA, 264 nt, Artificial Sequence
  Her2/neu__Homo_sapiens__CCQ43016
augaugaggaugaaaaccuuugugaugauccacuuccacuuaaugaaugguggcaaagcaaagcuauauucaagaccacaugcaaagcuacucccugagcaaagagucacagauaaaacgggggcaccaguagaauggccaggacaaacgcagugcagcacagagacucagacccuggcagccaugccugcgcaggcagugaugagagugacauguacuguuguggacaugcacaaaagugagugugcaccggcacagacauga

SEQ ID NO: 1877 - RNA, 264 nt, Artificial Sequence
  derived and/or modified sequence opt1 from Her2/neu__Homo_sapiens__CCQ43016
augaugcgcaugaagaccuucgugaugauccacuuccaccugaugaacggcgggaaggccaagcucuacagccggccccacgccaagcugcugccggagcagcgcgucaccgacaagacgggcgcgcccguggaguggcccgggcagacccagugcuccaccgagacccagacgcucgccgccaugcccgcccaggccgugaugcgggugaccugcaccgucguggacaugcacaagagcgagugcgcgccggcccagaccuga

SEQ ID NO: 1878 - RNA, 264 nt, Artificial Sequence
  derived and/or modified sequence opt2 from Her2/neu__Homo_sapiens__CCQ43016
augaugcgcaugaagaccuucgucaugauccacuuccaccucaugaacggcggcaaggccaagcucuacucccgcccccacgccaagcuccuccccgagcagcgcgucaccgacaagaccggcgcccccgucgaguggcccggccagacccagugcuccaccgagacccagacccucgccgccaugcccgcccaggccgucaugcgcgucaccugcaccgucgucgacaugcacaaguccgagugcgcccccgcccagaccuga

SEQ ID NO: 1879 - RNA, 264 nt, Artificial Sequence
  derived and/or modified sequence opt3 from Her2/neu__Homo_sapiens__CCQ43016
augaugagaaugaagaccuucgugaugauccacuuucaucugaugaacggcgggaaagccaagcucuacagcaggccccacgcuaaacuucugccugagcagcgggucacagacaagacuggagcaccaguugaauggccgggucaaacgcagugcuccaccgagacacagacuuuggccgcgaugcccgcucaggccgugaugcgcguaaccuguacaguggucgauaugcauaaaucugaaugcgccccugcacaaaccuga

SEQ ID NO: 1880 - RNA, 264 nt, Artificial Sequence
  derived and/or modified sequence opt4 from Her2/neu__Homo_sapiens__CCQ43016
augaugagaaugaagaccuucgugaugauccacuuccaccugaugaacggcggcaaggccaagcuguacagcagaccccacgccaagcugcugcccgagcagagagugaccgacaagaccggcgcccccguggaguggcccggccagacccagugcagcaccgagacccagacccuggccgccaugcccgcccaggccgugaugagagugaccugcaccgugguggacaugcacaagagcgagugcgcccccgcccagaccuga

SEQ ID NO: 1881 - RNA, 264 nt, Artificial Sequence
  derived and/or modified sequence opt5 from Her2/neu__Homo_sapiens__CCQ43016
augaugagaaugaagaccuucgugaugauccacuuucaucugaugaacggcgggaaagccaagcucuacagccggccccacgcuaaacugcuuccugagcagcgcgucacagacaagacgggagccccgguugaauggcccggccaaacccagugcuccacagagacccagacacuggcggcuaugccugcccaggccgugaugagagugaccuguacagucguggauaugcauaaaucugaaugcgcucccgcccaaaccuga

SEQ ID NO: 1882 - protein, 1255 aa, Artificial Sequence [sequence omitted]

SEQ ID NO: 1883 - RNA, 3768 nt, Artificial Sequence
  Her2/neu__Homo_sapiens__AAI67147
auggagcuggcggccuugugccgcugggggcuccuccucgcccucuugccccccggagccgcgagcacccaagugugcaccggcacagacaugaagcugcggcucccugccagucccgagacccaccuggacaugcuccgccaccucuaccagggcugccagguggugcagggaaaccuggaacucaccuaccugcccaccaaugccagccuguccuuccugcaggauauccaggaggugcagggcuacgugcucaucgcucacaaccaagugaggcaggucccacugcagaggcugcggauugugcgaggcacccagcucuuugaggacaacuaugcccuggccgugcuagacaauggagacccgcugaacaauaccaccccugucacaggggccuccccaggaggccugcgggagcugcagcuucgaagccucacagagaucuugaaaggaggggucuugauccagcggaacccccagcucugcuaccaggacacgauuuuguggaaggacaucuuccacaagaacaaccagcuggcucucacacugauagacaccaaccgcucucgggccugccaccccuguucuccgauguguaagggcucccgcugcuggggagagaguucugaggauugucagagccugacgcgcacugucugugccgguggcugugcccgcugcaaggggccacugcccacugacugcugccaugagcagugugcugccggcugcacgggccccaagcacucugacugccuggccugccuccacuucaaccacaguggcaucugugagcugcacugcccagcccuggucaccuacaacacagacacguuugaguccaugcccaaucccgagggccgguauacauucggcgccagcugugugacugccugucccuacaacuaccuuucuacggacgugggauccugcacccucgucugcccccugcacaaccaagaggugacagcagaggauggaacacagcggugugagaagugcagcaagcccugugcccgagugugcuauggucugggcauggagcacuugcgagaggugagggcaguuaccagugccaauauccaggaguuugcuggcugcaagaagaucuuugggagccuggcauuucugccggagagcuuugauggggacccagccuccaacacugccccgcuccagccagagcagcuccaaguguuugagacucuggaagagaucacagguuaccuauacaucucagcauggccggacagccugccugaccucagcgucuuccagaaccugcaaguaauccggggacgaauucugcacaauggcgccuacucgcugacccugcaagggcugggcaucagcuggcuggggcugcgcucacugagggaacugggcaguggacuggcccucauccaccauaacacccaccucugcuucgugcacacggugcccugggaccagcucuuucggaacccgcaccaagcucugcuccacacugccaaccggccagaggacgagugugugggcgagggccuggccugccaccagcugugcgcccgagggcacugcugggguccagggcccacccagugugucaacugcagccaguuccuucggggccaggagugcguggaggaaugccgaguacugcaggggcuccccagggaguaugugaaugccaggcacuguuugccgugccacccugagugucagccccagaauggcucagugaccuguuuuggaccggaggcugaccaguguguggccugugcccacuauaaggacccucccuucugcguggcccgcugccccagcggugugaaaccugaccucuccuacaugcccaucuggaaguuuccagaugaggagggcgcaugccagccuugccccaucaacugcacccacuccuguguggaccuggaugacaagggcugccccgccgagcagagagccagcccucugacguccaucaucucugcggugguuggcauucugcuggucguggucuuggggguggucuuugggauccucaucaagcgacggcagcagaagauccggaaguacacgaugcggagacugcugcaggaaacggagcugguggagccgcugacaccuagcggagcgaugcccaaccaggcgcagaugcggauccugaaagagacggagcugaggaaggugaaggugcuuggaucuggcgcuuuuggcacagucuacaagggcaucuggaucccugauggggagaaugugaaaauuccaguggccaucaaaguguugagggaaaacacaucccccaaagccaacaaagaaaucuuagacgaagcauacgugauggcuggugugggcuccccauaugucucccgccuucugggcaucugccugacauccacggugcagcuggugacacagcuuaugcccuauggcugccucuuagaccauguccgggaaaaccgcggacgccugggcucccaggaccugcugaacugguguaugcagauugccaaggggaugagcuaccuggaggaugugcggcucguacacagggacuuggccgcucggaacgugcuggucaagagucccaaccaugucaaaauuacagacuucgggcuggcucggcugcuggacauugacgagacagaguaccaugcagaugggggcaaggugcccaucaaguggauggcgcuggaguccauucuccgccggcgguucacccaccagagugauguguggaguuauggugugacugugugggagcugaugacuuuuggggccaaaccuuacgaugggaucccagcccgggagaucccugaccugcuggaaaagggggagcggcugccccagccccccaucugcaccauugaugucuacaugaucauggucaaauguuggaugauugacucugaaugucggccaagauuccgggaguuggugucugaauucucccgcauggccagggacccccagcgcuuuguggucauccagaaugaggacuugggcccagccagucccuuggacagcaccuucuaccgcucacugcuggaggacgaugacaugggggaccugguggaugcugaggaguaucugguaccccagcagggcuucuucuguccagacccugccccgggcgcugggggcaugguccaccacaggcaccgcagcucaucuaccaggaguggcgguggggaccugacacuagggcuggagcccucugaagaggaggcccccaggucuccacuggcacccuccgaaggggcuggcuccgauguauuugauggugaccugggaaugggggcagccaaggggcugcaaagccuccccacacaugaccccagcccucuacagcgguacagugaggaccccacaguaccccugcccucugagacugauggcuacguugccccccugaccugcagcccccagccugaauaugugaaccagccagauguucggccccagcccccuucgccccgagagggcccucugccugcugcccgaccugcuggugccacucuggaaaggcccaagacucucuccccagggaagaauggggucgucaaagacguuuuugccuuugggggugccguggagaaccccgaguacuugacaccccagggaggagcugccccucagccccacccuccuccugccuucagcccagccuucgacaaccucuauuacugggaccaggacccaccagagcggggggcuccacccagcaccuucaaagggacaccuacggcagagaacccagaguaccugggucuggacgugccaguguga

SEQ ID NO: 1884 - RNA, 3768 nt, Artificial Sequence
  derived and/or modified sequence opt1 from Her2/neu__Homo_sapiens__AAI67147
auggagcuggccgcccucugccgcuggggccugcugcucgcgcugcugcccccgggggccgccagcacccaggugugcaccggcacggacaugaagcuccggcugcccgccucccccgagacccaccuggacaugcuccgccaccuguaccaggggugccaggucgugcagggcaaccuggagcucaccuaccugcccaccaacgccagccuguccuuccuccaggacauccaggaggugcagggguacguccugaucgcgcacaaccaggugcgccaggugccgcugcagcggcuccggaucguccgcggcacgcagcuguucgaggacaacuacgcccuggccgugcucgacaacggcgacccccugaacaacaccacccccgugaccggggccagccccggcgggcugcgggagcuccagcugcgcucccugacggagauccucaagggcgggguccugauccagcggaacccgcagcugugcuaccaggacaccauccucuggaaggacaucuuccacaagaacaaccagcuggcgcugacccucaucgacaccaaccgcagccgggccugccaccccugcucccccaugugcaagggcagccgcugcuggggcgaguccagcgaggacugccagucccugacgcggaccgugugcgccgggggcugcgcccgcugcaaggggccccugccgaccgacugcugccacgagcagugcgccgcgggcugcaccggccccaagcacagcgacugccucgccugccugcacuucaaccacuccgggaucugcgagcugcacugccccgcccucgugacguacaacaccgacaccuucgagagcaugcccaacccggagggccgguacaccuucggggccuccugcgucacggccugccccuacaacuaccugagcaccgacgugggcuccugcacccuggugugcccccuccacaaccaggaggucaccgcggaggacgggacgcagcgcugcgagaagugcagcaagcccugcgcccgggugugcuacggccugggcauggagcaccuccgcgaggugcgggccgucaccuccgccaacauccaggaguucgccgggugcaagaagaucuucggcagccuggcguuccugccggagagcuucgacggggaccccgccuccaacaccgcgccccugcagcccgagcagcuccagguguucgagacccuggaggagaucacgggcuaccuguacaucagcgccuggccggacucccugcccgaccucagcguguuccagaaccugcaggucauccgcgggcggauccugcacaacggcgccuacucccucacccugcagggccuggggaucagcuggcucggccugcgcucccugcgcgagcucgggagcggccuggcccugauccaccacaacacccaccucugcuucgugcacaccgugcccugggaccagcuguuccggaacccccaccaggcccugcuccacacggccaaccgccccgaggacgagugcgucggggagggccuggccugccaccagcugugcgcgcggggccacugcugggggcccggccccacccagugcgugaacugcucccaguuccuccgcgggcaggagugcgucgaggagugccgggugcugcagggccugccgcgcgaguacgugaacgcccggcacugccuccccugccaccccgagugccagccccagaacggcagcgugaccugcuucgggccggaggccgaccagugcguggccugcgcccacuacaaggacccgcccuucugcguggcgcgcugccccuccggcgucaagcccgaccugagcuacaugcccaucuggaaguuccccgacgaggagggggccugccagcccugcccgaucaacugcacccacuccugcguggaccuggacgacaagggcugccccgccgagcagcgggccagcccccucacguccaucaucagcgccguggucgggauccugcugguggugguccucggcgugguguucggcauccugaucaagcgccggcagcagaagauccgcaaguacaccaugcggcgccugcuccaggagaccgagcuggucgagccccugaccccguccggggcgaugcccaaccaggcccagaugcggauccucaaggagaccgagcugcgcaaggugaaggugcugggcagcggggccuucggcacggucuacaaggggaucuggauccccgacggcgagaacgugaagauccccguggccaucaagguccuccgggagaacaccuccccgaaggccaacaaggagauccuggacgaggcguacgugauggccggcguggggagccccuacgucagccgccugcucggcaucugccugaccuccaccgugcagcuggugacgcagcucaugcccuacgggugccugcuggaccacguccgggagaaccgcggccgccucgggagccaggaccugcugaacuggugcaugcagaucgccaagggcauguccuaccucgaggacgugcggcuggugcaccgcgaccuggccgcgcggaacguccucgucaagagccccaaccacgugaagaucaccgacuucggccuggcccgccugcucgacaucgacgagaccgaguaccacgccgacgggggcaaggucccgaucaaguggauggcccuggaguccauccugcggcgccgguucacccaccagagcgacgugugguccuacggggugacggucugggagcucaugaccuucggcgccaagcccuacgacgggauccccgcgcgcgagaucccggaccugcuggagaagggcgagcggcucccccagccgcccaucugcaccaucgacguguacaugaucauggugaagugcuggaugaucgacagcgagugccgcccccgguuccgcgagcuggucuccgaguucagccggauggcccgcgacccccagcgguucguggugauccagaacgaggaccugggccccgccagcccccucgacuccaccuucuaccgcucccugcuggaggacgacgacaugggggaccucgucgacgccgaggaguaccuggugccgcagcagggcuucuucugccccgaccccgcccccggggcgggcggcauggugcaccaccggcaccgcagcuccagcacgcgguccgggggcggggaccugacccucggccuggagccgagcgaggaggaggcgccccgcagcccccuggcccccuccgagggggccggcagcgacgucuucgacggcgaccucgggaugggcgccgccaaggggcugcagucccugccgacccacgaccccagcccccuccagcgguacuccgaggaccccaccgugccgcugcccagcgagacggacggcuacguggcgccccugaccugcuccccgcagcccgaguacgucaaccagcccgacgugcgcccccagcccccgagcccccgcgaggggccccucccggccgcccggcccgccggcgccacccuggagcgccccaagacccugucccccggcaagaacgggguggucaaggacguguucgccuucggcggggccgucgagaacccggaguaccucacgccccagggcggggccgcgccccagccccacccgccgcccgccuucagccccgccuucgacaaccuguacuacugggaccaggacccgcccgagcggggcgccccgcccuccaccuucaagggcacccccaccgccgagaaccccgaguaccuggggcucgacgugcccguguga

SEQ ID NO: 1885 - RNA, 3768 nt, Artificial Sequence
  derived and/or modified sequence opt2 from Her2/neu__Homo_sapiens__AAI67147
auggagcucgccgcccucugccgcuggggccuccuccucgcccuccucccccccggcgccgccuccacccaggucugcaccggcaccgacaugaagcuccgccuccccgccucccccgagacccaccucgacaugcuccgccaccucuaccagggcugccaggucguccagggcaaccucgagcucaccuaccuccccaccaacgccucccucuccuuccuccaggacauccaggagguccagggcuacguccucaucgcccacaaccagguccgccaggucccccuccagcgccuccgcaucguccgcggcacccagcucuucgaggacaacuacgcccucgccguccucgacaacggcgacccccucaacaacaccacccccgucaccggcgccucccccggcggccuccgcgagcuccagcuccgcucccucaccgagauccucaagggcggcguccucauccagcgcaacccccagcucugcuaccaggacaccauccucuggaaggacaucuuccacaagaacaaccagcucgcccucacccucaucgacaccaaccgcucccgcgccugccaccccugcucccccaugugcaagggcucccgcugcuggggcgaguccuccgaggacugccagucccucacccgcaccgucugcgccggcggcugcgcccgcugcaagggcccccuccccaccgacugcugccacgagcagugcgccgccggcugcaccggccccaagcacuccgacugccucgccugccuccacuucaaccacuccggcaucugcgagcuccacugccccgcccucgucaccuacaacaccgacaccuucgaguccaugcccaaccccgagggccgcuacaccuucggcgccuccugcgucaccgccugccccuacaacuaccucuccaccgacgucggcuccugcacccucgucugcccccuccacaaccaggaggucaccgccgaggacggcacccagcgcugcgagaagugcuccaagcccugcgcccgcgucugcuacggccucggcauggagcaccuccgcgagguccgcgccgucaccuccgccaacauccaggaguucgccggcugcaagaagaucuucggcucccucgccuuccuccccgaguccuucgacggcgaccccgccuccaacaccgccccccuccagcccgagcagcuccaggucuucgagacccucgaggagaucaccggcuaccucuacaucuccgccuggcccgacucccuccccgaccucuccgucuuccagaaccuccaggucauccgcggccgcauccuccacaacggcgccuacucccucacccuccagggccucggcaucuccuggcucggccuccgcucccuccgcgagcucggcuccggccucgcccucauccaccacaacacccaccucugcuucguccacaccguccccugggaccagcucuuccgcaacccccaccaggcccuccuccacaccgccaaccgccccgaggacgagugcgucggcgagggccucgccugccaccagcucugcgcccgcggccacugcuggggccccggccccacccagugcgucaacugcucccaguuccuccgcggccaggagugcgucgaggagugccgcguccuccagggccucccccgcgaguacgucaacgcccgccacugccuccccugccaccccgagugccagccccagaacggcuccgucaccugcuucggccccgaggccgaccagugcgucgccugcgcccacuacaaggacccccccuucugcgucgcccgcugccccuccggcgucaagcccgaccucuccuacaugcccaucuggaaguuccccgacgaggagggcgccugccagcccugccccaucaacugcacccacuccugcgucgaccucgacgacaagggcugccccgccgagcagcgcgccuccccccucaccuccaucaucuccgccgucgucggcauccuccucgucgucguccucggcgucgucuucggcauccucaucaagcgccgccagcagaagauccgcaaguacaccaugcgccgccuccuccaggagaccgagcucgucgagccccucacccccuccggcgccaugcccaaccaggcccagaugcgcauccucaaggagaccgagcuccgcaaggucaagguccucggcuccggcgccuucggcaccgucuacaagggcaucuggauccccgacggcgagaacgucaagauccccgucgccaucaagguccuccgcgagaacaccucccccaaggccaacaaggagauccucgacgaggccuacgucauggccggcgucggcucccccuacgucucccgccuccucggcaucugccucaccuccaccguccagcucgucacccagcucaugcccuacggcugccuccucgaccacguccgcgagaaccgcggccgccucggcucccaggaccuccucaacuggugcaugcagaucgccaagggcauguccuaccucgaggacguccgccucguccaccgcgaccucgccgcccgcaacguccucgucaagucccccaaccacgucaagaucaccgacuucggccucgcccgccuccucgacaucgacgagaccgaguaccacgccgacggcggcaagguccccaucaaguggauggcccucgaguccauccuccgccgccgcuucacccaccaguccgacgucugguccuacggcgucaccgucugggagcucaugaccuucggcgccaagcccuacgacggcauccccgcccgcgagauccccgaccuccucgagaagggcgagcgccucccccagccccccaucugcaccaucgacgucuacaugaucauggucaagugcuggaugaucgacuccgagugccgcccccgcuuccgcgagcucgucuccgaguucucccgcauggcccgcgacccccagcgcuucgucgucauccagaacgaggaccucggccccgccuccccccucgacuccaccuucuaccgcucccuccucgaggacgacgacaugggcgaccucgucgacgccgaggaguaccucgucccccagcagggcuucuucugccccgaccccgcccccggcgccggcggcaugguccaccaccgccaccgcuccuccuccacccgcuccggcggcggcgaccucacccucggccucgagcccuccgaggaggaggccccccgcuccccccucgcccccuccgagggcgccggcuccgacgucuucgacggcgaccucggcaugggcgccgccaagggccuccagucccuccccacccacgaccccuccccccuccagcgcuacuccgaggaccccaccgucccccuccccuccgagaccgacggcuacgucgccccccucaccugcuccccccagcccgaguacgucaaccagcccgacguccgcccccagccccccuccccccgcgagggcccccuccccgccgcccgccccgccggcgccacccucgagcgccccaagacccucucccccggcaagaacggcgucgucaaggacgucuucgccuucggcggcgccgucgagaaccccgaguaccucaccccccagggcggcgccgccccccagccccaccccccccccgccuucucccccgccuucgacaaccucuacuacugggaccaggacccccccgagcgcggcgccccccccuccaccuucaagggcacccccaccgccgagaaccccgaguaccucggccucgacguccccgucuga

SEQ ID NO: 1886 - RNA, 3768 nt, Artificial Sequence
  derived and/or modified sequence opt3 from Her2/neu__Homo_sapiens__AAI67147
auggagcuggccgcucucugcagauggggccuucuguuggcauuacugcccccuggggccgcgagcacccagguguguacaggaacugacaugaagcuaaggcucccagcuuccccggaaacgcaccuggauaugcuucggcaucuguaccaagguugccaggucguucagggcaacuuggagcucaccuaucugcccacaaaugccucucugucauuccuccaggacauccaagaagugcagggguacguauuaauugcacacaaccaggugcgccaggucccucugcaacgacuucguauagugagaggaacucaguuguuugaggauaauuaugcccuggcuguucuagacaacggcgauccacucaauaacaccacacccgugaccggugcaaguccugggggacugagggaacuucagcugcggagcuugacugagauccucaaaggcggcguccugauucagcgcaauccacaauuauguuaccaggacacaauccuguggaaggauauuuuccauaaaaacaaucagcucgcccuuacccugaucgacacgaacagauccagggcuugccaccccuguucuccuaugugcaaggggucgcgguguuggggagagucaagcgaagauugccaaaguuugacucgcaccgugugugccgguggcugcgcgcgauguaaagggccacuaccgacagacugcugccaugagcagugugcagccggaugcacuggccccaagcacuccgauugucuggcuugccuccacuuuaaucauucugguauaugugaacugcacugcccugcccuuguaaccuauaacacagacaccuucgagagcaugccaaaucccgaggggagauacacguuuggagcauccuguguuacugcuugcccuuauaacuaccugucaacagaugugggcaguuguaccuuggucugcccacuccauaaucaggaagugacugccgaggacggcacacagaggugugaaaagugcagcaaacccugcgcgcggguguguuacgggcugggaauggagcacuuacgugaaguccgcgccguuaccucugcaaacauccaagaguucgcugguugcaagaaaauuuuuggcucccuggccuuccuaccggagucauuugacggggauccugcuagcaacacggcaccccuccagccagaacagcuucagguguucgagacccuggaagagaucacaggauauuuguacauuagugccuggccugacucucugcccgaucucuccguauuucaaaaucuucaggugaucagaggcaggauacugcacaacggugccuauagccugacuuugcaggggcucggcauuucguggcugggauuacggucucugcgagaacuaggcuccgggcucgcucugauccaucacaauacccaucuuuguuucguccacacagugccaugggaccaguuguuucgcaacccccaucaagcgcugcuccacacugcaaauagaccugaggaugagugcguuggagaaggucuggccugucaccaguuaugcgcuaggggccauuguugggggccaggaccgacccagugcgugaacuguucacaguuccugcggggccaagagugcgucgaagagugucgcgugcuucaggguuugcccagagaauacguaaaugccaggcacugccucccuugccauccagagugucagccccaaaacgggaguguuacaugcuucggcccugaggcagaccaguguguggccugcgcucacuauaaggauccacccuuuugugucgcccguugcccgagcggagugaaaccugaccuguccuacaugccaauuuggaaguuccccgaugaagagggcgcaugucagccuugccccaucaauuguacccacucuugcgucgaccuagaugacaagggguguccagcggaacagcgggcuagcccucugacuucaaucauuagugccgugguuggaauacuccuggugguaguccuuggugugguuuuuggcaucuugauuaaacgaagacaacagaagaucaggaaauauacgaugcgccggcuguuacaggagacagagcucguggaaccccugaccccauccggggcaaugccgaaccaggcccaaaugagaauacuuaaggagacugaacugaggaaagucaagguguugggaagcggcgcuuucgguaccguauacaaagggauuuggaucccugacggcgagaaugugaagauccccguugccauuaagguccuccgcgaaaacacaucuccaaaagcaaauaaggagauccuggaugaggcuuacgugauggccggagugggcucacccuaugucagucgacuacuggggauuugccucaccagcacuguucagcuggugacacagcuuaugccuuacggaugcuugcuggaccaugugcgggaaaaccguggcagauuagguucccaggaucuccugaauugguguaugcaaauagcgaaagggaugucuuaucuugaggacguaaggcugguccaccgcgaucuagccgcucggaacgugcucguuaagucgccaaaccaugugaaaaucacggacuuuggacuggcaagauugcuggauauugacgaaaccgaguaccacgccgauggcgguaagguccccaucaaguggauggcuuuagaaagcauccucaggcgacgcuucacucaucaguccgacguguggucauauggcguuacagugugggagcugaugaccuuuggggccaaaccuuacgauggcauuccggcacgggagauaccagaccuucuggaaaagggagagagauugccccagccuccaaucugcacaauugauguauauaugaucauggucaaauguuggaugauugacagugaaugcaggccccguuuccgcgagcucgugucugaauuuagccggauggcgagagacccucaaagguucguggucauccagaaugaggaucuggggccggccucuccccuagacucaacuuuuuaccgaagccugcuugaggaugacgauaugggagaccucguugaugcugaagaguaccuggugccacagcagggcuucuuuuguccugaccccgccccaggugcagggggaaugguacaccaccggcaucgcuccuccaguaccagaagcggcgguggcgauuugacgcugggguuagaaccuucugaggaggaagcucccagguccccacucgccccgucagagggagcaggcagugacguguucgauggggaccugggaaugggcgccgcuaagggucuucaaagccugccuacccacgaucccucgccauugcagcgguauuccgaagaccccacagucccucucccaucugagacugacggguacguggcgccccugaccugcagcccucagccggaauauguuaaccagccagaugugcgaccccaaccucccucaccaagagagggaccucuacccgccgcacgcccagcuggcgccacacuggagaggccuaaaacucuuaguccggguaagaauggcgucgugaaggacguuuucgccuuugggggagcuguggaaaaccccgaguaccucaccccacagggcggggcagccccucagccccauccaccucccgcguucuccccggcuuuugauaaucuguauuacugggaccaggauccaccugaacguggagcacccccaucuacguucaaaggcacacccaccgccgagaacccugaauauuuggguuuagacgucccgguauga

SEQ ID NO: 1887 - RNA, 3768 nt, Artificial Sequence
  derived and/or modified sequence opt4 from Her2/neu__Homo_sapiens__AAI67147
auggagcuggccgcccugugcagauggggccugcugcuggcccugcugccccccggcgccgccagcacccaggugugcaccggcaccgacaugaagcugagacugcccgccagccccgagacccaccuggacaugcugagacaccuguaccagggcugccagguggugcagggcaaccuggagcugaccuaccugcccaccaacgccagccugagcuuccugcaggacauccaggaggugcagggcuacgugcugaucgcccacaaccaggugagacaggugccccugcagagacugagaaucgugagaggcacccagcuguucgaggacaacuacgcccuggccgugcuggacaacggcgacccccugaacaacaccacccccgugaccggcgccagccccggcggccugagagagcugcagcugagaagccugaccgagauccugaagggcggcgugcugauccagagaaacccccagcugugcuaccaggacaccauccuguggaaggacaucuuccacaagaacaaccagcuggcccugacccugaucgacaccaacagaagcagagccugccaccccugcagccccaugugcaagggcagcagaugcuggggcgagagcagcgaggacugccagagccugaccagaaccgugugcgccggcggcugcgccagaugcaagggcccccugcccaccgacugcugccacgagcagugcgccgccggcugcaccggccccaagcacagcgacugccuggccugccugcacuucaaccacagcggcaucugcgagcugcacugccccgcccuggugaccuacaacaccgacaccuucgagagcaugcccaaccccgagggcagauacaccuucggcgccagcugcgugaccgccugccccuacaacuaccugagcaccgacgugggcagcugcacccuggugugcccccugcacaaccaggaggugaccgccgaggacggcacccagagaugcgagaagugcagcaagcccugcgccagagugugcuacggccugggcauggagcaccugagagaggugagagccgugaccagcgccaacauccaggaguucgccggcugcaagaagaucuucggcagccuggccuuccugcccgagagcuucgacggcgaccccgccagcaacaccgccccccugcagcccgagcagcugcagguguucgagacccuggaggagaucaccggcuaccuguacaucagcgccuggcccgacagccugcccgaccugagcguguuccagaaccugcaggugaucagaggcagaauccugcacaacggcgccuacagccugacccugcagggccugggcaucagcuggcugggccugagaagccugagagagcugggcagcggccuggcccugauccaccacaacacccaccugugcuucgugcacaccgugcccugggaccagcuguucagaaacccccaccaggcccugcugcacaccgccaacagacccgaggacgagugcgugggcgagggccuggccugccaccagcugugcgccagaggccacugcuggggccccggccccacccagugcgugaacugcagccaguuccugagaggccaggagugcguggaggagugcagagugcugcagggccugcccagagaguacgugaacgccagacacugccugcccugccaccccgagugccagccccagaacggcagcgugaccugcuucggccccgaggccgaccagugcguggccugcgcccacuacaaggacccccccuucugcguggccagaugccccagcggcgugaagcccgaccugagcuacaugcccaucuggaaguuccccgacgaggagggcgccugccagcccugccccaucaacugcacccacagcugcguggaccuggacgacaagggcugccccgccgagcagagagccagcccccugaccagcaucaucagcgccguggugggcauccugcuggugguggugcugggcgugguguucggcauccugaucaagagaagacagcagaagaucagaaaguacaccaugagaagacugcugcaggagaccgagcugguggagccccugacccccagcggcgccaugcccaaccaggcccagaugagaauccugaaggagaccgagcugagaaaggugaaggugcugggcagcggcgccuucggcaccguguacaagggcaucuggauccccgacggcgagaacgugaagauccccguggccaucaaggugcugagagagaacaccagccccaaggccaacaaggagauccuggacgaggccuacgugauggccggcgugggcagccccuacgugagcagacugcugggcaucugccugaccagcaccgugcagcuggugacccagcugaugcccuacggcugccugcuggaccacgugagagagaacagaggcagacugggcagccaggaccugcugaacuggugcaugcagaucgccaagggcaugagcuaccuggaggacgugagacuggugcacagagaccuggccgccagaaacgugcuggugaagagccccaaccacgugaagaucaccgacuucggccuggccagacugcuggacaucgacgagaccgaguaccacgccgacggcggcaaggugcccaucaaguggauggcccuggagagcauccugagaagaagauucacccaccagagcgacguguggagcuacggcgugaccgugugggagcugaugaccuucggcgccaagcccuacgacggcauccccgccagagagauccccgaccugcuggagaagggcgagagacugccccagccccccaucugcaccaucgacguguacaugaucauggugaagugcuggaugaucgacagcgagugcagacccagauucagagagcuggugagcgaguucagcagaauggccagagacccccagagauucguggugauccagaacgaggaccugggccccgccagcccccuggacagcaccuucuacagaagccugcuggaggacgacgacaugggcgaccugguggacgccgaggaguaccuggugccccagcagggcuucuucugccccgaccccgcccccggcgccggcggcauggugcaccacagacacagaagcagcagcaccagaagcggcggcggcgaccugacccugggccuggagcccagcgaggaggaggcccccagaagcccccuggcccccagcgagggcgccggcagcgacguguucgacggcgaccugggcaugggcgccgccaagggccugcagagccugcccacccacgaccccagcccccugcagagauacagcgaggaccccaccgugccccugcccagcgagaccgacggcuacguggccccccugaccugcagcccccagcccgaguacgugaaccagcccgacgugagaccccagccccccagccccagagagggcccccugcccgccgccagacccgccggcgccacccuggagagacccaagacccugagccccggcaagaacggcguggugaaggacguguucgccuucggcggcgccguggagaaccccgaguaccugaccccccagggcggcgccgccccccagccccaccccccccccgccuucagccccgccuucgacaaccuguacuacugggaccaggacccccccgagagaggcgccccccccagcaccuucaagggcacccccaccgccgagaaccccgaguaccugggccuggacgugcccguguga

SEQ ID NO: 1888 - RNA, 3768 nt, Artificial Sequence
  derived and/or modified sequence opt5 from Her2/neu__Homo_sapiens__AAI67147
auggagcuggccgcucucugccgguggggccugcuucuggcccuccugcccccuggggcggcuagcacccagguguguacaggaacggacaugaagcugcggcuuccggccucccccgaaacccaccucgauaugcugcgccaucuguaccaaggcugccaggucguucaggggaaccucgagcugacauaucuuccuaccaaugccucucugagcuuccuccaggacauccaagaagugcagggauacgugcugauugcucacaaccaggucagacaggugccccuucaacggcugcgcaucguuagaggcacacagcucuuugaggauaauuaugcccuggcugugcuggacaacggggauccucucaauaacaccacacccgucaccggagccuccccuggcggccugcgggaacuucagcugcgcucucucacggagauucugaaagggggagugcuuauccagagaaauccgcaacuguguuaccaggacaccauucucuggaaggauaucuuccauaaaaacaaucagcuggcgcugacacucaucgacaccaaccggagccgcgccugccaccccuguuccccuaugugcaagggcucuagauguuggggagagagcuccgaagauugccaaagccugacacggaccguuugugcugggggcugcgcccgcuguaaagggccccuuccuacggacugcugccaugagcagugugcugccggaugcacaggccccaagcacucugauugucuggcgugccuccacuuuaaucauuccggcauuugugaacugcacugcccggcccuugugaccuauaacacagacaccuucgagagcaugccuaaucccgaggggagauacaccuuuggagcuucuugugucacagccugcccuuauaacuaccuguccacggaugugggcagcuguacccucgugugcccccugcauaaucaggaagucacagcugaggacgggacccagcggugugaaaagugcucuaaacccugcgcccgcguuuguuacggacugggcauggagcaccucagagaagugcgggccgugacauccgcuaacauccaagaguucgcggggugcaagaaaauuuuuggaagccuggccuuccuuccugaguccuuugacggcgauccggcuucuaacaccgcuccccugcagccugaacagcuccaggucuucgagacgcuggaagagaucacaggcuaucuguacauuagcgccuggcccgacucccuuccugaucucagcguguuucaaaaucugcagguuaucagagggcgcauucugcacaacggagccuauucucucacccugcagggccuugggaucuccuggcugggacuccggagccugagagaacugggcucugggcuugcccucauccaucacaauacccaucuguguuucgugcacacaguccccugggaccagcuguuucgcaacccgcaucaagcgcuccugcacaccgcuaaucggccugaggaugagugcgugggcgaaggacuugccugucaccagcugugcgccagaggccauuguugggggcccggaccuacacagugcguuaacuguagccaguuccuccgcggccaagagugcguggaagagugucggguccugcaggggcugcccagagaauacgugaaugcucgccacugccuuccuugccaucccgagugucagccgcaaaacggauccgucacgugcuucggcccugaggccgaccaguguguggcuugcgcccacuauaaggauccucccuuuuguguugcgcggugccccucuggggugaaaccggaccucagcuacaugcccauuuggaaguucccugaugaagagggcgccugucagcccugcccuaucaauuguacccacuccugcgucgaccuggaugacaagggaugucccgcugaacagagagccagcccucugacaucuauuaucuccgcugugguuggcauucuccugguggucgugcuuggggugguuuuuggaauccugaucaaacgccggcaacagaagauuagaaaauauaccaugcggcgccuccugcaggagacagagcuggucgaaccccuuaccccgagcggcgccaugccuaaccaggcgcaaaugagaauccucaaggagacggaacugcggaaagugaaggugcuggggucuggagccuucggcaccgucuacaaagggauuuggauccccgacggcgagaaugugaagauuccuguugcuaucaaggugcucagagaaaacacaucccccaaagccaauaaggagauccuggaugaggcuuacgucauggccggagugggcagcccguauguuucccgccuucuggggauuugccucaccucuacagugcagcuggucacccagcugaugccuuacggaugccuucuggaccaugugcgggaaaacagaggccgccucgggagccaggaucugcucaauugguguaugcaaaucgccaaaggaauguccuaucuggaggacguuagacuugugcaccgggaucuggcugcgcgcaacguccucgugaagucucccaaccaugugaaaauuacggacuuuggccuggccagacugcuugauaucgacgaaacagaguaccacgcugaugggggcaaggucccuauuaaguggauggcccuggaaagcauccuccggcgcagauucacccaucaguccgacguuuggagcuauggagugacagugugggagcugaugaccuuuggcgccaaacccuacgaugggauucccgcucgggagaucccugaccuccuggaaaagggagagcgccuuccgcagcccccuaucugcaccauugaugucuauaugaucauggugaaauguuggaugauugacucugaaugcagaccccgguuccgcgagcugguuuccgaauuuagcagaauggcccgggacccucaaagauucguggucauccagaaugaggaucucggccccgcgucuccucuggacuccacauuuuaccgcagccugcuugaggaugacgauaugggggaccugguggaugcugaagaguaccucguuccgcagcagggauucuuuugucccgacccugcccccggcgccggcgggauggugcaccaccggcauagaucuagcuccacgcgcagcggaggcggggaucugacccucggacuggaaccuucugaggaggaagcuccccgguccccgcuugccccuagcgagggcgcgggguccgacgucuucgauggagaccugggcaugggcgcugccaaggggcugcaaucucuccccacacacgaucccagcccucugcagagauauuccgaagaccccaccgugccucuuccgucugagacagacggauacguugcuccccugaccugcagcccucagcccgaauaugugaaccagccugauguccgcccccaaccgccuucuccccgggagggcccucuccccgccgccagaccugcuggggccacgcuggagcgccccaaaacacucuccccgggaaagaauggcguggugaaggacgucuucgcguuugggggagccguugaaaacccugaguaccugacaccccagggcggcgcugcuccccagccucauccgcccccugccuucagccccgccuuugauaaucuuuauuacugggaccaggauccucccgaaagaggggccccuccguccaccuucaaaggaacccccaccgcugagaacccugaauaucugggccuggacgugcccguguga

SEQ ID NO: 1889 - protein, 419 aa, Artificial Sequence
  Her2/neu__Homo_sapiens__Q9UK79
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARGTHSLPPRPAAVPVPLRMQPGPAHPVLSFLRPSWDLVSAFYSLPLAPLSPTSVPISPVSVGRGPDPDAHVAVDLSRYEG

SEQ ID NO: 1890 - RNA, 1260 nt, Artificial Sequence
  Her2/neu__Homo_sapiens__AAD56009
auggagcuggcggccuugugccgcugggggcuccuccucgcccucuugccccccggagccgcgagcacccaagugugcaccggcacagacaugaagcugcggcucccugccagucccgagacccaccuggacaugcuccgccaccucuaccagggaugccagguggugcagggaaaccuggaacucaccuaccugcccaccaaugccagccuguccuuccugcaggauauccaggaggugcagggcuacgugcucaucgcucacaaccaagugaggcaggucccacugcagaggcugcggauugugcgaggcacccagcucuuugaggacaacuaugcccuggccgugcuagacaauggagacccgcugaacaauaccaccccugucacaggggccuccccaggaggccugcgggagcugcagcuucgaagccucacagagaucuugaaaggaggggucuugauccagcggaacccccagcucugcuaccaggacacgauuuuguggaaggacaucuuccacaagaacaaccagcuggcucucacacugauagacaccaaccgcucucgggccugccaccccugcucuccgauguguaagggcucccgcugcuggggagagaguucugaggauugucagagccugacgcgcacugucugugccgguggcugugcccgcugcaaggggccacugcccacugacugcugccaugagcagugugcugccggcugcacgggccccaagcacucugacugccuggccugccuccacuucaaccacaguggcaucugugagcugcacugcccagcccuggucaccuacaacacagacacguuugaguccaugcccaaucccgagggccgguauacauucggcgccagcugugucacugccugucccuacaacuaccuuucuacggacgugggauccugcacccucgucugcccccugcacaaccaagaggugacagcagaggauggaacacagcggugugagaagugcagcaagcccugugcccgagguacccacucacugcccccgaggccagcugcaguuccugucccucugcgcaugcagccuggcccagcccacccuguccuauccuuccucagacccucuugggaccuagucucugccuucuacucucuaccccuggccccccucagcccuacaagugucccuauauccccugucaguguggggaggggcccggacccugaugcucauguggcuguugaccugucccgguaugaaggcuga

SEQ ID NO: 1891 - RNA, 1260 nt, Artificial Sequence
  derived and/or modified sequence opt1 from Her2/neu__Homo_sapiens__AAD56009
auggagcuggccgcccucugccgcuggggccugcugcucgcccugcugcccccgggggccgccagcacccaggugugcaccggcacggacaugaagcuccggcugcccgccucccccgagacccaccuggacaugcuccgccaccuguaccaggggugccaggucgugcagggcaaccuggagcucaccuaccugcccaccaacgccagccuguccuuccuccaggacauccaggaggugcagggguacguccugaucgcgcacaaccaggugcgccaggugccgcugcagcggcuccggaucguccgcggcacgcagcuguucgaggacaacuacgcccuggccgugcucgacaacggcgacccccugaacaacaccacccccgugaccggggccagccccggcgggcugcgggagcuccagcugcgcucccugacggagauccucaagggcgggguccugauccagcggaacccgcagcugugcuaccaggacaccauccucuggaaggacaucuuccacaagaacaaccagcuggcgcugacccucaucgacaccaaccgcagccgggccugccaccccugcucccccaugugcaagggcagccgcugcuggggcgaguccagcgaggacugccagucccugacgcggaccgugugcgccgggggcugcgcccgcugcaaggggccccugccgaccgacugcugccacgagcagugcgccgcgggcugcaccggccccaagcacagcgacugccucgccugccugcacuucaaccacuccgggaucugcgagcugcacugccccgcccucgugacguacaacaccgacaccuucgagagcaugcccaacccggagggccgguacaccuucggggccuccugcgucacggccugccccuacaacuaccugagcaccgacgugggcuccugcacccuggugugcccccuccacaaccaggaggucaccgcggaggacgggacgcagcgcugcgagaagugcagcaagcccugcgcccggggcacccacucccugccgccccgccccgccgccgugcccgugccgcugcggaugcagcccggccccgcccaccccguccucagcuuccugcgcccgagcugggaccugguguccgcguucuacagccucccccuggcgccccuguccccgaccagcgugcccaucucccccgucagcguggggcggggccccgacccggacgcccacguggccgucgaccugucccgcuacgagggguga

SEQ ID NO: 1892 - RNA, 1260 nt, Artificial Sequence
  derived and/or modified sequence opt2 from Her2/neu__Homo_sapiens__AAD56009
auggagcucgccgcccucugccgcuggggccuccuccucgcccuccucccccccggcgccgccuccacccaggucugcaccggcaccgacaugaagcuccgccuccccgccucccccgagacccaccucgacaugcuccgccaccucuaccagggcugccaggucguccagggcaaccucgagcucaccuaccuccccaccaacgccucccucuccuuccuccaggacauccaggagguccagggcuacguccucaucgcccacaaccagguccgccaggucccccuccagcgccuccgcaucguccgcggcacccagcucuucgaggacaacuacgcccucgccguccucgacaacggcgacccccucaacaacaccacccccgucaccggcgccucccccggcggccuccgcgagcuccagcuccgcucccucaccgagauccucaagggcggcguccucauccagcgcaacccccagcucugcuaccaggacaccauccucuggaaggacaucuuccacaagaacaaccagcucgcccucacccucaucgacaccaaccgcucccgcgccugccaccccugcucccccaugugcaagggcucccgcugcuggggcgaguccuccgaggacugccagucccucacccgcaccgucugcgccggcggcugcgcccgcugcaagggcccccuccccaccgacugcugccacgagcagugcgccgccggcugcaccggccccaagcacuccgacugccucgccugccuccacuucaaccacuccggcaucugcgagcuccacugccccgcccucgucaccuacaacaccgacaccuucgaguccaugcccaaccccgagggccgcuacaccuucggcgccuccugcgucaccgccugccccuacaacuaccucuccaccgacgucggcuccugcacccucgucugcccccuccacaaccaggaggucaccgccgaggacggcacccagcgcugcgagaagugcuccaagcccugcgcccgcggcacccacucccuccccccccgccccgccgccguccccgucccccuccgcaugcagcccggccccgcccaccccguccucuccuuccuccgccccuccugggaccucgucuccgccuucuacucccucccccucgccccccucucccccaccuccguccccaucucccccgucuccgucggccgcggccccgaccccgacgcccacgucgccgucgaccucucccgcuacgagggcuga

SEQ ID NO: 1893 - RNA, 1260 nt, Artificial Sequence
  derived and/or modified sequence opt3 from Her2/neu__Homo_sapiens__AAD56009
auggagcuggccgcucucugcagauggggccuucuguuggcauuacugcccccuggggccgcgagcacccagguguguacaggaacugacaugaagcuaaggcucccagcuuccccggaaacgcaccuggauaugcuucggcaucuguaccaagguugccaggucguucagggcaacuuggagcucaccuaucugcccacaaaugccucucugucauuccuccaggacauccaagaagugcagggguacguauuaauugcacacaaccaggugcgccaggucccucugcaacgacuucguauagugagaggaacucaguuguuugaggauaauuaugcccuggcuguucuagacaacggcgauccacucaauaacaccacacccgugaccggugcaaguccugggggacugagggaacuucagcugcggagcuugacugagauccucaaaggcggcguccugauucagcgcaauccacaauuauguuaccaggacacaauccuguggaaggauauuuuccauaaaaacaaucagcucgcccuuacccugaucgacacgaacagauccagggcuugccaccccuguucuccuaugugcaaggggucgcgguguuggggagagucaagcgaagauugccaaaguuugacucgcaccgugugugccgguggcugcgcgcgauguaaagggccacuaccgacagacugcugccaugagcagugugcagccggaugcacuggccccaagcacuccgauugucuggcuugccuccacuuuaaucauucugguauaugugaacugcacugcccugcccuuguaaccuauaacacagacaccuucgagagcaugccaaaucccgaggggagauacacguuuggagcauccuguguuacugcuugcccuuauaacuaccugucaacagaugugggcaguuguaccuuggucugcccacuccauaaucaggaagugacugccgaggacggcacacagaggugugaaaagugcagcaaacccugcgcgcgggggacccacucucugccgccucgucccgccgcagugccagucccuuuacgcaugcaacccggaccagcucaccccguucuguccuuccuaagaccuucaugggaccucgugagcgccuuuuacagucugccacuugcuccguugucucccacguccguaccuaucagcccagugucggucgguaggggccccgauccugacgcccauguggcaguugaucugucucgguaugagggguga

SEQ ID NO: 1894 - RNA, 1260 nt, Artificial Sequence
  derived and/or modified sequence opt4 from Her2/neu__Homo_sapiens__AAD56009
auggagcuggccgcccugugcagauggggccugcugcuggcccugcugccccccggcgccgccagcacccaggugugcaccggcaccgacaugaagcugagacugcccgccagccccgagacccaccuggacaugcugagacaccuguaccagggcugccagguggugcagggcaaccuggagcugaccuaccugcccaccaacgccagccugagcuuccugcaggacauccaggaggugcagggcuacgugcugaucgcccacaaccaggugagacaggugccccugcagagacugagaaucgugagaggcacccagcuguucgaggacaacuacgcccuggccgugcuggacaacggcgacccccugaacaacaccacccccgugaccggcgccagccccggcggccugagagagcugcagcugagaagccugaccgagauccugaagggcggcgugcugauccagagaaacccccagcugugcuaccaggacaccauccuguggaaggacaucuuccacaagaacaaccagcuggcccugacccugaucgacaccaacagaagcagagccugccaccccugcagccccaugugcaagggcagcagaugcuggggcgagagcagcgaggacugccagagccugaccagaaccgugugcgccggcggcugcgccagaugcaagggcccccugcccaccgacugcugccacgagcagugcgccgccggcugcaccggccccaagcacagcgacugccuggccugccugcacuucaaccacagcggcaucugcgagcugcacugccccgcccuggugaccuacaacaccgacaccuucgagagcaugcccaaccccgagggcagauacaccuucggcgccagcugcgugaccgccugccccuacaacuaccugagcaccgacgugggcagcugcacccuggugugcccccugcacaaccaggaggugaccgccgaggacggcacccagagaugcgagaagugcagcaagcccugcgccagaggcacccacagccugccccccagacccgccgccgugcccgugccccugagaaugcagcccggccccgcccaccccgugcugagcuuccugagacccagcugggaccuggugagcgccuucuacagccugccccuggccccccugagccccaccagcgugcccaucagccccgugagcgugggcagaggccccgaccccgacgcccacguggccguggaccugagcagauacgagggcuga

SEQ ID NO: 1895 - RNA, 1260 nt, Artificial Sequence
  derived and/or modified sequence opt5 from Her2/neu__Homo_sapiens__AAD56009
auggagcuggccgcucucugcagauggggccugcuucuggcccuccugcccccuggggcggcuagcacccagguguguacaggaacggacaugaagcugcggcuuccggccucccccgaaacccaccucgauaugcugcgccaucuguaccaaggcugccaggucguucaggggaaccucgagcugacauaucuuccuaccaaugccucucugagcuuccuccaggacauccaagaagugcagggauacgugcugauugcucacaaccaggucagacaggugccccuucaacggcugcgcaucguuagaggcacacagcucuuugaggauaauuaugcccuggcugugcuggacaacggggauccucucaauaacaccacacccgucaccggagccuccccuggcggccugcgggaacuucagcugcgcucucucacggagauucugaaagggggagugcuuauccagagaaauccgcaacuguguuaccaggacaccauucucuggaaggauaucuuccauaaaaacaaucagcuggcgcugacacucaucgacaccaaccggagccgcgccugccaccccuguuccccuaugugcaagggcucuagauguuggggagagagcuccgaagauugccaaagccugacacggaccguuugugcugggggcugcgcccgcuguaaagggccccuuccuacggacugcugccaugagcagugugcugccggaugcacaggccccaagcacucugauugucuggcgugccuccacuuuaaucauuccggcauuugugaacugcacugcccggcccuugugaccuauaacacagacaccuucgagagcaugccuaaucccgaggggagauacaccuuuggagcuucuugugucacagccugcccuuauaacuaccuguccacggaugugggcagcuguacccucgugugcccccugcauaaucaggaagucacagcugaggacgggacccagcggugugaaaagugcucuaaacccugcgcccgcggaacacacucccugccuccgagacccgccgcuguuccugugccccuccggaugcaaccuggccccgcgcacccggugcugagcuuccuuagaccuuccugggaccuggucucugccuuuuacagccucccccuggcuccucugucccccaccagcgugccuaucucucccguuuccguggggcgcggaccggauccugacgcccaugucgccguggaucuuagccgguaugagggcuga

SEQ ID NO: 1896 - protein, 182 aa, Artificial Sequence
  HLA-A2/m__Homo_sapiens__Q95387
GSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWETAHVAEQLRAYLEGTCVEWLRRYLENGKETLQRT

SEQ ID NO: 1897 - RNA, 546 nt, Artificial Sequence
  HLA-A2/m__Homo_sapiens__U70863.1
ggcucucacuccaugagguauuucuucacauccgugucccggcccggccgcggggagccccgcuucaucgcagugggcuacguggacgacacgcaguucgugcgguucgacagcgacgccgcgagccagaggauggagccgcgggcgccguggauagagcaggaggguccggaguauugggacggggagacacggaaagugaaggcccacucacagacucaccgaguggaccuggggacccugcgcggcuacuacaaccagagcgaggccgguucucacaccguccagaggauguauggcugcgacguggggucggacuggcgcuuccuccgcggguaccaccaguacgccuacgacggcaaggauuacaucgcccugaaagaggaccugcgcucuuggaccgcggcggacauggcagcucagaccaccaagcacaagugggagacggcccauguggcggagcaguugagagccuaccuggagggcacgugcguggaguggcuccgcagauaccuggagaacgggaaggagacgcugcagcgcacg

SEQ ID NO: 1898 - RNA, 546 nt, Artificial Sequence
  derived and/or modified sequence opt1 from HLA-A2/m__Homo_sapiens__U70863.1
ggcagccacuccaugcgcuacuucuucaccagcgugucccggcccgggcgcggcgagccgcgguucaucgccgucggguacguggacgacacccaguucgugcgcuucgacagcgacgccgcgucccagcggauggagccccgcgcccccuggaucgagcaggagggccccgaguacugggacggggagacgcggaaggucaaggcccacagccagacccaccgcguggaccugggcacccuccggggcuacuacaaccaguccgaggccgggagccacaccgugcagcgcauguacggcugcgacgucggguccgacuggcgguuccugcgcggcuaccaccaguacgccuacgacgggaaggacuacaucgcgcugaaggaggaccuccggagcuggacggccgccgacauggccgcgcagaccaccaagcacaagugggagaccgcccacguggccgagcagcugcgcgccuaccuggagggcacgugcguggaguggcuccggcgcuaccuggagaacggcaaggagacccugcagcggacc

SEQ ID NO: 1899 - RNA, 546 nt, Artificial Sequence
  derived and/or modified sequence opt2 from HLA-A2/m__Homo_sapiens__U70863.1
ggcucccacuccaugcgcuacuucuucaccuccgucucccgccccggccgcggcgagccccgcuucaucgccgucggcuacgucgacgacacccaguucguccgcuucgacuccgacgccgccucccagcgcauggagccccgcgcccccuggaucgagcaggagggccccgaguacugggacggcgagacccgcaaggucaaggcccacucccagacccaccgcgucgaccucggcacccuccgcggcuacuacaaccaguccgaggccggcucccacaccguccagcgcauguacggcugcgacgucggcuccgacuggcgcuuccuccgcggcuaccaccaguacgccuacgacggcaaggacuacaucgcccucaaggaggaccuccgcuccuggaccgccgccgacauggccgcccagaccaccaagcacaagugggagaccgcccacgucgccgagcagcuccgcgccuaccucgagggcaccugcgucgaguggcuccgccgcuaccucgagaacggcaaggagacccuccagcgcacc

SEQ ID NO: 1900 - RNA, 546 nt, Artificial Sequence
  derived and/or modified sequence opt3 from HLA-A2/m__Homo_sapiens__U70863.1
ggcagccacuccaugagauacuucuuuaccucugugucaaggcccgggcggggagagccucgcuucaucgccgucgguuauguugacgauacacaguuugugcgauucgacagugaugcugcaagccaacguauggaaccaagagccccguggauugagcaggaaggccccgaguacugggacggggaaacuaggaagguaaaagcgcauucccagacgcaccggguggaucugggaacccuccgcggcuauuacaaccagucugaggcugguucgcauacaguccaaagaauguaugggugcgacgugggaucagauuggagguuucuucggggcuaccaccaguaugccuacgacggcaaggauuacauagcacugaaagaggacuugcgcagcuggacugccgcugauauggcagcccagaccacaaagcauaaaugggaaaccgcucacguugccgagcaguuacgagcguaucuggaagggacuuguguggaguggcuaagaagguaccucgagaauggaaaggaaacacugcaacggacc

SEQ ID NO: 1901 - RNA, 546 nt, Artificial Sequence
  derived and/or modified sequence opt4 from HLA-A2/m__Homo_sapiens__U70863.1
ggcagccacagcaugagauacuucuucaccagcgugagcagacccggcagaggcgagcccagauucaucgccgugggcuacguggacgacacccaguucgugagauucgacagcgacgccgccagccagagaauggagcccagagcccccuggaucgagcaggagggccccgaguacugggacggcgagaccagaaaggugaaggcccacagccagacccacagaguggaccugggcacccugagaggcuacuacaaccagagcgaggccggcagccacaccgugcagagaauguacggcugcgacgugggcagcgacuggagauuccugagaggcuaccaccaguacgccuacgacggcaaggacuacaucgcccugaaggaggaccugagaagcuggaccgccgccgacauggccgcccagaccaccaagcacaagugggagaccgcccacguggccgagcagcugagagccuaccuggagggcaccugcguggaguggcugagaagauaccuggagaacggcaaggagacccugcagagaacc

SEQ ID NO: 1902 - RNA, 546 nt, Artificial Sequence
  derived and/or modified sequence opt5 from HLA-A2/m__Homo_sapiens__U70863.1
ggcagccacuccaugagauacuucuuuaccucugugagccggcccgggcgcggagagccuagauucaucgccgucggcuauguugacgauacacaguuugugcgguucgacuccgaugcugccucucaacgcauggaaccgagagcgcccuggauugagcaggaagggccugaguacugggacggagaaacgcggaaggugaaagcucauagccagacccaccgcgucgaucugggcacacucagaggguauuacaaccaguccgaggccggaucucauaccgugcaacggauguauggcugcgacguuggcagcgauuggcgcuuucugagaggguaccaccaguaugccuacgacggaaaggauuacaucgcucuuaaagaggaccugcgguccuggacagccgcugauauggccgcgcagaccacaaagcauaaaugggaaaccgcccacguggcugagcagcuccgcgccuaucuggaaggcacgugugucgaguggcuuagacgguaccuggagaaugggaaggaaacccuccaacgcaca

SEQ ID NO: 1903 - protein, 181 aa, Artificial Sequence
  HLA-A2/m__Homo_sapiens__Q9MYF8
SHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRT

SEQ ID NO: 1904 - RNA, 543 nt, Artificial Sequence
  HLA-A2/m__Homo_sapiens__AH009136.2
ucucacuccaugagguauuucuucacauccgugucccggcccggccgcggggagccccgcuucaucgcagugggcuacguggacgacacgcaguucgugcgguucgacagcgacgccgcgagccagaggauggagccgcgggcgccguggauagagcaggaggguccggaguauugggacggggagacacggaaagugaaggcccacucacagacucaccgaguggaccuggggacccugcgcggcuacuacaaccagagcgaggccgguucucacaccguccagaggauguauggcugcgacguggggucggacuggcgcuuccuccgcggguaccaccaguacgccuacgacggcaaggauuacaucgcccugaaagaagaccugcgcucuuggaccgcggcggacauggcagcucagaccaccaagcacaagugggaggcggcccauguggcggagcaguugagagccuaccuggagggcacgugcguggaguggcuccgcagauaccuggagaacgggaaggagacgcugcagcgcacg

SEQ ID NO: 1905 - RNA, 543 nt, Artificial Sequence
  derived and/or modified sequence opt1 from HLA-A2/m__Homo_sapiens__AH009136.2
agccacuccaugcgcuacuucuucaccagcgugucccggcccggccgcggggagccgcgguucaucgccgucggcuacguggacgacacccaguucgugcgcuucgacagcgacgccgcgucccagcggauggagccccgcgcccccuggaucgagcaggaggggcccgaguacugggacggcgagacgcggaaggucaaggcccacagccagacccaccgcguggaccuggggacccuccggggcuacuacaaccaguccgaggccggcagccacaccgugcagcgcauguacgggugcgacgucggcuccgacuggcgguuccugcgcggguaccaccaguacgccuacgacggcaaggacuacaucgcgcugaaggaggaccuccggagcuggacggccgccgacauggccgcgcagaccaccaagcacaagugggaggccgcccacguggccgagcagcugcgcgccuaccuggaggggaccugcguggaguggcuccggcgcuaccuggagaacggcaaggagacgcugcagcggacc

SEQ ID NO: 1906 - RNA, 543 nt, Artificial Sequence
  derived and/or modified sequence opt2 from HLA-A2/m__Homo_sapiens__AH009136.2
ucccacuccaugcgcuacuucuucaccuccgucucccgccccggccgcggcgagccccgcuucaucgccgucggcuacgucgacgacacccaguucguccgcuucgacuccgacgccgccucccagcgcauggagccccgcgcccccuggaucgagcaggagggccccgaguacugggacggcgagacccgcaaggucaaggcccacucccagacccaccgcgucgaccucggcacccuccgcggcuacuacaaccaguccgaggccggcucccacaccguccagcgcauguacggcugcgacgucggcuccgacuggcgcuuccuccgcggcuaccaccaguacgccuacgacggcaaggacuacaucgcccucaaggaggaccuccgcuccuggaccgccgccgacauggccgcccagaccaccaagcacaagugggaggccgcccacgucgccgagcagcuccgcgccuaccucgagggcaccugcgucgaguggcuccgccgcuaccucgagaacggcaaggagacccuccagcgcacc

SEQ ID NO: 1907 - RNA, 543 nt, Artificial Sequence
  derived and/or modified sequence opt3 from HLA-A2/m__Homo_sapiens__AH009136.2
agccacuccaugagauacuucuuuaccucugugucaaggcccggccgcggggagccucgguucaucgccgucggauauguugacgauacacaguuugugcgauucgacagugaugcugcaagccaacguauggaaccaagagccccguggauugagcaggaaggucccgaguacugggacggcgaaacuaggaagguaaaagcgcauucccagacgcaccggguggaucuggggacccuccgcggauauuacaaccagucugaggcuggcucgcauacaguccaaagaauguaugguugcgacguggggucagauuggagguuucuucggggauaccaccaguaugccuacgacggcaaggauuacauagcacugaaagaggacuugcgcagcuggacugccgcugauauggcagcccagaccacaaagcauaaaugggaagcugcccacguugcggagcaguuacgagcauaucuggaaggcaccuguguggaguggcuaagaagguaccucgagaaugggaaggaaacucugcaacggaca

SEQ ID NO: 1908 - RNA, 543 nt, Artificial Sequence
  derived and/or modified sequence opt4 from HLA-A2/m__Homo_sapiens__AH009136.2
agccacagcaugagauacuucuucaccagcgugagcagacccggcagaggcgagcccagauucaucgccgugggcuacguggacgacacccaguucgugagauucgacagcgacgccgccagccagagaauggagcccagagcccccuggaucgagcaggagggccccgaguacugggacggcgagaccagaaaggugaaggcccacagccagacccacagaguggaccugggcacccugagaggcuacuacaaccagagcgaggccggcagccacaccgugcagagaauguacggcugcgacgugggcagcgacuggagauuccugagaggcuaccaccaguacgccuacgacggcaaggacuacaucgcccugaaggaggaccugagaagcuggaccgccgccgacauggccgcccagaccaccaagcacaagugggaggccgcccacguggccgagcagcugagagccuaccuggagggcaccugcguggaguggcugagaagauaccuggagaacggcaaggagacccugcagagaacc

SEQ ID NO: 1909 - RNA, 543 nt, Artificial Sequence
  derived and/or modified sequence opt5 from HLA-A2/m__Homo_sapiens__AH009136.2
agccacuccaugagauacuucuuuaccucugugagccggcccggccgcggggagccuagauucaucgccgucggauauguugacgauacacaguuugugcgguucgacuccgaugcugccucucaacgcauggaaccgagagcgcccuggauugagcaggaaggcccugaguacugggacggggaaacgcggaaggugaaagcucauagccagacccaccgcgucgaucugggaacacucagaggcuauuacaaccaguccgaggccgggucucauaccgugcaacggauguauggaugcgacguuggcagcgauuggcgcuuucugagaggcuaccaccaguaugccuacgacgggaaggauuacaucgcucuuaaagaggaccugcgguccuggacagccgcugauauggccgcgcagaccacaaagcauaaaugggaagccgcucacguggccgagcagcuccgcgcuuaucuggaaggaaccugugucgaguggcuuagacgguaccuggagaauggcaaggaaacgcuccaacgcacc

SEQ ID NO: 1910 - protein, 234 aa, Artificial Sequence
  homeobox_NKX3.1__Homo_sapiens__Q99801
MLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 1911 - RNA, 705 nt, Artificial Sequence
  homeobox_NKX3.1__Homo_sapiens__AAG09781
augcucaggguuccggagccgcggcccggggaggcgaaagcggagggggccgcgccgccgaccccguccaagccgcucacguccuuccucauccaggacauccugcgggacggcgcgcagcggcaaggcggccgcacgagcagccagagacagcgcgacccggagccggagccagagccagagccagagggaggacgcagccgcgccggggcgcagaacgaccagcugagcaccgggccccgcgccgcgccggaggaggccgagacgcuggcagagaccgagccagaaaggcacuuggggucuuaucuguuggacucugaaaacacuucaggcgcccuuccaaggcuuccccaaaccccuaagcagccgcagaagcgcucccgagcugccuucucccacacucaggugaucgaguuggagaggaaguucagccaucagaaguaccugucagccccugaacgggcccaccuggccaagaaccucaagcucacggagacccaagugaagauaugguuccagaacagacgcuauaagacuaagcgaaagcagcucuccucggagcugggagacuuggagaagcacuccucuuugccggcccugaaagaggaggccuucucccgggccucccuggucuccguguauaacagcuauccuuacuacccauaccuguacugcgugggcagcuggagcccagcuuuuugguaa

SEQ ID NO: 1912 - RNA, 705 nt, Artificial Sequence
  derived and/or modified sequence opt1 from homeobox_NKX3.1__Homo_sapiens__AAG09781
augcugcgcgugcccgagccgcggcccggcgaggccaaggccgagggggcggccccgcccacccccagcaagccccucaccuccuuccugauccaggacauccugcgcgacggcgcccagcggcagggcgggcgcacgagcucccagcggcagcgcgaccccgagcccgagccggagcccgagcccgagggcgggcggagccgcgccggcgcccagaacgaccagcucuccaccgggccccgggcggccccggaggaggccgagacccuggccgagaccgagcccgagcgccaccugggcagcuaccuccuggacuccgagaacacgagcggggcgcugccccggcucccccagaccccgaagcagccccagaagcgcucccgggccgccuucagccacacccaggucaucgagcuggagcgcaaguucucccaccagaaguaccugagcgcccccgagcgggcccaccucgcgaagaaccugaagcugaccgagacccaggugaagaucugguuccagaaccgccgguacaagacgaagcgcaagcagcucuccagcgagcugggcgaccuggagaagcacuccagccuccccgcccugaaggaggaggccuucucccgggccagccugguguccgucuacaacagcuacccguacuaccccuaccucuacugcguggggagcuggucccccgccuucugguga

SEQ ID NO: 1913 - RNA, 705 nt, Artificial Sequence
  derived and/or modified sequence opt2 from homeobox_NKX3.1__Homo_sapiens__AAG09781
augcuccgcguccccgagccccgccccggcgaggccaaggccgagggcgccgccccccccacccccuccaagccccucaccuccuuccucauccaggacauccuccgcgacggcgcccagcgccagggcggccgcaccuccucccagcgccagcgcgaccccgagcccgagcccgagcccgagcccgagggcggccgcucccgcgccggcgcccagaacgaccagcucuccaccggcccccgcgccgcccccgaggaggccgagacccucgccgagaccgagcccgagcgccaccucggcuccuaccuccucgacuccgagaacaccuccggcgcccucccccgccucccccagacccccaagcagccccagaagcgcucccgcgccgccuucucccacacccaggucaucgagcucgagcgcaaguucucccaccagaaguaccucuccgcccccgagcgcgcccaccucgccaagaaccucaagcucaccgagacccaggucaagaucugguuccagaaccgccgcuacaagaccaagcgcaagcagcucuccuccgagcucggcgaccucgagaagcacuccucccuccccgcccucaaggaggaggccuucucccgcgccucccucgucuccgucuacaacuccuaccccuacuaccccuaccucuacugcgucggcuccuggucccccgccuucugguga

SEQ ID NO: 1914 - RNA, 705 nt, Artificial Sequence
  derived and/or modified sequence opt3 from homeobox_NKX3.1__Homo_sapiens__AAG09781
augcugagagugcccgagccuaggccaggcgaagccaaggcugagggggcagccccgcccaccccuagcaaaccacucacauccuuccuuauccaggacauucugcgggauggagcgcaacgccaggguggccgaacuucuucacagcgucagagagaccccgaaccugagccagaacccgagccugaagggggaaggagucgggcuggcgcccaaaacgaucaguugagcacggguccacgcgcagccccggaggaggcugaaaccuuagcagagacagagcccgaaagacaccugggguccuaccuacucgacucugagaauacuucgggagcccugccuaggcuuccacagacccccaagcagccucaaaaacggucacgcgcugccuuuagccauacacaggucauagaacuggagcgaaaguucagucaccagaaauauuuguccgcgccagaaagagcacaucucgccaagaaccugaagcugaccgagacucagguuaaaaucugguuucaaaauaggcgguacaagacaaaacguaagcagcucucuagcgaguuaggcgaucuggaaaaacacuccucacuucccgcuuugaaggaggaagccuucagucgcgcaagccuggugucuguauauaacuccuacccguauuacccuuaucuauacugcgugggcucauggagccccgcuuuuugguga

SEQ ID NO: 1915 - RNA, 705 nt, Artificial Sequence
  derived and/or modified sequence opt4 from homeobox_NKX3.1__Homo_sapiens__AAG09781
augcugagagugcccgagcccagacccggcgaggccaaggccgagggcgccgccccccccacccccagcaagccccugaccagcuuccugauccaggacauccugagagacggcgcccagagacagggcggcagaaccagcagccagagacagagagaccccgagcccgagcccgagcccgagcccgagggcggcagaagcagagccggcgcccagaacgaccagcugagcaccggccccagagccgcccccgaggaggccgagacccuggccgagaccgagcccgagagacaccugggcagcuaccugcuggacagcgagaacaccagcggcgcccugcccagacugccccagacccccaagcagccccagaagagaagcagagccgccuucagccacacccaggugaucgagcuggagagaaaguucagccaccagaaguaccugagcgcccccgagagagcccaccuggccaagaaccugaagcugaccgagacccaggugaagaucugguuccagaacagaagauacaagaccaagagaaagcagcugagcagcgagcugggcgaccuggagaagcacagcagccugcccgcccugaaggaggaggccuucagcagagccagccuggugagcguguacaacagcuaccccuacuaccccuaccuguacugcgugggcagcuggagccccgccuucugguga

SEQ ID NO: 1916 - RNA, 705 nt, Artificial Sequence
  derived and/or modified sequence opt5 from homeobox_NKX3.1__Homo_sapiens__AAG09781
augcugagagugcccgagccucggccgggcgaagccaaggcugagggggccgcgcccccuacccccagcaaaccucucacauccuuccugauccaggacauucuucgcgauggagcucaaagacagggcgggcggacgucuagccagcgccagagagaccccgaaccugagccggaacccgagccugagggaggccggucccgcgccggggcccaaaacgaucagcugucuaccggacccagagcugccccugaagaggcugaaacacucgccgagaccgagcccgaacggcaccugggcagcuaccuucuggacuccgagaauacaucuggcgcgcucccgcgccugccucagacccccaagcagccucagaaaagaagccgggccgcuuuuucccauacacaagucaucgaacuggagcgcaaguucagccaccagaaauaucucucugcccccgaaagagcucaucuggccaagaaccuuaagcugaccgagacgcagguuaaaauuugguuucaaaaucggcgcuacaagaccaaaagaaagcagcucuccagcgagcugggggaucuugaaaaacacucuucccugcccgcgcucaaggaggaagccuucagccgggcuucucugguguccguguauaacagcuacccuuauuacccguaucuguacugcgucggauccuggucucccgccuuuugguga

SEQ ID NO: 1917 - protein, 313 aa, Artificial Sequence
  HOM-TES-85__Homo_sapiens__B2RBQ6
MASFRKLTLSEKVPPNHPSRKKVNFLDMSLDDIIIYKELEGTNAEEEKNKRQNHSKKESPSRQQSKAHRHRHRRDYSRCRSNSEEGNHDKKPSQKPSGFKSGQHPLNGQPLIEQEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 1918 - RNA, 942 nt, Artificial Sequence
  HOM-TES-85__Homo_sapiens__BAG37303
auggcuucguuucggaagcuaacgcuuucugaaaaagugccgccaaaucaucccagucggaaaaagguuaacuuccuagauaugucucuagacgacauuauaaucuauaaagaguuagaagggacaaaugcugaagaagaaaagaauaaaagacagaaccauaguaaaaaggaaucgccuucaagacagcaaucaaaagcucauagacaucgccaucggagagacuacucaagaugcagaagcaacucugaggaaggaaaucaugauaaaaaaccaucccaaaaaccuucuggauucaagucuggacaacacccuuuaaaugggcagccuuuaauugagcaggagaagugcagugacaauuaugaggcccaagcagagaagaaucaaggccagucagaggggaaccagcaucaaucagaaggaaauccggacaaaucagaagaaucccagggccaaccagaagaaaaucaucauucugagcgaucccgaaaccacuuagagagaucucuuucucagucagacagaucucaagggcagcuaaagagacaucauccccaauaugagagaucucauggccaauacaagagaucucauggucagucugagagaucucauggccacucagagagaucucauggucacucagagagaucucauggucacucagagagaucucauggucacucaaagagaucucguagccagggagaucuuguggacacucagagugaucucauagccacucagagagaucucauagccacucagaaagaucucauagccacucagagagaucucauagccacucagagagaucucauagucacucagagagaucucguggccacugagagagaucucauaaaucagucagggagaucucauggccaaucagaaagacaucagagauacucaacagguaaaaauacaauaacuacuuaa

SEQ ID NO: 1919 - RNA, 942 nt, Artificial Sequence
  derived and/or modified sequence opt1 from HOM-TES-85__Homo_sapiens__BAG37303
auggccagcuuccgcaagcugacccucuccgagaaggugcccccgaaccaccccagccggaagaaggucaacuuccuggacaugucccuggacgacaucaucaucuacaaggagcucgagggcaccaacgccgaggaggagaagaacaagcgccagaaccacagcaagaaggagucccccagccggcagcaguccaaggcgcaccgccaccggcaccgccgggacuacagccgcugccgguccaacagcgaggaggggaaccacgacaagaagcccucccagaagccgagcggcuucaaguccgggcagcacccccugaacggccagccccugaucgagcaggagaagugcagcgacaacuacgaggcccaggccgagaagaaccaggggcaguccgagggcaaccagcaccagagcgagggcaaccccgacaaguccgaggagagccaggggcagccggaggagaaccaccacuccgagcgcagccggaaccaccucgagcgcagccugucccagagcgaccggucccagggccagcugaagcgccaccacccccaguacgagcggagccacgggcaguacaagcgcucccacggccagagcgagcggucccacgggcacagcgagcgcucccacggccacagcgagcggucccacggccacagcgagcgcucccacgggcacagcaagcggucccgcagccagggcgaccucguggacacgcaguccgaccugaucgccacccagcgcgaccugaucgccacccagaaggaccucaucgcgacccagcgggaccugaucgccacgcagcgcgaccugaucgugacccagcgggaccucgucgccaccgagcgcgaccugaucaaccagagcgggcggucccacggccagagcgagcgccaccagcgguacagcaccggcaagaacacgaucaccaccuga

SEQ ID NO: 1920 - RNA, 942 nt, Artificial Sequence
  derived and/or modified sequence opt2 from HOM-TES-85__Homo_sapiens__BAG37303
auggccuccuuccgcaagcucacccucuccgagaaggucccccccaaccaccccucccgcaagaaggucaacuuccucgacaugucccucgacgacaucaucaucuacaaggagcucgagggcaccaacgccgaggaggagaagaacaagcgccagaaccacuccaagaaggagucccccucccgccagcaguccaaggcccaccgccaccgccaccgccgcgacuacucccgcugccgcuccaacuccgaggagggcaaccacgacaagaagcccucccagaagcccuccggcuucaaguccggccagcacccccucaacggccagccccucaucgagcaggagaagugcuccgacaacuacgaggcccaggccgagaagaaccagggccaguccgagggcaaccagcaccaguccgagggcaaccccgacaaguccgaggagucccagggccagcccgaggagaaccaccacuccgagcgcucccgcaaccaccucgagcgcucccucucccaguccgaccgcucccagggccagcucaagcgccaccacccccaguacgagcgcucccacggccaguacaagcgcucccacggccaguccgagcgcucccacggccacuccgagcgcucccacggccacuccgagcgcucccacggccacuccgagcgcucccacggccacuccaagcgcucccgcucccagggcgaccucgucgacacccaguccgaccucaucgccacccagcgcgaccucaucgccacccagaaggaccucaucgccacccagcgcgaccucaucgccacccagcgcgaccucaucgucacccagcgcgaccucgucgccaccgagcgcgaccucaucaaccaguccggccgcucccacggccaguccgagcgccaccagcgcuacuccaccggcaagaacaccaucaccaccuga

SEQ ID NO: 1921 - RNA, 942 nt, Artificial Sequence
  derived and/or modified sequence opt3 from HOM-TES-85__Homo_sapiens__BAG37303
auggccagcuucagaaagcugacccucuccgagaaagugcccccuaaccacccaucuaggaagaaagucaauuuucuugacaugucacuggaugacaucauuauauacaaggaauuggagggcacaaacgcugaagaggagaaaaauaagcggcagaaccauaguaagaaagaaagcccgucccgccaacagucuaaggcacaccgacaucgucacagaagggauuauucgcggugccgcucaaauagcgaggaagggaaccaugacaaaaagcccagucagaaaccuuccggauucaagucuggucagcacccauuaaauggccaaccccugaucgagcaggaaaaguguagcgauaacuacgaggcccaggcggagaaaaaucaggggcaauccgaaggaaaccagcaccagucagagggcaauccugacaagagugaagagagccagggucaaccagaagagaaccaucacucugagagauccaggaaucaucuagaacggucacucagccagagugaucgcucucaggggcaacugaaacgacaccacccccaguaugagagaucccauggacaguacaagaggagccacggccagucggaacggucucauggccacuccgagcguucacaugggcacagugaacgcagccacggacauuccgagagaucucacggucauagcaaaaggucacggagucaaggcgaccuuguugauacucaguccgaccugauugcuacgcagcgagauuugaucgccacccagaaggaccucauugcaacacaacgcgaucugaucgccacucagagagaccugauagugacccagagggaccucguagcuacagagcgggauuuaaucaaccagagcgggcgcucucacggacaaucagaaagacaccagagguauaguaccggcaaaaauacuauuacaaccuga

SEQ ID NO: 1922 - RNA, 942 nt, Artificial Sequence
  derived and/or modified sequence opt4 from HOM-TES-85__Homo_sapiens__BAG37303
auggccagcuucagaaagcugacccugagcgagaaggugccccccaaccaccccagcagaaagaaggugaacuuccuggacaugagccuggacgacaucaucaucuacaaggagcuggagggcaccaacgccgaggaggagaagaacaagagacagaaccacagcaagaaggagagccccagcagacagcagagcaaggcccacagacacagacacagaagagacuacagcagaugcagaagcaacagcgaggagggcaaccacgacaagaagcccagccagaagcccagcggcuucaagagcggccagcacccccugaacggccagccccugaucgagcaggagaagugcagcgacaacuacgaggcccaggccgagaagaaccagggccagagcgagggcaaccagcaccagagcgagggcaaccccgacaagagcgaggagagccagggccagcccgaggagaaccaccacagcgagagaagcagaaaccaccuggagagaagccugagccagagcgacagaagccagggccagcugaagagacaccacccccaguacgagagaagccacggccaguacaagagaagccacggccagagcgagagaagccacggccacagcgagagaagccacggccacagcgagagaagccacggccacagcgagagaagccacggccacagcaagagaagcagaagccagggcgaccugguggacacccagagcgaccugaucgccacccagagagaccugaucgccacccagaaggaccugaucgccacccagagagaccugaucgccacccagagagaccugaucgugacccagagagaccugguggccaccgagagagaccugaucaaccagagcggcagaagccacggccagagcgagagacaccagagauacagcaccggcaagaacaccaucaccaccuga

SEQ ID NO: 1923 - RNA, 942 nt, Artificial Sequence
  derived and/or modified sequence opt5 from HOM-TES-85__Homo_sapiens__BAG37303
auggccagcuucagaaagcugacccucuccgagaaagugcccccuaaccacccgucucggaagaaagucaauuuucuggacaugagccuugaugacaucauuaucuacaaggaacuggagggcacaaacgcugaagaggagaaaaauaagcgccagaaccauuccaagaaagaaucucccagcagacaacaguccaaggcccaccggcaucgccacagacgggauuauucucgcugcagaagcaauuccgaggaagggaaccaugacaaaaagccuagccagaaacccucuggauucaaguccggccagcacccucucaaugggcaaccccugauugagcaggaaaaguguagcgauaacuacgaggcgcaggcugagaaaaaucagggacaaucugaaggcaaccagcaccaguccgaggggaauccugacaagagcgaagagucucagggacaaccggaagagaaccaucacuccgagcggagccgcaaucaucuugaaagaucccugucucagagcgaucggucccagggccaacucaaacgccaccacccccaguaugagagaagccauggccaguacaagcggucucacgggcaguccgaacgcagccauggacacucugagagaagccauggccacuccgaacggucucacgggcauagcgagagaucccacggacauagcaaacgcucucggucccaaggcgaccugguugauacgcagagcgaccugaucgccacccagagagaucucauugccacacagaaggaccugaucgcuacccaacgcgaucuuaucgccacacagcgggaccugauugugacccagagagaccucguggcuacagagcgcgaucugaucaaccagucugggcggucccacggacaaagcgaaagacaccagcgcuauuccaccggcaaaaauacgauuaccacauga

SEQ ID NO: 1924 - protein, 313 aa, Artificial Sequence
  HOM-TES-85__Homo_sapiens__Q9P127
MASFRKLTLSEKVPPNHPSRKKVNFLDMSLDDIIIYKELEGTNAEEEKNKRQNHSKKESPSRQQSKAHRHRHRRGYSRCRSNSEEGNHDKKPSQKPSGFKSGQHPLNGQPLIEQEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 1925 - RNA, 942 nt, Artificial Sequence
  HOM-TES-85__Homo_sapiens__AAI28135
auggcuucguuucggaagcuaacgcuuucugaaaaagugccgccaaaucaucccagucggaaaaagguuaacuuccuagauaugucucuagacgacauuauaaucuauaaagaguuagaagggacaaaugcugaagaagaaaagaauaaaagacagaaccauaguaaaaaggaaucgccuucaagacagcaaucaaaagcucauagacaucgccaucggagaggcuacucaagaugcagaagcaacucugaggaaggaaaucaugauaaaaaaccaucccaaaaaccuucuggauucaagucuggacaacacccuuuaaaugggcagccuuuaauugagcaggagaagugcagugacaauuaugaggcccaagcagagaagaaucaaggccagucagaggggaaccagcaucaaucagaaggaaauccggacaaaucagaagaaucccagggccaaccagaagaaaaucaucauucugagcgaucccgaaaccacuuagagagaucucuuucucagucagacagaucucaagggcagcuaaagagacaucauccccaauaugagagaucucauggccaauacaagagaucucauggucaaucugagagaucucauggccacucagagagaucucauggucacucagagagaucucauggucacucagagagaucucauggucacucaaagagaucucguagccagggagaucuuguggacacucagagugaucucauagccacucagagagaucucauagccacucagaaagaucucauagccacucagagagaucucauagccacucagagagaucucauagucacucagagagaucucguggccacugagagagaucucauaaaucagucagggagaucucauggccaaucagaaagacaucagagauacucaacagguaaaaauacaauaacuacuuaa

SEQ ID NO: 1926 - RNA, 942 nt, Artificial Sequence
  derived and/or modified sequence opt1 from HOM-TES-85__Homo_sapiens__AAI28135
auggccagcuuccgcaagcugacccucuccgagaaggugcccccgaaccaccccagccggaagaaggucaacuuccuggacaugucccuggacgacaucaucaucuacaaggagcucgagggcaccaacgccgaggaggagaagaacaagcgccagaaccacagcaagaaggagucccccagccggcagcaguccaaggcgcaccgccaccggcaccgccggggguacagccgcugccgguccaacagcgaggagggcaaccacgacaagaagcccucccagaagccgagcggguucaaguccggccagcacccccugaacgggcagccccugaucgagcaggagaagugcagcgacaacuacgaggcccaggccgagaagaaccagggccaguccgagggcaaccagcaccagagcgaggggaaccccgacaaguccgaggagagccagggccagccggaggagaaccaccacuccgagcgcagccggaaccaccucgagcgcagccugucccagagcgaccggucccaggggcagcugaagcgccaccacccccaguacgagcggagccacggccaguacaagcgcucccacgggcagagcgagcggucccacggccacagcgagcgcucccacggccacagcgagcggucccacgggcacagcgagcgcucccacggccacagcaagcggucccgcagccagggggaccucguggacacgcaguccgaccugaucgccacccagcgcgaccugaucgccacccagaaggaccucaucgcgacccagcgggaccugaucgccacgcagcgcgaccugaucgugacccagcgggaccucgucgccaccgagcgcgaccugaucaaccagagcggccggucccacggccagagcgagcgccaccagcgguacagcaccgggaagaacacgaucaccaccuga

SEQ ID NO: 1927 - RNA, 942 nt, Artificial Sequence
  derived and/or modified sequence opt2 from HOM-TES-85__Homo_sapiens__AAI28135
auggccuccuuccgcaagcucacccucuccgagaaggucccccccaaccaccccucccgcaagaaggucaacuuccucgacaugucccucgacgacaucaucaucuacaaggagcucgagggcaccaacgccgaggaggagaagaacaagcgccagaaccacuccaagaaggagucccccucccgccagcaguccaaggcccaccgccaccgccaccgccgcggcuacucccgcugccgcuccaacuccgaggagggcaaccacgacaagaagcccucccagaagcccuccggcuucaaguccggccagcacccccucaacggccagccccucaucgagcaggagaagugcuccgacaacuacgaggcccaggccgagaagaaccagggccaguccgagggcaaccagcaccaguccgagggcaaccccgacaaguccgaggagucccagggccagcccgaggagaaccaccacuccgagcgcucccgcaaccaccucgagcgcucccucucccaguccgaccgcucccagggccagcucaagcgccaccacccccaguacgagcgcucccacggccaguacaagcgcucccacggccaguccgagcgcucccacggccacuccgagcgcucccacggccacuccgagcgcucccacggccacuccgagcgcucccacggccacuccaagcgcucccgcucccagggcgaccucgucgacacccaguccgaccucaucgccacccagcgcgaccucaucgccacccagaaggaccucaucgccacccagcgcgaccucaucgccacccagcgcgaccucaucgucacccagcgcgaccucgucgccaccgagcgcgaccucaucaaccaguccggccgcucccacggccaguccgagcgccaccagcgcuacuccaccggcaagaacaccaucaccaccuga

SEQ ID NO: 1928 - RNA, 942 nt, Artificial Sequence
  derived and/or modified sequence opt3 from HOM-TES-85__Homo_sapiens__AAI28135
auggccagcuucagaaagcugacccucuccgagaaagugcccccuaaccacccaucuaggaagaaagucaauuuucuugacaugucacuggaugacaucauuauauacaaggaauuggagggcacaaacgcugaagaggagaaaaauaagcggcagaaccauaguaagaaagaaagcccgucccgccaacagucuaaggcacaccgacaucgucacagaaggggguauucgcggugccgcucaaauagcgaggaaggaaaccaugauaaaaagcccagucagaaaccuuccgguuucaagucuggccagcacccauuaaaugggcaaccccugaucgagcaggaaaaguguagcgacaacuacgaggcccaggcggagaaaaaucagggacaauccgaaggcaaccagcaccagucagaggguaauccugauaagagugaagagagccaggggcaaccagaagagaaccaucacucugagagauccaggaaucaucuagaacggucacucagccagagugaccgcucucagggacaacugaaacgacaccacccccaguaugagagaucccauggccaguacaagaggagccacggccagucggaacggucucaugggcacuccgagcguucacauggacacagugaacgcagccacggucauuccgagagaucucacggccauagcaaaaggucacggagucaaggggaucuuguugacacucaguccgaucugauugcuacgcagcgagacuugaucgccacccagaaggaucucauugcaacacaacgcgaccugaucgccacucagagagaucugauagugacccagagggaccucguagcuacagagcgggacuuaaucaaccagagcggacgcucucacggccaaucagaaagacaccagagguauaguaccgguaaaaauacuauuacaaccuga

SEQ ID NO: 1929 - RNA, 942 nt, Artificial Sequence
  derived and/or modified sequence opt4 from HOM-TES-85__Homo_sapiens__AAI28135
auggccagcuucagaaagcugacccugagcgagaaggugccccccaaccaccccagcagaaagaaggugaacuuccuggacaugagccuggacgacaucaucaucuacaaggagcuggagggcaccaacgccgaggaggagaagaacaagagacagaaccacagcaagaaggagagccccagcagacagcagagcaaggcccacagacacagacacagaagaggcuacagcagaugcagaagcaacagcgaggagggcaaccacgacaagaagcccagccagaagcccagcggcuucaagagcggccagcacccccugaacggccagccccugaucgagcaggagaagugcagcgacaacuacgaggcccaggccgagaagaaccagggccagagcgagggcaaccagcaccagagcgagggcaaccccgacaagagcgaggagagccagggccagcccgaggagaaccaccacagcgagagaagcagaaaccaccuggagagaagccugagccagagcgacagaagccagggccagcugaagagacaccacccccaguacgagagaagccacggccaguacaagagaagccacggccagagcgagagaagccacggccacagcgagagaagccacggccacagcgagagaagccacggccacagcgagagaagccacggccacagcaagagaagcagaagccagggcgaccugguggacacccagagcgaccugaucgccacccagagagaccugaucgccacccagaaggaccugaucgccacccagagagaccugaucgccacccagagagaccugaucgugacccagagagaccugguggccaccgagagagaccugaucaaccagagcggcagaagccacggccagagcgagagacaccagagauacagcaccggcaagaacaccaucaccaccuga

SEQ ID NO: 1930 - RNA, 942 nt, Artificial Sequence
  derived and/or modified sequence opt5 from HOM-TES-85__Homo_sapiens__AAI28135
auggccagcuucagaaagcugacccucuccgagaaagugcccccuaaccacccgucucggaagaaagucaauuuucuggacaugagccuugaugacaucauuaucuacaaggaacuggagggcacaaacgcugaagaggagaaaaauaagcgccagaaccauuccaagaaagaaucucccagcagacaacaguccaaggcccaccggcaucgccacagacggggguauucucgcugcagaagcaauuccgaggaaggaaaccaugauaaaaagccuagccagaaacccucuggcuucaaguccgggcagcacccucucaauggacaaccccugauugagcaggaaaaguguagcgacaacuacgaggcgcaggcugagaaaaaucagggccaaucugaagggaaccagcaccaguccgagggaaauccugauaagagcgaagagucucagggccaaccggaagagaaccaucacuccgagcggagccgcaaucaucuugaaagaucccugucucagagcgaccggucccagggccaacucaaacgccaccacccccaguaugagagaagccaugggcaguacaagcggucucacggacaguccgaacgcagccauggccacucugagagaagccaugggcacuccgaacggucucacggacauagcgagagaucccacggccauagcaaacgcucucggucccaaggggaucugguugacacgcagagcgaucugaucgccacccagagagaccucauugccacacagaaggaucugaucgcuacccaacgcgaccuuaucgccacacagcgggaucugauugugacccagagagaccucguggcuacagagcgcgaccugaucaaccagucuggacggucccacggccaaagcgaaagacaccagcgcuauuccaccggcaaaaauacgauuaccacauga

SEQ ID NO: 1931 - protein, 127 aa, Artificial Sequence
  HPG1__Homo_sapiens__12543784
MIKKNLKKLGIEETYLNIIKAIYDRPTASIQKTENLSTKTGTSQEYHLSPLWFYIVLEILASTIRQEKNLKDIHTEKEEVKLSLFADAMILYLKKPNDSTRKLLELIKKIHSSCRIKINIHFAFCSQ

SEQ ID NO: 1932 - RNA, 384 nt, Artificial Sequence
  HPG1__Homo_sapiens__12543784
augauaaaaaaaaaucuuaaaaaacuggguauagaagaaacauaccuuaacauaauaaaagccauauaugacagacccacagcuaguauacaaaaaacugaaaaccuuuccacuaaaacuggaacaagccaagaauaccaccugucaccacugugguucuacauaguacuggaaauccuagcuagcacaaucagacaagagaaaaauuuaaaggacauccacacugaaaaagaagaagucaaauuauccuuguuugcugaugcuaugaucuuauauuugaaaaaaccuaaugacuccacaagaaaauuauuagaacugauaaaaaaaauucauucaaguugcaggauaaaaaucaauauacauuuugcauuuuguucacaauga

SEQ ID NO: 1933 - RNA, 384 nt, Artificial Sequence
  derived and/or modified sequence opt1 from HPG1__Homo_sapiens__12543784
augaucaagaagaaccugaagaagcucggcaucgaggagaccuaccugaacaucaucaaggccaucuacgaccgccccaccgccagcauccagaagacggagaaccuguccaccaagaccgggaccagccaggaguaccaccucuccccgcugugguucuacaucgugcuggagauccucgcgagcacgauccggcaggagaagaaccugaaggacauccacaccgagaaggaggaggucaagcugucccucuucgccgacgccaugauccuguaccugaagaagcccaacgacagcacccgcaagcuccuggagcugaucaagaagauccacuccagcugccggaucaagaucaacauccacuucgccuucugcucccaguga

SEQ ID NO: 1934 - RNA, 384 nt, Artificial Sequence
  derived and/or modified sequence opt2 from HPG1__Homo_sapiens__12543784
augaucaagaagaaccucaagaagcucggcaucgaggagaccuaccucaacaucaucaaggccaucuacgaccgccccaccgccuccauccagaagaccgagaaccucuccaccaagaccggcaccucccaggaguaccaccucuccccccucugguucuacaucguccucgagauccucgccuccaccauccgccaggagaagaaccucaaggacauccacaccgagaaggaggaggucaagcucucccucuucgccgacgccaugauccucuaccucaagaagcccaacgacuccacccgcaagcuccucgagcucaucaagaagauccacuccuccugccgcaucaagaucaacauccacuucgccuucugcucccaguga

SEQ ID NO: 1935 - RNA, 384 nt, Artificial Sequence
  derived and/or modified sequence opt3 from HPG1__Homo_sapiens__12543784
augaucaagaaaaaccugaagaaacucggcauugaggaaaccuaccuuaauauaaucaaggccauuuaugacagacccacagcuagcauccagaaaacugagaaccuguccacgaagaccgggacaucucaagaauaccacuugucaccuuuaugguucuauauugugcuggagauccuagcaaguacuauaaggcaggaaaagaaucucaaagauauccauaccgagaaggaggaagucaaacugagccuuuuugccgacgcgaugauucuguacuugaagaaaccaaacgauuccacacggaagcuccuggagcugaucaagaaaauucacucuucgugccgcaucaagauaaauauucauuucgcuuuuuguucacaguga

SEQ ID NO: 1936 - RNA, 384 nt, Artificial Sequence
  derived and/or modified sequence opt4 from HPG1__Homo_sapiens__12543784
augaucaagaagaaccugaagaagcugggcaucgaggagaccuaccugaacaucaucaaggccaucuacgacagacccaccgccagcauccagaagaccgagaaccugagcaccaagaccggcaccagccaggaguaccaccugagcccccugugguucuacaucgugcuggagauccuggccagcaccaucagacaggagaagaaccugaaggacauccacaccgagaaggaggaggugaagcugagccuguucgccgacgccaugauccuguaccugaagaagcccaacgacagcaccagaaagcugcuggagcugaucaagaagauccacagcagcugcagaaucaagaucaacauccacuucgccuucugcagccaguga

SEQ ID NO: 1937 - RNA, 384 nt, Artificial Sequence
  derived and/or modified sequence opt5 from HPG1__Homo_sapiens__12543784
augaucaagaaaaaccugaagaaacucggcauugaggaaaccuaccugaauaucauuaaggccaucuaugacagacccacagcuagcauucagaaaacggagaaccuuuccaccaagacagggaccucucaagaauaccaccugagcccucucugguucuauaucgugcuggagauccuugccuccacaauucggcaggaaaagaaucugaaagauauccauaccgagaaggaggaagucaaacucucucuguuugcggacgcuaugauucuguaccucaagaaaccgaacgauagcacacgcaagcugcuugagcugaucaagaaaauucacuccucuugcagaaucaagauuaauauccauuucgccuuuuguagccaguga

SEQ ID NO: 1938 - protein, 641 aa, Artificial Sequence
  HS71A__Homo_sapiens__P0DMV8
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 1939 - RNA, 1926 nt, Artificial Sequence
  HS71A__Homo_sapiens__AAA63226
auggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcgccugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggccgacaagaagaaggugcuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccugggggcuucggggcucagggucccaagggagggucugggucaggccccaccauugaggagguagauuag

SEQ ID NO: 1940 - RNA, 1926 nt, Artificial Sequence
  derived and/or modified sequence opt1 from HS71A__Homo_sapiens__AAA63226
auggccaaggccgcggccaucggcaucgaccuggggaccaccuacagcugcgugggcguguuccagcacgggaagguggagaucaucgccaacgaccagggcaaccgcacgacccccuccuacguggccuucaccgacaccgagcggcucaucggggacgccgcgaagaaccaggucgcccugaacccgcagaacacgguguucgacgccaagcgccugaucggccggaaguucggcgaccccgugguccagagcgacaugaagcacuggcccuuccaggugaucaacgacggggacaagcccaaggugcaggucuccuacaagggcgagaccaaggccuucuacccggaggagaucagcuccauggugcucaccaagaugaaggagaucgcggaggccuaccugggguaccccgugaccaacgccgucaucacggugcccgccuacuucaacgacagccagcgccaggccaccaaggacgcgggcgugaucgccgggcugaacguccuccggaucaucaacgagcccaccgccgccgccaucgcguacggccuggaccgcaccggcaagggggagcggaacgugcugaucuucgaccucggcgggggcacguucgacguguccauccugaccaucgacgacggcaucuucgaggucaaggccaccgccggggacacccaccugggcggggaggacuucgacaaccgccucgugaaccacuucguggaggaguucaagcggaagcacaagaaggacaucagccagaacaagcgcgccguccggcgccugcggacggccugcgagcgcgcgaagcggacccuguccagcuccacccaggccagccucgagaucgacucccuguucgagggcaucgacuucuacaccagcaucacgcgcgcccgguucgaggagcugugcuccgaccucuuccgcagcacccuggagccgguggagaaggcccugcgggacgccaagcucgacaaggcgcagauccacgaccuggugcuggucgggggcuccacccgcauccccaaggugcagaagcuccugcaggacuucuucaacggccgggaccugaacaagagcaucaaccccgacgaggccgucgccuacggggccgcggugcaggccgccauccucaugggcgacaaguccgagaacgugcaggaccugcugcuccuggacgucgcgccccugagccucgggcuggagaccgccggcggggugaugacggcccugaucaagcgcaacagcaccaucccgaccaagcagacccagaucuucacgaccuacuccgacaaccagcccggcgugcucauccaggucuacgagggcgagcgcgccaugaccaaggacaacaaccugcuggggcgguucgagcucagcggcaucccgcccgcgccccgcggggugccccagaucgaggugaccuucgacaucgacgccaacggcauccugaacgucacggccaccgacaaguccaccgggaaggccaacaagaucaccaucacgaacgacaagggccggcugagcaaggaggagaucgagcgcauggugcaggaggccgagaaguacaaggccgaggacgaggugcagcgggagcgcgucuccgccaagaacgcccucgagagcuacgcguucaacaugaaguccgccguggaggacgagggccugaaggggaagaucagcgaggccgacaagaagaaggugcuggacaagugccaggaggucaucuccuggcucgacgccaacacccuggcggagaaggacgaguucgagcacaagcggaaggagcuggagcaggucugcaaccccaucaucagcggccucuaccagggggccggcggccccgggccgggcggguucggcgcccaggggcccaagggcggcuccgggagcggccccaccaucgaggagguggacuga

SEQ ID NO: 1941 - RNA, 1926 nt, Artificial Sequence
  derived and/or modified sequence opt2 from HS71A__Homo_sapiens__AAA63226
auggccaaggccgccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgcccucaacccccagaacaccgucuucgacgccaagcgccucaucggccgcaaguucggcgaccccgucguccaguccgacaugaagcacuggcccuuccaggucaucaacgacggcgacaagcccaagguccaggucuccuacaagggcgagaccaaggccuucuaccccgaggagaucuccuccaugguccucaccaagaugaaggagaucgccgaggccuaccucggcuaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgaccgcaccggcaagggcgagcgcaacguccucaucuucgaccucggcggcggcaccuucgacgucuccauccucaccaucgacgacggcaucuucgaggucaaggccaccgccggcgacacccaccucggcggcgaggacuucgacaaccgccucgucaaccacuucgucgaggaguucaagcgcaagcacaagaaggacaucucccagaacaagcgcgccguccgccgccuccgcaccgccugcgagcgcgccaagcgcacccucuccuccuccacccaggccucccucgagaucgacucccucuucgagggcaucgacuucuacaccuccaucacccgcgcccgcuucgaggagcucugcuccgaccucuuccgcuccacccucgagcccgucgagaaggcccuccgcgacgccaagcucgacaaggcccagauccacgaccucguccucgucggcggcuccacccgcauccccaagguccagaagcuccuccaggacuucuucaacggccgcgaccucaacaaguccaucaaccccgacgaggccgucgccuacggcgccgccguccaggccgccauccucaugggcgacaaguccgagaacguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucaacgucaccgccaccgacaaguccaccggcaaggccaacaagaucaccaucaccaacgacaagggccgccucuccaaggaggagaucgagcgcaugguccaggaggccgagaaguacaaggccgaggacgagguccagcgcgagcgcgucuccgccaagaacgcccucgaguccuacgccuucaacaugaaguccgccgucgaggacgagggccucaagggcaagaucuccgaggccgacaagaagaagguccucgacaagugccaggaggucaucuccuggcucgacgccaacacccucgccgagaaggacgaguucgagcacaagcgcaaggagcucgagcaggucugcaaccccaucaucuccggccucuaccagggcgccggcggccccggccccggcggcuucggcgcccagggccccaagggcggcuccggcuccggccccaccaucgaggaggucgacuga

SEQ ID NO: 1942 - RNA, 1926 nt, Artificial Sequence
  derived and/or modified sequence opt3 from HS71A__Homo_sapiens__AAA63226
auggccaaggcugcagccaucggcauugaccuggggaccacauacagcugcgugggagucuuccagcacgguaaaguugagauaaucgcgaacgaucaaggcaauagaacuacgcccuccuauguggcuuuuaccgacacagaaaggcucauuggggaugccgcaaagaaccagguagcccuuaauccucagaacacuguguucgacgcuaaacggcugaucggacgcaaguuuggcgauccagucgugcagucugacaugaaacauuggccguuccaaguuauuaaugauggugacaagcccaaggugcaggucucauacaaaggggagaccaaggcauuuuauccugaagagaucaguagcaugguguugacaaaaaugaaggaaauagccgaggcuuacuuaggauauccaguaaccaacgccguuaucacugugcccgcguacuucaaugauucccagcgacaggcaacaaaagacgccggcgucauugcuggccugaacgugcuacguaucauuaaugagccuaccgccgcagcuaucgccuaugggcucgauagaacgggaaagggugaaaggaacgugcugauauuugaccuuggcgggggaacuuucgaugucucuauucugaccaucgacgacggcauuuuugagguuaaggcgacagccggugauacucaccuugggggagaagacuucgauaaucggcucgugaaccauuuuguagaggaguucaaacgcaagcacaaaaaggacaucucgcaaaauaaaagagcagugaggcggcugcgcaccgcuugugaacgagccaagagaacacugucaagcaguacccaggcuucccucgagaucgauucuuuauuugaaggcauugacuucuacacgagcauaacuagggcccgguucgaggaacugugcuccgaucuuuuucguucaacauuggagccagucgagaaagcacugcgcgacgccaagcuagauaaggcucagauccaugaccucgugcugguuggcgggaguacccggauucccaaagugcagaaguugcugcaagauuucuuuaacggaagggacuugaauaaaagcaucaacccugacgaagcggucgcauacggugccgcugugcaggccgcaauacucaugggcgauaagucugagaacguacaggaccuguuacugcucgauguugccccacuuucccugggguuggaaacugcuggaggcgugaugacagcccuaauuaaaagaaauucaaccaucccgacgaagcaaacccagaucuucacaacuuauagcgacaaccagcccgguguccugauucagguguacgagggggaacgagcaaugaccaaggauaauaaccuccugggccgcuuugagcuuaguggaaucccuccagcgcccagaggcgucccucaaauugaggugacauucgacauagaugcuaaugggauccugaacguuacugccaccgacaaaucuacaggaaaggcaaauaaaauuaccaucacuaacgauaaggguagguuguccaaagaagagaucgaacggauggugcaggaggccgaaaaguauaaggcugaggacgagguacagcgcgaaagagucagcgccaaaaaugcacucgagucguacgcuuuuaacaugaagucugccguggaagaugagggccugaaagggaagauuuccgaggcggacaaaaagaagguuuuagauaaaugucaggaagugauaucauggcuggacgccaauacgcuagcugagaaggacgaguucgaacacaaaaggaaggaacucgagcaagucugcaacccaaucauuaguggacuguaucagggcgccggugggcccggcccgggaggcuuuggggcacagggaccuaaagguggcagcggguccggacccacaaucgaggaaguggauuga

SEQ ID NO: 1943 - RNA, 1926 nt, Artificial Sequence
  derived and/or modified sequence opt4 from HS71A__Homo_sapiens__AAA63226
auggccaaggccgccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggcccugaacccccagaacaccguguucgacgccaagagacugaucggcagaaaguucggcgaccccguggugcagagcgacaugaagcacuggcccuuccaggugaucaacgacggcgacaagcccaaggugcaggugagcuacaagggcgagaccaaggccuucuaccccgaggagaucagcagcauggugcugaccaagaugaaggagaucgccgaggccuaccugggcuaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacagaaccggcaagggcgagagaaacgugcugaucuucgaccugggcggcggcaccuucgacgugagcauccugaccaucgacgacggcaucuucgaggugaaggccaccgccggcgacacccaccugggcggcgaggacuucgacaacagacuggugaaccacuucguggaggaguucaagagaaagcacaagaaggacaucagccagaacaagagagccgugagaagacugagaaccgccugcgagagagccaagagaacccugagcagcagcacccaggccagccuggagaucgacagccuguucgagggcaucgacuucuacaccagcaucaccagagccagauucgaggagcugugcagcgaccuguucagaagcacccuggagcccguggagaaggcccugagagacgccaagcuggacaaggcccagauccacgaccuggugcuggugggcggcagcaccagaauccccaaggugcagaagcugcugcaggacuucuucaacggcagagaccugaacaagagcaucaaccccgacgaggccguggccuacggcgccgccgugcaggccgccauccugaugggcgacaagagcgagaacgugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgagcugagcggcaucccccccgcccccagaggcgugccccagaucgaggugaccuucgacaucgacgccaacggcauccugaacgugaccgccaccgacaagagcaccggcaaggccaacaagaucaccaucaccaacgacaagggcagacugagcaaggaggagaucgagagaauggugcaggaggccgagaaguacaaggccgaggacgaggugcagagagagagagugagcgccaagaacgcccuggagagcuacgccuucaacaugaagagcgccguggaggacgagggccugaagggcaagaucagcgaggccgacaagaagaaggugcuggacaagugccaggaggugaucagcuggcuggacgccaacacccuggccgagaaggacgaguucgagcacaagagaaaggagcuggagcaggugugcaaccccaucaucagcggccuguaccagggcgccggcggccccggccccggcggcuucggcgcccagggccccaagggcggcagcggcagcggccccaccaucgaggagguggacuga

SEQ ID NO: 1944 - RNA, 1926 nt, Artificial Sequence
  derived and/or modified sequence opt5 from HS71A__Homo_sapiens__AAA63226
auggccaaggcugccgcgaucggcauugaccuggggaccacauacagcugcgugggagucuuccagcacggcaaaguugagaucauugcuaacgaucaagggaauagaacgacccccuccuauguggccuuuacagacaccgaacggcucaucggagaugccgcuaagaaccagguggcccugaauccucagaacacagucuucgacgcuaaacgccuuauuggcagaaaguuuggggauccggugguucagucugacaugaaacauuggcccuuccaagugaucaaugauggagacaagccuaagguccaggugagcuacaaaggcgagaccaaggccuuuuaucccgaagagaucuccucuaugguucugacaaaaaugaaggaaauugcggaggccuaccucggcuauccugugaccaacgcugucaucacggugcccgccuacuucaaugauagccagcggcaggcuaccaaagacgccggggugauugcgggacugaacguccuucgcaucauuaaugagccuacagccgcugccaucgcuuauggccuggauagaaccgggaagggagaacggaacguucucauuuuugaccugggcgggggaacauucgauguguccauccugaccaucgacgacggcauuuuugaggugaaggccacggccggcgauacacaccucgggggagaagacuucgauaaucgccuggucaaccauuuuguggaggaguucaaaagaaagcacaaaaaggacaucucucaaaauaaacgggcuguucgcagacuucggaccgcgugugaacgcgccaagagaacacugagcuccagcacccaggcuucucucgagauugauucccuguuugaaggcaucgacuucuacaccagcauuacacgggcccgcuucgaggaacuuugcucugaucuguuuagauccacgcucgagccgguggagaaagcccugcgggacgcuaagcuggauaaggcccagauccaugaccucguccugguugggggaagcaccagaauccccaaagugcagaaacuucugcaagauuucuuuaacggccgcgaccucaauaagucuauuaacccugacgaagcgguggcuuacggggccgccguccaggcugccauccugaugggagauaaguccgagaacgugcaggaccuucugcuccuggaugucgcuccccugagccucggccuggaaacagccggcggggugaugaccgcgcuuauuaaacggaauagcacaaucccuaccaagcaaacgcagauuuucacaaccuauucugacaaccagcccggaguucugauccagguguacgagggcgaaagagccaugaccaaggauaauaaccuccuggggcgcuuugagcuuagcggaaucccgccugcuccccggggcgucccucaaauugaggugacauucgacaucgaugccaaugggauucugaacguuaccgcuacagacaaauccacgggcaaggccaauaaaaucaccauuacaaacgauaagggaagacucagcaaagaagagaucgaacgcauggugcaggaggcggaaaaguauaaggccgaggacgagguccagcgggaaagagugucugcuaaaaaugcccuggaguccuacgcuuuuaacaugaaguccgccguggaagaugagggccugaaagggaagauuucugaggccgacaaaaagaagguucucgauaaaugucaggaagucaucagcuggcuggacgcuaauacccuugcggagaaggacgaguucgaacacaaacgcaaggaacuggagcaagugugcaaccccaucauuuccggacucuaucagggcgccgggggacccggcccugggggcuuuggagcucagggcccgaaagggggaucuggcagcgggcccacaaucgaggaaguggauuga

SEQ ID NO: 1945 - protein, 641 aa, Artificial Sequence; identical to SEQ ID NO: 1938
  HS71B__Homo_sapiens__P0DMV9

SEQ ID NO: 1946 - RNA, 1926 nt, Artificial Sequence
  HS71B__Homo_sapiens__AAA63227
auggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcgccugaucggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacguccugaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaagacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggccgacaagaagaagguucuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccuggcggcuucggggcucagggucccaagggagggucugggucaggcccuaccauugaggagguggauuag

SEQ ID NO: 1947 - RNA, 1926 nt, Artificial Sequence; identical to SEQ ID NO: 1940
  derived and/or modified sequence opt1 from HS71B__Homo_sapiens__AAA63227

SEQ ID NO: 1948 - RNA, 1926 nt, Artificial Sequence; identical to SEQ ID NO: 1941
  derived and/or modified sequence opt2 from HS71B__Homo_sapiens__AAA63227

SEQ ID NO: 1949 - RNA, 1926 nt, Artificial Sequence; identical to SEQ ID NO: 1942
  derived and/or modified sequence opt3 from HS71B__Homo_sapiens__AAA63227

SEQ ID NO: 1950 - RNA, 1926 nt, Artificial Sequence; identical to SEQ ID NO: 1943
  derived and/or modified sequence opt4 from HS71B__Homo_sapiens__AAA63227

SEQ ID NO: 1951 - RNA, 1926 nt, Artificial Sequence; identical to SEQ ID NO: 1944
  derived and/or modified sequence opt5 from HS71B__Homo_sapiens__AAA63227

SEQ ID NO: 1952 - protein, 208 aa, Artificial Sequence
  HST-2__Homo_sapiens__P10767
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 1953 - RNA, 627 nt, Artificial Sequence
  HST-2__Homo_sapiens__AAI21098
auggcccugggacagaaacuguucaucacuaugucccggggagcaggacgucugcagggcacgcugugggcucucgucuuccuaggcauccuagugggcaugguggugcccucgccugcaggcacccgugccaacaacacgcugcuggacucgaggggcuggggcacccugcuguccaggucucgcgcggggcuagcuggagagauugccggggugaacugggaaaguggcuauuugguggggaucaagcggcagcggaggcucuacugcaacgugggcaucggcuuucaccuccaggugcuccccgacggccggaucagcggaacccacgaggagaaccccuacagccugcuggaaauuuccaccguggagcgaggcguggugagucucuuuggagugagaagugcccucuucgucgccaugaacaguaaaggaagauuguacgcaacgcccagcuuccaagaagaaugcaaguucagagaaacccuccugcccaacaauuacaaugccuacgagucagacuuguaccaagggaccuacauugcccugagcaaauacggacggguaaagcggggcagcaagguguccccgaucaugacugucacucauuuccuucccaggaucuaa

SEQ ID NO: 1954 - RNA, 627 nt, Artificial Sequence
  derived and/or modified sequence opt1 from HST-2__Homo_sapiens__AAI21098
auggcccugggccagaagcuguucaucaccaugagccgcggggccggccggcugcaggggacccugugggcgcucguguuccugggcauccuggucgggaugguggugcccuccccggccggcacgcgcgccaacaacacccuccuggacagccggggcugggggacccugcucucccgcagccgggccggccuggccggggagaucgcgggcgucaacugggaguccggguaccuggugggcaucaagcgccagcggcgccucuacugcaacgugggcaucggguuccaccuccagguccugcccgacggccggaucagcgggacccacgaggagaaccccuacucccuccuggagaucagcacgguggagcgcggcguggucucccuguucggcgugcggagcgcccucuucguggccaugaacuccaaggggcgccuguacgccacccccagcuuccaggaggagugcaaguuccgggagacccugcucccgaacaacuacaacgcguacgaguccgaccuguaccagggcaccuacaucgcccugagcaaguacgggcgcgucaagcggggcuccaaggugagccccaucaugacggugacccacuuccucccccgcaucuga

SEQ ID NO: 1955 - RNA, 627 nt, Artificial Sequence
  derived and/or modified sequence opt2 from HST-2__Homo_sapiens__AAI21098
auggcccucggccagaagcucuucaucaccaugucccgcggcgccggccgccuccagggcacccucugggcccucgucuuccucggcauccucgucggcauggucguccccucccccgccggcacccgcgccaacaacacccuccucgacucccgcggcuggggcacccuccucucccgcucccgcgccggccucgccggcgagaucgccggcgucaacugggaguccggcuaccucgucggcaucaagcgccagcgccgccucuacugcaacgucggcaucggcuuccaccuccagguccuccccgacggccgcaucuccggcacccacgaggagaaccccuacucccuccucgagaucuccaccgucgagcgcggcgucgucucccucuucggcguccgcuccgcccucuucgucgccaugaacuccaagggccgccucuacgccacccccuccuuccaggaggagugcaaguuccgcgagacccuccuccccaacaacuacaacgccuacgaguccgaccucuaccagggcaccuacaucgcccucuccaaguacggccgcgucaagcgcggcuccaaggucucccccaucaugaccgucacccacuuccucccccgcaucuga

SEQ ID NO: 1956 - RNA, 627 nt, Artificial Sequence
  derived and/or modified sequence opt3 from HST-2__Homo_sapiens__AAI21098
auggcccugggccagaagcuguucaucaccaugagcagaggggcuggaaggcuucaagguacacugugggcauugguguuuuuaggcauucuggucgggaugguugugcccuccccugccggaacucgggcgaacaauacgcuacucgacucucgcggcugggguacccugcuuucacgaagucgugcugggcuggccggagagauagcaggcguaaacugggaaagcggcuacuugguggggaucaaaagacagaggcggcucuauugcaaugucggaauugguuuccaccuccaggugcugccagauggccgcaucuccgggacacaugaggaaaacccguacucucucuuagagauuucgacuguugaaagaggaguggucucacuguuuggcgugaggagcgcccuuuucguagcuaugaauaguaagggucgguuguaugcaacccccuccuuucaggaggaguguaaauuccgcgaaacacugcuaccuaacaauuacaacgccuaugagucugaccucuaccaagggaccuauaucgcucugagcaaguacggacgaguuaaaagaggcuccaaggugucaccaauaaugacugucacacacuuucuucccaggaucuga

SEQ ID NO: 1957 - RNA, 627 nt, Artificial Sequence
  derived and/or modified sequence opt4 from HST-2__Homo_sapiens__AAI21098
auggcccugggccagaagcuguucaucaccaugagcagaggcgccggcagacugcagggcacccugugggcccugguguuccugggcauccuggugggcaugguggugcccagccccgccggcaccagagccaacaacacccugcuggacagcagaggcuggggcacccugcugagcagaagcagagccggccuggccggcgagaucgccggcgugaacugggagagcggcuaccuggugggcaucaagagacagagaagacuguacugcaacgugggcaucggcuuccaccugcaggugcugcccgacggcagaaucagcggcacccacgaggagaaccccuacagccugcuggagaucagcaccguggagagaggcguggugagccuguucggcgugagaagcgcccuguucguggccaugaacagcaagggcagacuguacgccacccccagcuuccaggaggagugcaaguucagagagacccugcugcccaacaacuacaacgccuacgagagcgaccuguaccagggcaccuacaucgcccugagcaaguacggcagagugaagagaggcagcaaggugagccccaucaugaccgugacccacuuccugcccagaaucuga

SEQ ID NO: 1958 - RNA, 627 nt, Artificial Sequence
  derived and/or modified sequence opt5 from HST-2__Homo_sapiens__AAI21098
auggcccugggccagaaacucuucaucaccaugagcagaggggcuggacggcugcaaggcacacuuugggcccugguguuucucgggauucuggucggaaugguugugcccuccccugcgggcacgcgcgcuaacaauacccuucuggacucuagaggguggggaacacuccugagccggucccgcgccggccuggccggcgagaucgcuggggugaacugggaaucuggauaccucgucggcauuaagagacagcggcgccuguauugcaauguggggaucggauuccaccuucagguucugccggauggcagaauuagcgggacccaugaggaaaaccccuacucccuccuggagaucucuacaguggaacggggagucgugagccuuuuuggcguucgcuccgcccuguucguggcuaugaauagcaagggcagacucuaugccaccccuucuuuucaggaggaguguaaauuccgggaaacacugcugcccaacaauuacaacgcguaugaguccgaccucuaccaagggaccuauaucgcccugagcaaguacggacgcgucaaaagaggcucuaagguguccccuauuaugacggugacccacuuucuuccccggaucuga

SEQ ID NO: 1959 - protein, 523 aa, Artificial Sequence
  hTERT__Homo_sapiens__O94807
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPILTGARRLVETIFLGSSPGCQGLPAGCPACPSATGKCGPCFWSCLGTTRSAPTGCSSRRTARCELRSPQQPVSVPGRSPRALWRPPRRRTQTPVAWCSCSASTAPLAGVRLRAGLPAPAGAPRPLGLQAQRRRFLRNTKKFISLGKHAKLSLQELTWKMSVRDCAWLRRSP

SEQ ID NO: 1960 - RNA, 1569 nt, Artificial Sequence
  hTERT__Homo_sapiens__BAA74724
augccgcgcgcuccccgcugccgagccgugcgcucccugcugcgcagccacuaccgcgaggugcugccgcuggccacguucgugcggcgccuggggccccagggcuggcggcuggugcagcgcggggacccggcggcuuuccgcgcgcugguggcccagugccuggugugcgugcccugggacgcacggccgccccccgccgcccccuccuuccgccagguguccugccugaaggagcugguggcccgagugcugcagaggcugugcgagcgcggcgcgaagaacgugcuggccuucggcuucgcgcugcuggacggggcccgcgggggcccccccgaggccuucaccaccagcgugcgcagcuaccugcccaacacggugaccgacgcacugcgggggagcggggcgugggggcugcuguugcgccgcgugggcgacgacgugcugguucaccugcuggcacgcugcgcgcucuuugugcugguggcucccagcugcgccuaccaggugugcgggccgccgcuguaccagcucggcgcugccacucaggcccggcccccgccacacgcuaguggaccccgaaggcgucugggaugcgaacgggccuggaaccauagcgucagggaggccggggucccccugggccugccagccccgggugcgaggaggcgcgggggcagugccagccgaagucugccguugcccaagaggcccaggcguggcgcugccccugagccggagcggacgcccguugggcagggguccugggcccacccgggcaggacgcguggaccgagugaccgugguuucuguguggugucaccugccagacccgccgaagaagccaccucuuuggagggugcgcucucuggcacgcgccacucccacccauccgugggccgccagcaccacgcgggccccccauccacaucgcggccaccacgucccugggacacgccuugucccccgguguacgccgagaccaagcacuuccucuacuccucaggcgacaaggagcagcugcggcccuccuuccuacucagcucucugaggcccauccugacuggcgcucggaggcucguggagaccaucuuucuggguuccagcccuggaugccagggacuccccgcagguugccccgccugccccagcgcuacuggcaaaugcggccccuguuucuggagcugcuugggaaccacgcgcagugccccuacggggugcuccucaagacgcacugcccgcugcgagcugcggucaccccagcagccggugucugugcccgggagaagccccagggcucuguggcggcccccgaggaggaggacacagacccccgucgccuggugcagcugcuccgccagcacagcaccccuggcagguguacggcuucgugcgggccugccugcgccggcuggugcccccaggccucuggggcuccaggcacaacgacgccgcuuccucaggaacaccaagaaguucaucucccuggggaagcaugccaagcucucgcugcaggagcugacguggaagaugagcgugcgggacugcgcuuggcugcgcaggagccca

SEQ ID NO: 1961 - RNA, 1569 nt, Artificial Sequence
  derived and/or modified sequence opt1 from hTERT__Homo_sapiens__BAA74724
augccccgcgccccgcggugccgcgccgugcggagccugcuccgcucccacuaccgggagguccugccccuggcgaccuucgugcgccggcucggcccccagggguggcgccuggugcagcggggcgaccccgccgccuuccgcgcccuggucgcccagugccucgugugcgugccgugggacgcgcggcccccgcccgccgcccccagcuuccgccaggucuccugccugaaggagcugguggcccgggugcuccagcgccugugcgagcgcggggcgaagaacguccuggccuucggcuucgcccuccuggacggggcccggggcggcccgcccgaggccuucaccacgagcgugcgguccuaccugcccaacaccgugaccgacgcgcuccgcgggagcggcgccugggggcugcugcuccggcgcgucggcgacgacgugcuggugcaccuccucgcccggugcgcccuguucguccugguggcccccuccugcgcguaccaggugugcgggccgccccucuaccagcugggcgccgccacccaggcccgcccgccgccccacgccagcggcccccgccggcgccuggggugcgagcgggcguggaaccacuccguccgcgaggccggcgugccccuggggcugcccgcccccggcgcccggcgccggggcgggagcgccucccgcagccugccccuccccaagcggccccgccggggcgcggcccccgagcccgagcgcacgcccguggggcagggcuccugggcccacccggggcggacccgcggccccagcgaccggggcuucugcgucgugucccccgcccgcccggcggaggaggccaccagccuggagggggcccuguccggcacccggcacagccaccccuccguggggcgccagcaccacgccggcccgcccagcacgagccggccgccccgccccugggacacccccugcccgcccgucuacgccgagaccaagcacuuccucuacuccagcggggacaaggagcagcugcgccccuccuuccugcucagcucccugcggcccauccugaccggcgcgcgccggcucguggagacgaucuuccugggcagcucccccgggugccagggccugcccgccgggugccccgccugccccagcgccaccggcaagugcgggccgugcuucugguccugccucggcaccacccgcagcgcccccacgggcugcuccagccggcgcaccgcgcggugcgagcugcgcagcccccagcagcccgucuccgugccggggcggagcccccgcgcccuguggcggccgccccgccggcgcacccagacccccguggccuggugcuccugcuccgccagcacggcgccccucgccggcguccggcugcgcgccgggcugcccgccccggccggcgcgccccggccccucggccugcaggcccagcgccggcgcuuccugcggaacaccaagaaguucaucucccuggggaagcacgccaagcucagccugcaggagcugaccuggaagaugagcgugcgcgacugcgccuggcuccgccgguccccc

SEQ ID NO: 1962 - RNA, 1569 nt, Artificial Sequence
  derived and/or modified sequence opt2 from hTERT__Homo_sapiens__BAA74724
augccccgcgccccccgcugccgcgccguccgcucccuccuccgcucccacuaccgcgagguccucccccucgccaccuucguccgccgccucggcccccagggcuggcgccucguccagcgcggcgaccccgccgccuuccgcgcccucgucgcccagugccucgucugcguccccugggacgcccgccccccccccgccgcccccuccuuccgccaggucuccugccucaaggagcucgucgcccgcguccuccagcgccucugcgagcgcggcgccaagaacguccucgccuucggcuucgcccuccucgacggcgcccgcggcggcccccccgaggccuucaccaccuccguccgcuccuaccuccccaacaccgucaccgacgcccuccgcggcuccggcgccuggggccuccuccuccgccgcgucggcgacgacguccucguccaccuccucgcccgcugcgcccucuucguccucgucgcccccuccugcgccuaccaggucugcggccccccccucuaccagcucggcgccgccacccaggcccgcccccccccccacgccuccggcccccgccgccgccucggcugcgagcgcgccuggaaccacuccguccgcgaggccggcgucccccucggccuccccgcccccggcgcccgccgccgcggcggcuccgccucccgcucccucccccuccccaagcgcccccgccgcggcgccgcccccgagcccgagcgcacccccgucggccagggcuccugggcccaccccggccgcacccgcggccccuccgaccgcggcuucugcgucgucucccccgcccgccccgccgaggaggccaccucccucgagggcgcccucuccggcacccgccacucccaccccuccgucggccgccagcaccacgccggcccccccuccaccucccgccccccccgccccugggacacccccugcccccccgucuacgccgagaccaagcacuuccucuacuccuccggcgacaaggagcagcuccgccccuccuuccuccucuccucccuccgccccauccucaccggcgcccgccgccucgucgagaccaucuuccucggcuccucccccggcugccagggccuccccgccggcugccccgccugccccuccgccaccggcaagugcggccccugcuucugguccugccucggcaccacccgcuccgcccccaccggcugcuccucccgccgcaccgcccgcugcgagcuccgcuccccccagcagcccgucuccguccccggccgcuccccccgcgcccucuggcgccccccccgccgccgcacccagacccccgucgccuggugcuccugcuccgccuccaccgccccccucgccggcguccgccuccgcgccggccuccccgcccccgccggcgccccccgcccccucggccuccaggcccagcgccgccgcuuccuccgcaacaccaagaaguucaucucccucggcaagcacgccaagcucucccuccaggagcucaccuggaagauguccguccgcgacugcgccuggcuccgccgcuccccc

SEQ ID NO: 1963 - RNA, 1569 nt, Artificial Sequence
  derived and/or modified sequence opt3 from hTERT__Homo_sapiens__BAA74724
augcccagagccccuaggugccgggcugugcgcagccugcuccgaucccacuaccgugagguccuuccacuggcaaccuucguuagaagguugggcccgcagggguggcgguuagugcaacgcggagaccccgccgcguuuagagcucugguagcccagugucuagugugcgucccuugggaugcaaggccacccccugccgcuccaucuuuccgccaggugucaugucucaaggaacugguugcacgggugcuucagcgacugugcgagagaggugccaaaaacgucuuggcuuuuggcuucgcccuccuggacggggcgaggggaggucccccugaagcauuuacaacgagugugcggagcuaucugccaaauacuguaaccgaugcccuccguggcuccggggcuuggggauuacugcuucgcagaguuggcgacgauguguugguccaucugcuagccaggugugcacucuucgugcugguggcuccgucuugcgccuaccaagucugugggcccccucuuuaucagcugggcgcggccacacaggcacggccacccccucacgcuucgggaccacgacgcagauuggguugcgagagggccuggaaccauucaguucgggaagcuggcgugccccucgggcugccggccccuggagcacgcagaaggggcgguagcgccagucguuccuuaccccugccaaagcggccucgaagaggggcugcgcccgagccagagaggacucccguaggacagggcucuugggcacacccuggccgcacccgggggccaagcgacagaggauuuuguguggucuccccggccaggcccgcugaagaggccacaucacucgaaggugcacuuaguggcacccgccauagccacccuucuguggggcgacaacaccaugccggaccacccuccacuucacggccuccacgucccugggauacaccgugcccuccaguuuacgcugagaccaaacacuuccuguauagcaguggcgacaaggagcaguugagacccucuuuucuacuguccagccucaggccuauccugacgggugcccgccggcuuguggaaacuauuuuccuggggucgucucccggcugucagggauugccagcaggcugcccugcgugccccuccgcuaccgggaaauguggaccaugcuuuuggucaugucucgguacaacuagaagugccccgaccggcugcagcuccaggcgaacagcacgcugugagcugcggucuccucagcaacccgucagcgugccagggagaucacccagggccuuauggcguccuccacgccggagaacccagacgcccguagcuuggugcaguuguuccgccagcacugcaccucuggcuggaguuaggcuacgagccggccucccggcgccagccggugcuccccggccucuggggcuucaggcacaacgcagaagguucuugcggaauacaaagaaguuuauaucucugggcaaacaugccaagcucucacugcaggaacuuaccuggaaaaugagugugcgagauugcgcuuggcugagacgcagccca

SEQ ID NO: 1964 - RNA, 1569 nt, Artificial Sequence
  derived and/or modified sequence opt4 from hTERT__Homo_sapiens__BAA74724
augcccagagcccccagaugcagagccgugagaagccugcugagaagccacuacagagaggugcugccccuggccaccuucgugagaagacugggcccccagggcuggagacuggugcagagaggcgaccccgccgccuucagagcccugguggcccagugccuggugugcgugcccugggacgccagacccccccccgccgcccccagcuucagacaggugagcugccugaaggagcugguggccagagugcugcagagacugugcgagagaggcgccaagaacgugcuggccuucggcuucgcccugcuggacggcgccagaggcggcccccccgaggccuucaccaccagcgugagaagcuaccugcccaacaccgugaccgacgcccugagaggcagcggcgccuggggccugcugcugagaagagugggcgacgacgugcuggugcaccugcuggccagaugcgcccuguucgugcugguggcccccagcugcgccuaccaggugugcggccccccccuguaccagcugggcgccgccacccaggccagaccccccccccacgccagcggccccagaagaagacugggcugcgagagagccuggaaccacagcgugagagaggccggcgugccccugggccugcccgcccccggcgccagaagaagaggcggcagcgccagcagaagccugccccugcccaagagacccagaagaggcgccgcccccgagcccgagagaacccccgugggccagggcagcugggcccaccccggcagaaccagaggccccagcgacagaggcuucugcguggugagccccgccagacccgccgaggaggccaccagccuggagggcgcccugagcggcaccagacacagccaccccagcgugggcagacagcaccacgccggcccccccagcaccagcagaccccccagacccugggacacccccugcccccccguguacgccgagaccaagcacuuccuguacagcagcggcgacaaggagcagcugagacccagcuuccugcugagcagccugagacccauccugaccggcgccagaagacugguggagaccaucuuccugggcagcagccccggcugccagggccugcccgccggcugccccgccugccccagcgccaccggcaagugcggccccugcuucuggagcugccugggcaccaccagaagcgcccccaccggcugcagcagcagaagaaccgccagaugcgagcugagaagcccccagcagcccgugagcgugcccggcagaagccccagagcccuguggagaccccccagaagaagaacccagacccccguggccuggugcagcugcagcgccagcaccgccccccuggccggcgugagacugagagccggccugcccgcccccgccggcgcccccagaccccugggccugcaggcccagagaagaagauuccugagaaacaccaagaaguucaucagccugggcaagcacgccaagcugagccugcaggagcugaccuggaagaugagcgugagagacugcgccuggcugagaagaagcccc

SEQ ID NO: 1965 - RNA, 1569 nt, Artificial Sequence
  derived and/or modified sequence opt5 from hTERT__Homo_sapiens__BAA74724
augcccagagccccucggugccgcgcugugagaagccugcuccggucccacuaccgcgagguccugccgcuugccaccuucguuagacggcugggcccccagggguggcgccucgugcaaagaggagacccugcggcuuuucgggcccugguggcccagugucuugucugcgugcccugggaugcucgcccucccccugccgcuccgucuuucagacagguuagcugucugaaggaacucguggcccggguccugcagcgccugugcgagagaggcgcgaaaaacgugcucgccuuuggguucgcucugcuugacggagcccggggcgggcccccugaagccuuuacaacguccguucgcucuuaucugcccaauaccgugacagaugcccucagaggaagcggcgcguggggccugcuucugcggagagucggggacgaugugcucgugcaucugcuggcccgcugugcucucuucguccugguugccccuuccugcgcuuaccaaguguguggacccccgcuuuaucagcugggcgccgccacccaggcucggccucccccucacgcgucugggcccagacgccggcucggaugcgagagagccuggaaccauagcgugcgcgaagcuggcgucccccuggggcuuccugccccgggagcccggagacgcggcggcuccgcuagccggucucugccccucccuaagagaccccgccggggcgccgcgccugagcccgagagaacaccggugggacagggcuccugggcucacccugggcggacccgcggacccagcgacagaggcuuuuguguugugucuccugcccggcccgccgaagaggcuacaucccuggaaggggcccugagcggaaccagacauucucacccuuccgucggccgccaacaccaugcugggcccccgagcacgucccggccucccagacccugggauaccccuugcccgcccguguacgccgagacaaaacacuuccucuauucuagcggggacaaggagcagcugcgcccuuccuuucuucugagcucucucagacccauccugaccggagcgcggcgccuuguugaaacaauuuuccugggcuccagcccugggugucagggacuccccgccggcugcccugcuugccccucugccaccgggaaauguggcccgugcuuuuggagcugucugggaacgacaagauccgcuccuaccggcugcucuagccggcgcacagccagaugugagcugcggagcccccagcaaccuguguccguccccgggcgcucuccgagagcgcucuggcggccuccccgcagacggacccagaccccuguggccuggugcuccuguagcgcuucuacagcuccccuggcuggagucagacuucgcgccggccugcccgccccugcuggggcgccgcggccccucggacugcaggcccaaagacgccgguuccugagaaauacgaagaaguuuaucucccuuggcaaacaugcuaagcucagccugcaggaacugaccuggaaaauguccgugcgcgauugcgccuggcuccggagaucuccu

SEQ ID NO: 1966 - protein, 559 aa, Artificial Sequence
  iCE__Homo_sapiens__O00748
MRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 1967 - RNA, 1680 nt, Artificial Sequence
  iCE__Homo_sapiens__BAA23606
augcggcugcacagacuucgugcgcggcugagcgcgguggccugugggcuucugcugcuucuuguccggggccagggccaggacucagccagucccauccggaccacacacacggggcaggugcuggggagucuuguccaugugaagggcgccaaugccgggguccaaaccuuccugggaauuccauuugccaagccaccucuagguccgcugcgauuugcacccccugagcccccugaaucuuggaguggugugagggauggaaccacccauccggccaugugucuacaggaccucaccgcaguggagucagaguuucuuagccaguucaacaugaccuucccuuccgacuccaugucugaggacugccuguaccucagcaucuacacgccggcccauagccaugaaggcucuaaccugccggugaugguguggauccacgguggugcgcuuguuuuuggcauggcuuccuuguaugaugguuccaugcuggcugccuuggagaacguggugguggucaucauccaguaccgccuggguguccugggcuucuucagcacuggagacaagcacgcaaccggcaacuggggcuaccuggaccaaguggcugcacuacgcuggguccagcagaauaucgcccacuuuggaggcaacccugaccgugucaccauuuuuggcgagucugcggguggcacgagugugucuucgcuuguugugucccccauaucccaaggacucuuccacggagccaucauggagaguggcguggcccuccugcccggccucauugccagcucagcugaugucaucuccacggugguggccaaccugucugccugugaccaaguugacucugaggcccuggugggcugccugcggggcaagaguaaagaggagauucuugcaauuaacaagccuuucaagaugauccccggagugguggauggggucuuccugcccaggcacccccaggagcugcuggccucugccgacuuucagccugucccuagcauuguuggugucaacaacaaugaauucggcuggcucauccccaaggucaugaggaucuaugauacccagaaggaaauggacagagaggccucccaggcugcucugcagaaaauguuaacgcugcugauguugccuccuacauuuggugaccugcugagggaggaguacauuggggacaauggggauccccagacccuccaagcgcaguuccaggagaugauggcggacuccauguuugugaucccugcacuccaaguagcacauuuucaguguucccgggccccuguguacuucuacgaguuccagcaucagcccagcuggcucaagaacaucaggccaccgcacaugaaggcagaccauggugaugagcuuccuuuuguuuucagaaguuucuuugggggcaacuacauuaaauucacugaggaagaggagcagcuaagcaggaagaugaugaaguacugggccaacuuugcgagaaaugggaacccgaauggcgagggucugccacacuggccgcuguucgaccaggaggagcaauaccugcagcugaaccuacagccugcggugggccgggcucugaaggcccacaggcuccaguucuggaagaaggcgcugccccaaaagauccaggagcucgaggagccugaagagagacacacagagcuguag

SEQ ID NO: 1968 - RNA, 1680 nt, Artificial Sequence
  derived and/or modified sequence opt1 from iCE__Homo_sapiens__BAA23606
augcgccugcaccggcuccgcgcccggcugagcgccguggcgugcggccugcuccugcugcucguccgcgggcagggccaggacuccgccagccccauccggaccacccacacgggccaggugcuggggucccuggugcacgucaagggggccaacgccggcgugcagaccuuccucggcaucccguucgccaagccgccccuggggccccugcgcuucgcgccgcccgagccgcccgagagcugguccggcgugcgggacgggaccacccaccccgccaugugccuccaggaccugacggccgucgagagcgaguuccugucccaguucaacaugaccuuccccagcgacuccaugagcgaggacugccucuaccuguccaucuacacccccgcccacagccacgagggcuccaaccugcccgugaugguguggauccacgggggcgcgcucgucuucggcauggccagccuguacgacggguccaugcuggccgcccucgagaacgugguggucgugaucauccaguaccgccugggcgugcugggguucuucagcaccggcgacaagcacgccacgggcaacuggggguaccucgaccaggucgcggcccugcggugggugcagcagaacaucgcccacuucggcgggaaccccgaccgcgugaccaucuucggcgaguccgccgggggcaccagcgucuccagccugguggugagccccaucucccagggccucuuccacggggccaucauggagagcggcgucgcgcugcugcccgggcucaucgccuccagcgccgacgugaucuccaccguggucgccaaccugagcgccugcgaccagguggacuccgaggcgcuggucggcugccuccggggcaagagcaaggaggagauccuggccaucaacaagcccuucaagaugaucccgggggugguggacggcgucuuccugccccgccacccccaggagcuccuggccuccgccgacuuccagcccgugccgagcaucgugggggucaacaacaacgaguucggcuggcugauccccaaggugaugcggaucuacgacacgcagaaggagauggaccgcgaggccucccaggcggcccuccagaagaugcugacccugcucaugcugccgcccaccuucggggaccugcuccgggaggaguacaucggcgacaacggggacccccagacccugcaggcccaguuccaggagaugauggccgacagcauguucgugauccccgcgcugcaggucgcccacuuccagugcucccgcgcccccguguacuucuacgaguuccagcaccagcccagcuggcucaagaacauccggccgccccacaugaaggccgaccacggcgacgagcugcccuucguguuccgcuccuucuucggcgggaacuacaucaaguucacggaggaggaggagcagcugagccggaagaugaugaaguacugggccaacuucgcgcgcaacggcaacccgaacggggagggccugccccacuggccccucuucgaccaggaggagcaguaccugcagcugaaccuccagcccgccgucggccgggcccugaaggcccaccgccugcaguucuggaagaaggcccucccgcagaagauccaggagcuggaggagcccgaggagcgccacaccgagcuguga

SEQ ID NO: 1969 - RNA, 1680 nt, Artificial Sequence
  derived and/or modified sequence opt2 from iCE__Homo_sapiens__BAA23606
augcgccuccaccgccuccgcgcccgccucuccgccgucgccugcggccuccuccuccuccucguccgcggccagggccaggacuccgccucccccauccgcaccacccacaccggccagguccucggcucccucguccacgucaagggcgccaacgccggcguccagaccuuccucggcauccccuucgccaagcccccccucggcccccuccgcuucgccccccccgagccccccgaguccugguccggcguccgcgacggcaccacccaccccgccaugugccuccaggaccucaccgccgucgaguccgaguuccucucccaguucaacaugaccuuccccuccgacuccauguccgaggacugccucuaccucuccaucuacacccccgcccacucccacgagggcuccaaccuccccgucauggucuggauccacggcggcgcccucgucuucggcauggccucccucuacgacggcuccaugcucgccgcccucgagaacgucgucgucgucaucauccaguaccgccucggcguccucggcuucuucuccaccggcgacaagcacgccaccggcaacuggggcuaccucgaccaggucgccgcccuccgcuggguccagcagaacaucgcccacuucggcggcaaccccgaccgcgucaccaucuucggcgaguccgccggcggcaccuccgucuccucccucgucgucucccccaucucccagggccucuuccacggcgccaucauggaguccggcgucgcccuccuccccggccucaucgccuccuccgccgacgucaucuccaccgucgucgccaaccucuccgccugcgaccaggucgacuccgaggcccucgucggcugccuccgcggcaaguccaaggaggagauccucgccaucaacaagcccuucaagaugauccccggcgucgucgacggcgucuuccucccccgccacccccaggagcuccucgccuccgccgacuuccagcccguccccuccaucgucggcgucaacaacaacgaguucggcuggcucauccccaaggucaugcgcaucuacgacacccagaaggagauggaccgcgaggccucccaggccgcccuccagaagaugcucacccuccucaugcucccccccaccuucggcgaccuccuccgcgaggaguacaucggcgacaacggcgacccccagacccuccaggcccaguuccaggagaugauggccgacuccauguucgucauccccgcccuccaggucgcccacuuccagugcucccgcgcccccgucuacuucuacgaguuccagcaccagcccuccuggcucaagaacauccgccccccccacaugaaggccgaccacggcgacgagcuccccuucgucuuccgcuccuucuucggcggcaacuacaucaaguucaccgaggaggaggagcagcucucccgcaagaugaugaaguacugggccaacuucgcccgcaacggcaaccccaacggcgagggccucccccacuggccccucuucgaccaggaggagcaguaccuccagcucaaccuccagcccgccgucggccgcgcccucaaggcccaccgccuccaguucuggaagaaggcccucccccagaagauccaggagcucgaggagcccgaggagcgccacaccgagcucuga

SEQ ID NO: 1970 - RNA, 1680 nt, Artificial Sequence
  derived and/or modified sequence opt3 from iCE__Homo_sapiens__BAA23606
augagacugcacaggcuccgggcccgccuuagcgcuguggcaugcggccuguuguuacugcuaguccgagggcagggacaagacuccgccucucccauccguaccacacauacuggucagguucucggcucacuggugcacguaaagggggcgaacgcuggagugcagacguuccuuggcauuccuuuugccaaaccaccgcugggucccuugagauucgcaccuccagagcccccugaaaguuggagcggggucagggauggaaccacacauccagccaugugucuccaggaccugacugcuguggaguccgaauuucugucucaauucaauaugaccuuucccucggauucaaugagcgaggacugccucuacuuaaguauauauaccccugcacacucccaugaaggcucuaaccugccaguuaugguguggauccacggcggggcccuugucuucggaauggcuagcuuguacgaugguuccaugcuggccgcgcuagagaaugugguaguugugauuauccaguaucggcucggcguccugggguuuuucucaacaggagacaagcacgcaacuggcaacugggguuaccuugaucagguggccgcucugcgcugggugcagcaaaauauugcccauuuugggggaaacccggacagagucacaaucuucggcgagagugcaggcgggaccagcguuucuuccuuggugguaucacccauaagccagggacucuuucacggugcuaucauggaaaguggcguggcccuguuaccugggcugauugcgucuuccgccgaugucaucagcacggugguugcaaaucucucggcuugugaccagguggauucugaggcccuugucggaugccugaggggcaaauccaaggaagagauuuuggcuaucaacaaaccauucaagaugauacccggugugguagacgggguuuuucuaccucggcauccacaggagcugcucgccucagcagauuuccaacccgugccgaguauugucggcgugaauaacaaugaguucggauggcugaucccuaaggucaugcgcauuuaugacacucagaaagagauggaccgagaagccagccaggcugcgcuucaaaagaugcugaccuugcucaugcugcccccaacauuuggcgauuuacugagagaggaauacaucggggacaacggagauccucagacucuacaggcacaguuccaagagaugauggccgacuccauguuugugauccccgcucuccagguugcccacuuccaguguucuagggcaccaguguauuuuuacgaguuccagcaccaacccagcuggcugaaaaauauucggccuccacauaugaaggccgaucacggugacgaacuuccguuuguauuccguucauuuuucggcgggaacuacauaaaauuuaccgaggaagaggaacaguugagucgcaagaugaugaaguauugggcuaauuucgccagaaacggaaaccccaauggcgagggucugccucauuggccacucuuugaucaggaggaacaguaccugcaacuuaaccugcagcccgcagucgggagggcguugaaagcucaccggcuccaguucuggaagaaagcccugccucagaagauccaagaguuagaagaaccagaggaacgacauacagagcuguga

SEQ ID NO: 1971 - RNA, 1680 nt, Artificial Sequence
  derived and/or modified sequence opt4 from iCE__Homo_sapiens__BAA23606
augagacugcacagacugagagccagacugagcgccguggccugcggccugcugcugcugcuggugagaggccagggccaggacagcgccagccccaucagaaccacccacaccggccaggugcugggcagccuggugcacgugaagggcgccaacgccggcgugcagaccuuccugggcauccccuucgccaagcccccccugggcccccugagauucgccccccccgagccccccgagagcuggagcggcgugagagacggcaccacccaccccgccaugugccugcaggaccugaccgccguggagagcgaguuccugagccaguucaacaugaccuuccccagcgacagcaugagcgaggacugccuguaccugagcaucuacacccccgcccacagccacgagggcagcaaccugcccgugaugguguggauccacggcggcgcccugguguucggcauggccagccuguacgacggcagcaugcuggccgcccuggagaacguggugguggugaucauccaguacagacugggcgugcugggcuucuucagcaccggcgacaagcacgccaccggcaacuggggcuaccuggaccagguggccgcccugagaugggugcagcagaacaucgcccacuucggcggcaaccccgacagagugaccaucuucggcgagagcgccggcggcaccagcgugagcagccugguggugagccccaucagccagggccuguuccacggcgccaucauggagagcggcguggcccugcugcccggccugaucgccagcagcgccgacgugaucagcaccgugguggccaaccugagcgccugcgaccagguggacagcgaggcccuggugggcugccugagaggcaagagcaaggaggagauccuggccaucaacaagcccuucaagaugauccccggcgugguggacggcguguuccugcccagacacccccaggagcugcuggccagcgccgacuuccagcccgugcccagcaucgugggcgugaacaacaacgaguucggcuggcugauccccaaggugaugagaaucuacgacacccagaaggagauggacagagaggccagccaggccgcccugcagaagaugcugacccugcugaugcugccccccaccuucggcgaccugcugagagaggaguacaucggcgacaacggcgacccccagacccugcaggcccaguuccaggagaugauggccgacagcauguucgugauccccgcccugcagguggcccacuuccagugcagcagagcccccguguacuucuacgaguuccagcaccagcccagcuggcugaagaacaucagacccccccacaugaaggccgaccacggcgacgagcugcccuucguguucagaagcuucuucggcggcaacuacaucaaguucaccgaggaggaggagcagcugagcagaaagaugaugaaguacugggccaacuucgccagaaacggcaaccccaacggcgagggccugccccacuggccccuguucgaccaggaggagcaguaccugcagcugaaccugcagcccgccgugggcagagcccugaaggcccacagacugcaguucuggaagaaggcccugccccagaagauccaggagcuggaggagcccgaggagagacacaccgagcuguga

SEQ ID NO: 1972 - RNA, 1680 nt, Artificial Sequence
  derived and/or modified sequence opt5 from iCE__Homo_sapiens__BAA23606
augagacugcaccggcuccgcgccagacugagcgcuguggccugcggccuucugcuccugcuuguccgggggcagggacaagacuccgcgucucccauccgcaccacacauacgggccagguucuggggagccucgugcacgugaagggagcuaacgccggcguccagaccuuccuggggauuccuuuugccaaaccgccccugggaccucucagauucgcucccccugagcccccugaauccuggucuggcgugcgggauggcacaacccauccggccaugugucugcaggaccuuacagcuguugagagcgaauuucugucccaauucaauaugaccuuucccucugauagcauguccgaggacugccucuaccugagcaucuauaccccugcccacucucaugaaggguccaaccuucccgugauggucuggauucacggaggcgcgcugguguucgggauggccagccucuacgauggaucuaugcuggcugcccuggagaauguuguggucgugaucauucaguaucgccucggcgugcugggguuuuucuccacaggagacaagcacgcuacgggcaacuggggcuaccuugaucaggucgccgcgcugagauggguucagcaaaauaucgcccauuuugggggaaacccugaccgggugaccaucuucggcgagagcgcugggggaacaucuguguccagccucgucgugucccccauuucucagggccuguuucacggggccaucauggaaagcggaguugcccuucugccgggccucauugcuuccagcgccgaugugaucucuaccgucguggcuaaucuguccgcgugugaccagguugauagcgaggcccuggugggcugccuccgcgggaaaucuaaggaagagauucuggcuaucaacaaaccuuucaagaugauucccggagucguggacggcgucuuucuuccuagacauccccaggagcugcucgccagcgccgauuuccaacccgugccuuccaucguuggggugaauaacaaugaauuuggauggcugaucccgaaggucaugcggauuuaugacacacagaaagagauggaccgcgaggcuucucaggccgcgcuucaaaagaugcugacccuccugaugcugcccccuacguuuggcgaucuccugagagaggaauacaucggggacaacggcgauccccagacacuucaggcucaguuccaagagaugauggccgacagcauguuugugauuccugcccugcagguugcucacuuccaguguucccgggcccccguguauuuuuacgaguuccagcaccaaccgagcuggcucaaaaauauccgcccuccccauaugaaggcugaucacggagacgaacugccuuuugucuucagaucuuucuucggcgggaacuacauuaaauuuaccgaggaagaggaacagcugucccggaagaugaugaaguauugggccaauuucgcgagaaacggaaaccccaauggcgaggggcuuccucauuggccccucuuugaucaggaggaacaguaccugcaacugaaccuccagccggccgugggacgcgcucugaaagcccaccggcuucaguucuggaagaaagcucugccucagaagauccaagagcucgaagaacccgaagagagacauacagagcuguga

SEQ ID NO: 1973 - protein, 579 aa, Artificial Sequence
  IF2B3__Homo_sapiens__O00425
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 1974 - RNA, 1740 nt, Artificial Sequence
  IF2B3__Homo_sapiens__AAH65269
augaacaaacuguauaucggaaaccucagcgagaacgccgcccccucggaccuagaaaguaucuucaaggacgccaagaucccggugucgggacccuuccuggugaagacuggcuacgcguucguggacugcccggacgagagcugggcccucaaggccaucgaggcgcuuucagguaaaauagaacugcacgggaaacccauagaaguugagcacucggucccaaaaaggcaaaggauucggaaacuucagauacgaaauaucccgccucauuuacagugggaggugcuggauaguuuacuaguccaguauggagugguggagagcugugagcaagugaacacugacucggaaacugcaguuguaaauguaaccuauuccaguaaggaccaagcuagacaagcacuagacaaacugaauggauuucaguuagagaauuucaccuugaaaguagccuauaucccugaugaaauggccgcccagcaaaaccccuugcagcagccccgaggucgccgggggcuugggcagaggggcuccucaaggcaggggucuccaggauccguauccaagcagaaaccaugugauuugccucugcgccugcugguucccacccaauuuguuggagccaucauaggaaaagaaggugccaccauucggaacaucaccaaacagacccagucuaaaaucgauguccaccguaaagaaaaugcgggggcugcugagaagucgauuacuauccucucuacuccugaaggcaccucugcggcuuguaagucuauucuggagauuaugcauaaggaagcucaagauauaaaauucacagaagagauccccuugaagauuuuagcucauaauaacuuuguuggacgucuuauugguaaagaaggaagaaaucuuaaaaaaauugagcaagacacagacacuaaaaucacgauaucuccauugcaggaauugacgcuguauaauccagaacgcacuauuacaguuaaaggcaauguugagacaugugccaaagcugaggaggagaucaugaagaaaaucagggagucuuaugaaaaugauauugcuucuaugaaucuucaagcacauuuaauuccuggauuaaaucugaacgccuugggucuguucccacccacuucagggaugccaccucccaccucagggcccccuucagccaugacuccucccuacccgcaguuugagcaaucagaaacggagacuguucaucuguuuaucccagcucuaucagucggugccaucaucggcaagcagggccagcacaucaagcagcuuucucgcuuugcuggagcuucaauuaagauugcuccagcagaagcaccagaugcuaaagugaggauggugauuaucacuggaccaccagaggcucaguucaaggcucagggaagaauuuauggaaaaauuaaagaagaaaacuuuguuaguccuaaagaagaggugaaacuugaagcucauaucagagugccauccuuugcugcuggcagaguuauuggaaaaggaggcaaaacggugaaugaacuucagaauuugucaagugcagaaguuguugucccucgugaccagacaccugaugagaaugaccaagugguugucaaaauaacuggucacuucuaugcuugccagguugcccagagaaaaauucaggaaauucugacucagguaaagcagcaccaacaacagaaggcucugcaaaguggaccaccucagucaagacggaaguaa

SEQ ID NO: 1975 - RNA, 1740 nt, Artificial Sequence
  derived and/or modified sequence opt1 from IF2B3__Homo_sapiens__AAH65269
augaacaagcuguacaucggcaaccucagcgagaacgccgcccccuccgaccuggagagcaucuucaaggacgcgaagaucccgguguccgggcccuuccuggucaagaccggcuacgccuucguggacugccccgacgagagcugggcccucaaggccaucgaggcccuguccgggaagaucgagcugcacggcaagcccaucgagguggagcacagcgucccgaagcgccagcggauccgcaagcuccagauccggaacaucccgccccaccuccagugggaggugcuggacucccugcuggugcaguacggggucguggagagcugcgagcaggucaacaccgacuccgagacggcgguggugaacgugaccuacagcuccaaggaccaggcccgccaggcccuggacaagcucaacggcuuccagcuggagaacuucacccugaaggucgccuacauccccgacgagauggcggcccagcagaacccccuccagcagccccggggccgccgggggcugggccagcgcgggagcucccggcagggcagccccggguccgugagcaagcagaagcccugcgaccugccgcuccgccugcuggugcccacccaguucgucggcgccaucaucggcaaggagggggccacgauccggaacaucaccaagcagacccaguccaagaucgacgugcaccgcaaggagaacgccggcgcggccgagaaguccaucaccauccucagcacgcccgaggggaccagcgccgccugcaagagcauccuggagaucaugcacaaggaggcccaggacaucaaguucaccgaggagaucccccugaagauccucgcgcacaacaacuucgugggccggcugaucggcaaggaggggcgcaaccugaagaagaucgagcaggacaccgacacgaagaucaccaucuccccgcuccaggagcugacccuguacaaccccgagcggaccaucacggucaagggcaacguggagaccugcgccaaggccgaggaggagaucaugaagaagauccgcgagagcuacgagaacgacaucgccuccaugaaccuccaggcccaccugauccccgggcugaaccucaacgcgcugggccuguucccgcccaccagcgggaugcccccgcccaccuccggcccgcccagcgccaugacgccgcccuacccccaguucgagcaguccgagaccgagaccgugcaccucuucauccccgcccugagcgucggcgccaucaucgggaagcagggccagcacaucaagcagcugucccgguucgccggggcgagcaucaagaucgcccccgccgaggcccccgacgcgaaggugcgcauggugaucaucaccggcccgcccgaggcccaguucaaggcccaggggcggaucuacggcaagaucaaggaggagaacuucgucucccccaaggaggaggugaagcucgaggcccacauccgcguccccagcuucgccgcgggccgggugaucgggaagggcgggaagacggugaacgagcugcagaaccuguccagcgccgaggucguggugccccgcgaccagacccccgacgagaacgaccaggucguggugaagaucaccggccacuucuacgccugccaggucgcccagcgcaagauccaggagauccucacccaggugaagcagcaccagcagcagaaggcccugcaguccgggcccccgcagagccggcgcaaguga

SEQ ID NO: 1976 - RNA, 1740 nt, Artificial Sequence
  derived and/or modified sequence opt2 from IF2B3__Homo_sapiens__AAH65269
augaacaagcucuacaucggcaaccucuccgagaacgccgcccccuccgaccucgaguccaucuucaaggacgccaagauccccgucuccggccccuuccucgucaagaccggcuacgccuucgucgacugccccgacgaguccugggcccucaaggccaucgaggcccucuccggcaagaucgagcuccacggcaagcccaucgaggucgagcacuccguccccaagcgccagcgcauccgcaagcuccagauccgcaacauccccccccaccuccagugggagguccucgacucccuccucguccaguacggcgucgucgaguccugcgagcaggucaacaccgacuccgagaccgccgucgucaacgucaccuacuccuccaaggaccaggcccgccaggcccucgacaagcucaacggcuuccagcucgagaacuucacccucaaggucgccuacauccccgacgagauggccgcccagcagaacccccuccagcagccccgcggccgccgcggccucggccagcgcggcuccucccgccagggcucccccggcuccgucuccaagcagaagcccugcgaccucccccuccgccuccucguccccacccaguucgucggcgccaucaucggcaaggagggcgccaccauccgcaacaucaccaagcagacccaguccaagaucgacguccaccgcaaggagaacgccggcgccgccgagaaguccaucaccauccucuccacccccgagggcaccuccgccgccugcaaguccauccucgagaucaugcacaaggaggcccaggacaucaaguucaccgaggagaucccccucaagauccucgcccacaacaacuucgucggccgccucaucggcaaggagggccgcaaccucaagaagaucgagcaggacaccgacaccaagaucaccaucuccccccuccaggagcucacccucuacaaccccgagcgcaccaucaccgucaagggcaacgucgagaccugcgccaaggccgaggaggagaucaugaagaagauccgcgaguccuacgagaacgacaucgccuccaugaaccuccaggcccaccucauccccggccucaaccucaacgcccucggccucuucccccccaccuccggcaugcccccccccaccuccggcccccccuccgccaugaccccccccuacccccaguucgagcaguccgagaccgagaccguccaccucuucauccccgcccucuccgucggcgccaucaucggcaagcagggccagcacaucaagcagcucucccgcuucgccggcgccuccaucaagaucgcccccgccgaggcccccgacgccaagguccgcauggucaucaucaccggcccccccgaggcccaguucaaggcccagggccgcaucuacggcaagaucaaggaggagaacuucgucucccccaaggaggaggucaagcucgaggcccacauccgcguccccuccuucgccgccggccgcgucaucggcaagggcggcaagaccgucaacgagcuccagaaccucuccuccgccgaggucgucgucccccgcgaccagacccccgacgagaacgaccaggucgucgucaagaucaccggccacuucuacgccugccaggucgcccagcgcaagauccaggagauccucacccaggucaagcagcaccagcagcagaaggcccuccaguccggccccccccagucccgccgcaaguga

SEQ ID NO: 1977 - RNA, 1740 nt, Artificial Sequence
  derived and/or modified sequence opt3 from IF2B3__Homo_sapiens__AAH65269
augaacaagcuguacaucggcaaucucagcgagaacgccgcucccuccgaccuugaaucuauuuucaaagaugcaaagauaccugugucagggccauuucuggucaaaaccggauaugccuucguugacugcccggaugagaguugggcguugaaggcuaucgaagccuuaagcgguaaaauugagcugcacggcaagcccaucgaaguggagcauuccguaccuaagagacagaggauucggaaacuacaaauccgcaauauaccaccccaccuccagugggaggugcuggacucucuucugguccaguacggggugguugaaucgugugaacaggugaacacagauucagagacugcagucgugaauguaacguauagcaguaaggaccaagcccgacaggcuuuggauaaacucaacggauuucagcuggagaauuucacccugaagguugcauacaucccugacgagauggccgcucagcaaaacccacuccagcagccccguggcagaagggguuuagggcagcggggauccucucgccaaggcagcccuggcuccgugucaaaacagaagccaugcgaucugccgcuuagauugcugguccccacacaguuugugggggccauuaucggaaaggaaggugcgacuauuaggaauaucaccaaacaaacacagaguaagauagacgugcaucggaaagagaacgcaggcgccgcugaaaagagcauuaccauccuaucuacuccugaggggacauccgccgcauguaaaucaauucucgaaaucaugcacaaggaggcucaggauaucaaauucaccgaggaaauuccacugaagauacuugcccauaauaacuuugucggacgccugaucggcaaggagggucgaaauuugaaaaagauugaacaggacacggauacuaaaaucaccauaagcccccuccaagagcugacauuauauaacccugaaagaacuauuaccguuaaggggaauguggagacaugcgcgaaagccgaggaagagaucaugaagaagaucagggaaaguuacgagaacgacauugcaucuaugaaccugcaggcucaccucaucccaggacuuaaucugaacgccuugggccuauuucccccgaccuccggcaugccucccccaacgagcgggccucccucggcuaugacuccacccuauccucaguucgaacagucugagacagagaccguacaccuguucauuccagcccucuccgugggagcaauaaucgguaaacaaggccagcauauuaagcagcugucacgguuugccggggcuaguaucaaaaucgcgccggcagaagcccccgacgcuaagguccguauggugauuauaacuggaccuccagaggcccaguucaaagcacaaggccgcaucuacgguaagauuaaggaagagaauuuuguuagccccaaagaggaagugaaacuugaggcccacaucagagucccuuccuucgcugccgggagggugauuggcaagggaggcaagacaguaaacgaacugcagaauuugucuagcgcagagguuguggucccacgggaucagacccccgacgaaaacgaucagguggucgugaaaaucacggggcauuucuacgcgugucaaguugcucagcgaaagauacaggagauccucacccaagugaagcagcaccagcagcaaaaagcccugcagucaggaccgccucagagucgcagaaaguga

SEQ ID NO: 1978 - RNA, 1740 nt, Artificial Sequence
  derived and/or modified sequence opt4 from IF2B3__Homo_sapiens__AAH65269
augaacaagcuguacaucggcaaccugagcgagaacgccgcccccagcgaccuggagagcaucuucaaggacgccaagauccccgugagcggccccuuccuggugaagaccggcuacgccuucguggacugccccgacgagagcugggcccugaaggccaucgaggcccugagcggcaagaucgagcugcacggcaagcccaucgagguggagcacagcgugcccaagagacagagaaucagaaagcugcagaucagaaacauccccccccaccugcagugggaggugcuggacagccugcuggugcaguacggcgugguggagagcugcgagcaggugaacaccgacagcgagaccgccguggugaacgugaccuacagcagcaaggaccaggccagacaggcccuggacaagcugaacggcuuccagcuggagaacuucacccugaagguggccuacauccccgacgagauggccgcccagcagaacccccugcagcagcccagaggcagaagaggccugggccagagaggcagcagcagacagggcagccccggcagcgugagcaagcagaagcccugcgaccugccccugagacugcuggugcccacccaguucgugggcgccaucaucggcaaggagggcgccaccaucagaaacaucaccaagcagacccagagcaagaucgacgugcacagaaaggagaacgccggcgccgccgagaagagcaucaccauccugagcacccccgagggcaccagcgccgccugcaagagcauccuggagaucaugcacaaggaggcccaggacaucaaguucaccgaggagaucccccugaagauccuggcccacaacaacuucgugggcagacugaucggcaaggagggcagaaaccugaagaagaucgagcaggacaccgacaccaagaucaccaucagcccccugcaggagcugacccuguacaaccccgagagaaccaucaccgugaagggcaacguggagaccugcgccaaggccgaggaggagaucaugaagaagaucagagagagcuacgagaacgacaucgccagcaugaaccugcaggcccaccugauccccggccugaaccugaacgcccugggccuguucccccccaccagcggcaugcccccccccaccagcggcccccccagcgccaugaccccccccuacccccaguucgagcagagcgagaccgagaccgugcaccuguucauccccgcccugagcgugggcgccaucaucggcaagcagggccagcacaucaagcagcugagcagauucgccggcgccagcaucaagaucgcccccgccgaggcccccgacgccaaggugagaauggugaucaucaccggcccccccgaggcccaguucaaggcccagggcagaaucuacggcaagaucaaggaggagaacuucgugagccccaaggaggaggugaagcuggaggcccacaucagagugcccagcuucgccgccggcagagugaucggcaagggcggcaagaccgugaacgagcugcagaaccugagcagcgccgaggugguggugcccagagaccagacccccgacgagaacgaccaggugguggugaagaucaccggccacuucuacgccugccagguggcccagagaaagauccaggagauccugacccaggugaagcagcaccagcagcagaaggcccugcagagcggccccccccagagcagaagaaaguga

SEQ ID NO: 1979 - RNA, 1740 nt, Artificial Sequence
  derived and/or modified sequence opt5 from IF2B3__Homo_sapiens__AAH65269
augaacaagcuguacaucggcaaucucagcgagaacgccgcucccuccgaccuggaaucuauuuucaaagaugccaagaucccugugagcgggccguuucuugucaaaaccggauaugcguucguugacugccccgaugaguccugggcucugaaggccauugaagcccucucuggcaaaaucgagcugcacgggaagccuauugaaguggagcauagcgugcccaagagacagcggauccgcaaacuucaaaucagaaauauuccuccccaccuucagugggagguccucgacucccugcuggugcaguacggaguuguggaaucuugugagcaggucaacacagauagcgaaacggcugugguuaaugugaccuauuccagcaaggaccaagcccggcaggcucucgauaaacugaacggcuuucagcuugagaauuucacacugaaggucgccuacaucccugacgagauggcggcccagcaaaacccgcuccagcagccccgcgggagacggggacugggccagcgcgggucuuccagacaaggcagcccuggaucuguguccaaacagaagcccugcgaucuuccucugcggcuccuggugcccacccaguuugucggcgcuauuaucgggaaggaaggagccacaauucgcaauaucaccaaacaaacacagagcaagauugacguucauagaaaagagaacgcuggcgccgcggaaaagucuaucaccauccuguccacgccggaggggaccagcgccgcuuguaaauccauucucgaaaucaugcacaaggaggcccaggauauuaaauucacagaggaaaucccucugaagauucuugcucauaauaacuuugugggacggcugaucggcaaggagggccgcaaucucaaaaagaucgaacaggacaccgauacaaaaauuaccaucucuccccugcaagagcuuacgcuguauaacccugaaagaacaauuaccgugaaggggaaugucgagacaugcgccaaagccgaggaagagaucaugaagaagauucgggaaagcuacgagaacgacaucgcuuccaugaaccuccaggcgcaccugauccccggacugaaucucaacgcccugggccuuuuucccccuaccagcgggaugccgcccccuaccucuggacccccuuccgcuaugacacccccguauccucaguucgaacagagcgagacggagaccgugcaccuguucauucccgcccucucuguuggcgccaucauugggaaacaaggacagcauaucaagcagcugagccgcuuugcuggcgccuccauuaaaaucgcgccugcugaagcccccgacgccaaggugagaauggucauuaucacaggcccucccgaggcucaguucaaagcccaagggcggaucuacggaaagauuaaggaagagaauuuugugucuccgaaagaggaaguuaagcuggaggcucacaucagagugccuagcuucgccgcgggccgcgucauugggaaaggaggcaagaccgugaacgaacugcagaaucucuccagcgccgaggucgugguuccccgggaucagacacccgacgaaaacgaucagguggucgugaaaaucaccgggcauuucuacgcuugucaaguugcccagagaaagauucaggagauccugacgcaagugaagcagcaccagcagcaaaaagcucugcagucuggcccuccgcagucccgccggaaguga

SEQ ID NO: 1980 - protein, 380 aa, Artificial Sequence
  IL-13Ra2__Homo_sapiens__Q14627
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 1981 - RNA, 1143 nt, Artificial Sequence
  IL-13Ra2__Homo_sapiens__AAB17170
auggcuuucguuugcuuggcuaucggaugcuuauauaccuuucugauaagcacaacauuuggcuguacuucaucuucagacaccgagauaaaaguuaacccuccucaggauuuugagauaguggaucccggauacuuagguuaucucuauuugcaauggcaacccccacugucucuggaucauuuuaaggaaugcacaguggaauaugaacuaaaauaccgaaacauugguagugaaacauggaagaccaucauuacuaagaaucuacauuacaaagauggguuugaucuuaacaagggcauugaagcgaagauacacacgcuuuuaccauggcaaugcacaaauggaucagaaguucaaaguuccugggcagaaacuacuuauuggauaucaccacaaggaauuccagaaacuaaaguucaggauauggauugcguauauuacaauuggcaauauuuacucuguucuuggaaaccuggcauagguguacuucuugauaccaauuacaacuuguuuuacugguaugagggcuuggaucaugcauuacaguguguugauuacaucaaggcugauggacaaaauauaggaugcagauuucccuauuuggaggcaucagacuauaaagauuucuauauuuguguuaauggaucaucagagaacaagccuaucagauccaguuauuucacuuuucagcuucaaaauauaguuaaaccuuugccgccagucuaucuuacuuuuacucgggagaguucaugugaaauuaagcugaaauggagcauaccuuugggaccuauuccagcaagguguuuugauuaugaaauugagaucagagaagaugauacuaccuuggugacugcuacaguugaaaaugaaacauacaccuugaaaacaacaaaugaaacccgacaauuaugcuuuguaguaagaagcaaagugaauauuuauugcucagaugacggaauuuggagugaguggagugauaaacaaugcugggaaggugaagaccuaucgaagaaaacuuugcuacguuucuggcuaccauuugguuucaucuuaauauuaguuauauuuguaaccggucugcuuuugcguaagccaaacaccuacccaaaaaugauuccagaauuuuucugugauacauga

SEQ ID NO: 1982 - RNA, 1143 nt, Artificial Sequence
  derived and/or modified sequence opt1 from IL-13Ra2__Homo_sapiens__AAB17170
auggccuucgugugccuggccaucggcugccucuacaccuuccugaucagcaccacguucgggugcaccuccagcuccgacaccgagaucaaggucaacccgccccaggacuucgagaucguggaccccggcuaccugggguaccucuaccugcaguggcagccgccccugagccucgaccacuucaaggagugcaccguggaguacgagcugaaguaccgcaacaucggcuccgagacguggaagaccaucaucaccaagaaccugcacuacaaggacggguucgaccucaacaagggcaucgaggcgaagauccacacccugcugcccuggcagugcacgaacggcagcgagguccaguccagcugggccgagaccaccuacuggaucagcccccaggggauccccgagaccaaggugcaggacauggacugcguguacuacaacuggcaguaccuccugugcuccuggaagcccggcaucgggguccugcucgacacgaacuacaaccuguucuacugguacgagggccuggaccacgcccuccagugcguggacuacaucaaggccgacgggcagaacaucggcugccgguucccguaccuggaggccuccgacuacaaggacuucuacaucugcgugaacggcagcuccgagaacaagcccauccgcagcuccuacuucaccuuccagcugcagaacaucgucaagccccugcccccgguguaccucaccuucacccgggagagcuccugcgagaucaagcugaaguggagcaucccccucgggcccauccccgcgcgcugcuucgacuacgagaucgagauccgggaggacgacacgacccuggugaccgccaccgucgagaacgagacguacacccugaagaccaccaacgagacgcgccagcucugcuucguggugcgguccaaggucaacaucuacugcagcgacgacggcaucuggagcgagugguccgacaagcagugcugggagggggaggaccugagcaagaagacccugcuccgcuucuggcugccguucggcuucauccugauccucgugaucuucgugaccggccugcugcuccggaagcccaacaccuaccccaagaugauccccgaguucuucugcgacacguga

SEQ ID NO: 1983 - RNA, 1143 nt, Artificial Sequence
  derived and/or modified sequence opt2 from IL-13Ra2__Homo_sapiens__AAB17170
auggccuucgucugccucgccaucggcugccucuacaccuuccucaucuccaccaccuucggcugcaccuccuccuccgacaccgagaucaaggucaaccccccccaggacuucgagaucgucgaccccggcuaccucggcuaccucuaccuccaguggcagcccccccucucccucgaccacuucaaggagugcaccgucgaguacgagcucaaguaccgcaacaucggcuccgagaccuggaagaccaucaucaccaagaaccuccacuacaaggacggcuucgaccucaacaagggcaucgaggccaagauccacacccuccuccccuggcagugcaccaacggcuccgagguccaguccuccugggccgagaccaccuacuggaucuccccccagggcauccccgagaccaagguccaggacauggacugcgucuacuacaacuggcaguaccuccucugcuccuggaagcccggcaucggcguccuccucgacaccaacuacaaccucuucuacugguacgagggccucgaccacgcccuccagugcgucgacuacaucaaggccgacggccagaacaucggcugccgcuuccccuaccucgaggccuccgacuacaaggacuucuacaucugcgucaacggcuccuccgagaacaagcccauccgcuccuccuacuucaccuuccagcuccagaacaucgucaagccccucccccccgucuaccucaccuucacccgcgaguccuccugcgagaucaagcucaagugguccaucccccucggccccauccccgcccgcugcuucgacuacgagaucgagauccgcgaggacgacaccacccucgucaccgccaccgucgagaacgagaccuacacccucaagaccaccaacgagacccgccagcucugcuucgucguccgcuccaaggucaacaucuacugcuccgacgacggcaucugguccgagugguccgacaagcagugcugggagggcgaggaccucuccaagaagacccuccuccgcuucuggcuccccuucggcuucauccucauccucgucaucuucgucaccggccuccuccuccgcaagcccaacaccuaccccaagaugauccccgaguucuucugcgacaccuga

SEQ ID NO: 1984 - RNA, 1143 nt, Artificial Sequence
  derived and/or modified sequence opt3 from IL-13Ra2__Homo_sapiens__AAB17170
auggccuucgugugccuggcuaucggcugucucuacaccuuucuuauuagcacaacuuucgggugcacguccucuucagacaccgagauaaaggucaaucccccucaggauuuugaaaucguugacccaggauaucuggguuacuuguauuuacaauggcagccgccccugagucuagaucacuucaaagaguguacaguggaauacgagcucaaguauagaaacauuggcagcgaaacuuggaaaaccaucauuacaaagaaccugcauuacaaagacggguuugaucuuaauaagggaaucgaggcaaagauacacacccuguugccuuggcagugcacuaacggcuccgagguacagucuucgugggccgaaacaaccuauuggaucucaccacaagguauucccgagacgaaagugcaggacauggauugugucuacuacaauuggcaguaucuccugugcagcuggaagccugggaucggagugcugcucgacacuaacuacaauuuauucuauugguacgaaggccuggaucaugcgcuucaguguguugacuauauuaaagcugauggccaaaacaucgggugcagguuuccauacuuggaggccagugacuauaaggauuucuacauaugugugaauggauccucugagaacaaacccauucggagcuccuacuuuaccuuccagcugcagaauaucgucaagccucuaccaccgguguaucucacauuuacucgcgaaucaaguugcgagauuaagcugaaauggagcaucccccuugguccuaucccagcacgauguuucgacuacgaaauugagauacgugaagacgauaccacacugguaaccgccacgguugagaacgagacuuauacauugaagaccacuaaugaaacaagacagcucugcuuuguggucaggucuaaagugaacaucuacugcuccgacgauggcauuuggucagaguggagcgacaagcaauguugggaaggggaggaucugaguaaaaagaccuuacugcgguucuggcuccccuucggauuuauccuuauacuggugauuuucgucacgggcuugcuacugcgcaaaccuaauaccuauccaaagaugauccccgaauuuuucugcgacacauga

SEQ ID NO: 1985 - RNA, 1143 nt, Artificial Sequence
  derived and/or modified sequence opt4 from IL-13Ra2__Homo_sapiens__AAB17170
auggccuucgugugccuggccaucggcugccuguacaccuuccugaucagcaccaccuucggcugcaccagcagcagcgacaccgagaucaaggugaaccccccccaggacuucgagaucguggaccccggcuaccugggcuaccuguaccugcaguggcagcccccccugagccuggaccacuucaaggagugcaccguggaguacgagcugaaguacagaaacaucggcagcgagaccuggaagaccaucaucaccaagaaccugcacuacaaggacggcuucgaccugaacaagggcaucgaggccaagauccacacccugcugcccuggcagugcaccaacggcagcgaggugcagagcagcugggccgagaccaccuacuggaucagcccccagggcauccccgagaccaaggugcaggacauggacugcguguacuacaacuggcaguaccugcugugcagcuggaagcccggcaucggcgugcugcuggacaccaacuacaaccuguucuacugguacgagggccuggaccacgcccugcagugcguggacuacaucaaggccgacggccagaacaucggcugcagauuccccuaccuggaggccagcgacuacaaggacuucuacaucugcgugaacggcagcagcgagaacaagcccaucagaagcagcuacuucaccuuccagcugcagaacaucgugaagccccugccccccguguaccugaccuucaccagagagagcagcugcgagaucaagcugaaguggagcaucccccugggccccauccccgccagaugcuucgacuacgagaucgagaucagagaggacgacaccacccuggugaccgccaccguggagaacgagaccuacacccugaagaccaccaacgagaccagacagcugugcuucguggugagaagcaaggugaacaucuacugcagcgacgacggcaucuggagcgaguggagcgacaagcagugcugggagggcgaggaccugagcaagaagacccugcugagauucuggcugcccuucggcuucauccugauccuggugaucuucgugaccggccugcugcugagaaagcccaacaccuaccccaagaugauccccgaguucuucugcgacaccuga

SEQ ID NO: 1986 - RNA, 1143 nt, Artificial Sequence
  derived and/or modified sequence opt5 from IL-13Ra2__Homo_sapiens__AAB17170
auggccuucgugugccuggcuaucggcugucucuacaccuuucugauuagcacaacguucgggugcaccuccucuagcgacacagagaucaaggucaaucccccucaggauuuugaaauuguugacccgggauaucuuggcuaccuguaucuccaauggcagcccccucugucccuugaucacuucaaagaguguaccguggaauacgagcugaaguauagaaacaucgggucugaaacauggaaaaccauuaucacaaagaaccuccauuacaaagacggauuugaucugaauaagggcaucgaggccaagauucacacccugcuccccuggcagugcacgaacgggagcgaggugcaguccucuugggcggaaaccacauauuggaucagcccucaaggcauucccgagaccaaaguccaggacauggauuguguguacuacaauuggcaguaucugcuuugcuccuggaagccuggaaucggcguucugcucgacacaaacuacaaucuguucuauugguacgaagggcuugaucaugcucugcaguguguggacuauauuaaagccgauggacaaaacaucggcugccgguuuccguaccucgaggccagcgacuauaaggauuucuacauuugugucaaugggucuuccgagaacaaacccauccgcagcucuuacuuuaccuuccagcugcagaauaucgugaagccucugcccccuguuuaucucacguuuacaagagaauccagcugcgagauuaagcugaaauggucuaucccccuuggaccgauuccugcucgguguuucgacuacgaaaucgagauucgcgaagacgauaccacacuggugaccgccaccgucgagaacgagacauauacgcucaagaccacaaaugaaaccagacagcugugcuuuguggugcgguccaaagucaacaucuacugcagcgacgauggcaucugguccgaguggucugacaagcaauguugggaaggggaggaucuuagcaaaaagacacugcuccgcuucuggcugcccuucggauuuauucugauccucguuauuuucgugaccggccugcuucugagaaaaccuaauacguaucccaagaugauccccgaauuuuucugcgacacauga

SEQ ID NO: 1987 - protein, 272 aa, Artificial Sequence
  IL2-RA__Homo_sapiens__P01589
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 1988 - RNA, 819 nt, Artificial Sequence
  IL2-RA__Homo_sapiens__AAA67527
auggauucauaccugcugauguggggacugcucacguucaucauggugccuggcugccaggcagagcucugugacgaugacccgccagagaucccacacgccacauucaaagccauggccuacaaggaaggaaccauguugaacugugaaugcaagagagguuuccgcagaauaaaaagcgggucacucuauaugcucuguacaggaaacucuagccacucguccugggacaaccaaugucaaugcacaagcucugccacucggaacacaacgaaacaagugacaccucaaccugaagaacagaaagaaaggaaaaccacagaaaugcaaaguccaaugcagccaguggaccaagcgagccuuccaggucacugcagggaaccuccaccaugggaaaaugaagccacagagagaauuuaucauuucgugguggggcagaugguuuauuaucagugcguccagggauacagggcucuacacagagguccugcugagagcgucugcaaaaugacccacgggaagacaagguggacccagccccagcucauaugcacaggugaaauggagaccagucaguuuccaggugaagagaagccucaggcaagccccgaaggccguccugagagugagacuuccugccucgucacaacaacagauuuucaaauacagacagaaauggcugcaaccauggagacguccauauuuacaacagaguaccagguagcaguggccggcuguguuuuccugcugaucagcguccuccuccugagugggcucaccuggcagcggagacagaggaagaguagaagaacaaucuag

SEQ ID NO: 1989 - RNA, 819 nt, Artificial Sequence
  derived and/or modified sequence opt1 from IL2-RA__Homo_sapiens__AAA67527
auggacagcuaccugcucauguggggccugcugaccuucaucauggugcccgggugccaggccgagcucugcgacgacgacccgcccgagaucccccacgccaccuucaaggcgauggccuacaaggagggcacgaugcugaacugcgagugcaagcgcggguuccggcgcaucaaguccggcagccuguacaugcucugcaccgggaacuccagccacuccagcugggacaaccagugccagugcaccuccagcgccacccggaacacgaccaagcaggucacgccccagccggaggagcagaaggagcgcaagaccaccgagaugcagucccccaugcagcccguggaccaggccagccugcccggccacugccgggagccgccgcccugggagaacgaggccaccgagcgcaucuaccacuucguggucggccagaugguguacuaccagugcgugcagggguaccgggcgcugcaccgcggccccgccgaguccgucugcaagaugacccacgggaagacccgguggacgcagccccagcucaucugcaccggcgagauggagaccagccaguuccccggggaggagaagccccaggccucccccgagggccgcccggagagcgagaccuccugccuggugacgaccaccgacuuccagauccagaccgagauggccgcgacgauggagaccagcaucuucaccaccgaguaccagguggccgucgccggcugcguguuccugcucaucuccgugcugcugcucagcgggcugacguggcagcggcgccagcggaagucccgccggaccaucuga

SEQ ID NO: 1990 - RNA, 819 nt, Artificial Sequence
  derived and/or modified sequence opt2 from IL2-RA__Homo_sapiens__AAA67527
auggacuccuaccuccucauguggggccuccucaccuucaucaugguccccggcugccaggccgagcucugcgacgacgacccccccgagaucccccacgccaccuucaaggccauggccuacaaggagggcaccaugcucaacugcgagugcaagcgcggcuuccgccgcaucaaguccggcucccucuacaugcucugcaccggcaacuccucccacuccuccugggacaaccagugccagugcaccuccuccgccacccgcaacaccaccaagcaggucaccccccagcccgaggagcagaaggagcgcaagaccaccgagaugcagucccccaugcagcccgucgaccaggccucccuccccggccacugccgcgagcccccccccugggagaacgaggccaccgagcgcaucuaccacuucgucgucggccagauggucuacuaccagugcguccagggcuaccgcgcccuccaccgcggccccgccgaguccgucugcaagaugacccacggcaagacccgcuggacccagccccagcucaucugcaccggcgagauggagaccucccaguuccccggcgaggagaagccccaggccucccccgagggccgccccgaguccgagaccuccugccucgucaccaccaccgacuuccagauccagaccgagauggccgccaccauggagaccuccaucuucaccaccgaguaccaggucgccgucgccggcugcgucuuccuccucaucuccguccuccuccucuccggccucaccuggcagcgccgccagcgcaagucccgccgcaccaucuga

SEQ ID NO: 1991 - RNA, 819 nt, Artificial Sequence
  derived and/or modified sequence opt3 from IL2-RA__Homo_sapiens__AAA67527
auggacagcuaccugcucauguggggccuucugaccuucaucauggugcccgggugccaggccgaguugugugaugacgauccuccagaaauuccgcacgcuacauuuaaggcaauggccuauaaagagggaacuauguuaaacugcgaauguaagagagguuucaggcggauaaaauccggcucucuguacaugcuaugcacgggaaauucaagucauagcuccugggacaaccaaugucagugcaccucuucggcgacacgcaauacuaccaagcaggucacaccccagccugaggaacaaaaagagcgaaagaccacugagaugcagucaccaaugcagcccguugaucaggcuagccucccugggcacugucgugaaccacccccuugggagaacgaagccacagagagaaucuaucauuuugugguaggccaaaugguguacuaucagugcguccaggguuacagggcacugcaccgggggccagccgagaguguguguaagaugacccauggaaaaacgcgcuggacucagccgcaacuuauuugcaccggcgaaauggagacaucccaguuccccggcgaagagaagccucaggcuucuccagaagggagacccgagagcgagacuuccugucugguuaccacaaccgacuuucaaauccagacggaaauggcagccacuauggagacaucaauuuucaccacugaauaucagguggcugucgccggaugcguguuuuugcucaucaguguacugcugcucagcgguuuaacauggcagaggcggcaacgcaaaucucgaagaaccauauga

SEQ ID NO: 1992 - RNA, 819 nt, Artificial Sequence
  derived and/or modified sequence opt4 from IL2-RA__Homo_sapiens__AAA67527
auggacagcuaccugcugauguggggccugcugaccuucaucauggugcccggcugccaggccgagcugugcgacgacgacccccccgagaucccccacgccaccuucaaggccauggccuacaaggagggcaccaugcugaacugcgagugcaagagaggcuucagaagaaucaagagcggcagccuguacaugcugugcaccggcaacagcagccacagcagcugggacaaccagugccagugcaccagcagcgccaccagaaacaccaccaagcaggugaccccccagcccgaggagcagaaggagagaaagaccaccgagaugcagagccccaugcagcccguggaccaggccagccugcccggccacugcagagagcccccccccugggagaacgaggccaccgagagaaucuaccacuucguggugggccagaugguguacuaccagugcgugcagggcuacagagcccugcacagaggccccgccgagagcgugugcaagaugacccacggcaagaccagauggacccagccccagcugaucugcaccggcgagauggagaccagccaguuccccggcgaggagaagccccaggccagccccgagggcagacccgagagcgagaccagcugccuggugaccaccaccgacuuccagauccagaccgagauggccgccaccauggagaccagcaucuucaccaccgaguaccagguggccguggccggcugcguguuccugcugaucagcgugcugcugcugagcggccugaccuggcagagaagacagagaaagagcagaagaaccaucuga

SEQ ID NO: 1993 - RNA, 819 nt, Artificial Sequence
  derived and/or modified sequence opt5 from IL2-RA__Homo_sapiens__AAA67527
auggacagcuaccugcucauguggggccugcuuaccuucaucauggugcccgggugccaggccgagcugugugaugacgauccuccggaaauuccccacgcuacauuuaaggccauggcguauaaagagggaacgaugcucaacugcgaauguaagagaggcuuccggcgcaucaaauccgggucucuguacaugcuuugcaccggaaauagcucccauucuagcugggacaaccaaugucagugcacauccucugcuaccagaaauacaaccaagcaggucacaccucagcccgaggaacaaaaagagcggaagaccacggagaugcagagcccuaugcagcccguugaucaggccucccugccuggccacugucgcgaaccgcccccuugggagaacgaagccaccgagagaauuuaucauuuugugguggggcaaauggucuacuaucagugcgugcagggauaccgggcucuccaccgcggccccgccgagagcguuuguaagaugacacauggcaaaaccagauggacacagccucaacugaucugcaccggggaaauggagacgucucaguuccccggagaagagaagccgcaggcuuccccugaaggccggcccgagagcgagacaucuugucuggugaccacaaccgacuuucaaauucagaccgaaauggccgcgacaauggagacguccaucuucaccacagaauaucaggucgccguggcugggugcguuuuucuccugaucagcgugcuucugcucucuggacugaccuggcagcgcagacaacggaaaucccgcagaacaauuuga

SEQ ID NO: 1994 - protein, 551 aa, Artificial Sequence
  IL2-RB__Homo_sapiens__P14784
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 1995 - RNA, 1656 nt, Artificial Sequence
  IL2-RB__Homo_sapiens__AAA59143
auggcggccccugcucuguccuggcgucugccccuccucauccuccuccugccccuggcuaccucuugggcaucugcagcggugaauggcacuucccaguucacaugcuucuacaacucgagagccaacaucuccugugucuggagccaagauggggcucugcaggacacuuccugccaaguccaugccuggccggacagacggcgguggaaccaaaccugugagcugcuccccgugagucaagcauccugggccugcaaccugauccucggagccccagauucucagaaacugaccacaguugacaucgucacccugagggugcugugccgugagggggugcgauggagggugauggccauccaggacuucaagcccuuugagaaccuucgccugauggcccccaucucccuccaaguuguccacguggagacccacagaugcaacauaagcugggaaaucucccaagccucccacuacuuugaaagacaccuggaguucgaggcccggacgcuguccccaggccacaccugggaggaggccccccugcugacucucaagcagaagcaggaauggaucugccuggagacgcucaccccagacacccaguaugaguuucaggugcgggucaagccucugcaaggcgaguucacgaccuggagccccuggagccagccccuggccuucaggacaaagccugcagcccuugggaaggacaccauuccguggcucggccaccuccucgugggccucagcggggcuuuuggcuucaucaucuuaguguacuugcugaucaacugcaggaacaccgggccauggcugaagaagguccugaaguguaacaccccagaccccucgaaguucuuuucccagcugagcucagagcauggaggagacguccagaaguggcucucuucgcccuuccccucaucguccuucagcccuggcggccuggcaccugagaucucgccacuagaagugcuggagagggacaaggugacgcagcugcuccugcagcaggacaaggugccugagcccgcauccuuaagcagcaaccacucgcugaccagcugcuucaccaaccaggguuacuucuucuuccaccucccggaugccuuggagauagaggccugccagguguacuuuacuuacgaccccuacucagaggaagacccugaugaggguguggccggggcacccacagggucuuccccccaaccccugcagccucugucaggggaggacgacgccuacugcaccuuccccuccagggaugaccugcugcucuucucccccagucuccucgguggccccagccccccaagcacugccccugggggcaguggggccggugaagagaggaugcccccuucuuugcaagaaagaguccccagagacugggacccccagccccuggggccucccaccccaggagucccagaccugguggauuuucagccacccccugagcuggugcugcgagaggcuggggaggaggucccugacgcuggccccagggagggagucaguuuccccugguccaggccuccugggcagggggaguucagggcccuuaaugcucgccugccccugaacacugaugccuacuugucccuccaagaacuccagggucaggacccaacucacuugguguag

SEQ ID NO: 1996 - RNA, 1656 nt, Artificial Sequence
  derived and/or modified sequence opt1 from IL2-RB__Homo_sapiens__AAA59143
auggccgcccccgcgcugagcuggcgccucccgcugcugauccuccugcugccccucgccaccuccugggccagcgccgccgugaacggcaccucccaguucacgugcuucuacaacagccgggcgaacaucuccugcgucuggagccaggacggggcccugcaggacaccuccugccaggugcacgccuggcccgaccgccggcgcuggaaccagaccugcgagcugcuccccgugagccaggccuccugggcgugcaaccugauccugggcgccccggacagccagaagcucaccacggucgacaucgugacccugcgggugcugugccgcgaggggguccgguggcgcgugauggccauccaggacuucaagcccuucgagaaccuccggcugauggcccccaucucccuccaggugguccacguggagacccaccgcugcaacaucagcugggagaucucccaggccagccacuacuucgagcggcaccuggaguucgaggcgcgcacccugucccccggccacacgugggaggaggccccgcugcucacccugaagcagaagcaggaguggaucugccuggagacccucacccccgacacgcaguacgaguuccaggugcgggucaagccccugcagggggaguucaccaccuggagccccuggucccagccgcuggccuuccgcaccaagcccgccgcccucggcaaggacacgauccccuggcugggccaccuccugguggggcugagcggcgcguucggguucaucauccugguguaccuccugaucaacugccggaacaccggccccuggcugaagaagguccucaagugcaacaccccggaccccuccaaguucuucagccagcugagcuccgagcacgggggcgacgugcagaaguggcugagcucccccuuccccagcuccagcuucuccccgggcgggcucgcccccgagaucagcccccuggaggugcuggagcgcgacaaggucacccagcuccugcugcagcaggacaaggugcccgagccggccucccucagcuccaaccacagccugacguccugcuucaccaaccagggcuacuucuucuuccaccuccccgacgcccuggagaucgaggccugccagguguacuucaccuacgaccccuacagcgaggaggaccccgacgagggggucgcgggcgccccgaccggcuccagcccccagccccugcagccgcuguccggggaggacgacgccuacugcacguuccccagccgggacgaccugcuccuguucucccccagccugcucggcgggcccagcccgcccuccaccgcccccggcgggagcggcgccggcgaggagcgcaugcccccgucccugcaggagcgggugccccgcgacugggacccccagccccuggggccgcccacccccggcgugcccgaccucgucgacuuccagccgccgcccgagcuggugcugcgggaggcgggggaggagguccccgacgccggcccccgcgagggggugagcuuccccuggucccgcccgcccggccagggcgaguuccgggcccucaacgcccgccugccccugaacaccgacgcguaccucagccugcaggagcugcaggggcaggaccccacgcaccucguguga

SEQ ID NO: 1997 - RNA, 1656 nt, Artificial Sequence
  derived and/or modified sequence opt2 from IL2-RB__Homo_sapiens__AAA59143
auggccgcccccgcccucuccuggcgccucccccuccucauccuccuccucccccucgccaccuccugggccuccgccgccgucaacggcaccucccaguucaccugcuucuacaacucccgcgccaacaucuccugcgucuggucccaggacggcgcccuccaggacaccuccugccagguccacgccuggcccgaccgccgccgcuggaaccagaccugcgagcuccuccccgucucccaggccuccugggccugcaaccucauccucggcgcccccgacucccagaagcucaccaccgucgacaucgucacccuccgcguccucugccgcgagggcguccgcuggcgcgucauggccauccaggacuucaagcccuucgagaaccuccgccucauggcccccaucucccuccaggucguccacgucgagacccaccgcugcaacaucuccugggagaucucccaggccucccacuacuucgagcgccaccucgaguucgaggcccgcacccucucccccggccacaccugggaggaggccccccuccucacccucaagcagaagcaggaguggaucugccucgagacccucacccccgacacccaguacgaguuccagguccgcgucaagccccuccagggcgaguucaccaccuggucccccuggucccagccccucgccuuccgcaccaagcccgccgcccucggcaaggacaccauccccuggcucggccaccuccucgucggccucuccggcgccuucggcuucaucauccucgucuaccuccucaucaacugccgcaacaccggccccuggcucaagaagguccucaagugcaacacccccgaccccuccaaguucuucucccagcucuccuccgagcacggcggcgacguccagaaguggcucuccucccccuuccccuccuccuccuucucccccggcggccucgcccccgagaucuccccccucgagguccucgagcgcgacaaggucacccagcuccuccuccagcaggacaagguccccgagcccgccucccucuccuccaaccacucccucaccuccugcuucaccaaccagggcuacuucuucuuccaccuccccgacgcccucgagaucgaggccugccaggucuacuucaccuacgaccccuacuccgaggaggaccccgacgagggcgucgccggcgcccccaccggcuccuccccccagccccuccagccccucuccggcgaggacgacgccuacugcaccuuccccucccgcgacgaccuccuccucuucucccccucccuccucggcggccccuccccccccuccaccgcccccggcggcuccggcgccggcgaggagcgcaugccccccucccuccaggagcgcgucccccgcgacugggacccccagccccucggcccccccacccccggcguccccgaccucgucgacuuccagcccccccccgagcucguccuccgcgaggccggcgaggagguccccgacgccggcccccgcgagggcgucuccuuccccuggucccgcccccccggccagggcgaguuccgcgcccucaacgcccgccucccccucaacaccgacgccuaccucucccuccaggagcuccagggccaggaccccacccaccucgucuga

SEQ ID NO: 1998 - RNA, 1656 nt, Artificial Sequence
  derived and/or modified sequence opt3 from IL2-RB__Homo_sapiens__AAA59143
auggccgcucccgcacugagcuggagacucccucuucugaucuuguuacugccacuagccaccuccugggcgucugcugccgugaacggcacaucacaguucacuugcuuuuacaauaguagggcaaacauuagcugugucuggucccaagacggggcccuccaggauacgucuugccagguucacgcuuggccggaccggcgccgauggaaucagaccugugagcugcuucccgugucgcaagcaucaugggccugcaaccugauauugggagcuccugauagccagaagcucacaacuguagacaucgugacccugcguguccuguguagagaaggugugagguggcggguuauggccauucaggauuucaaaccauuugagaaucuccgcuuaauggcgcccaucagucuucaggugguccauguggaaacacacagaugcaacauuuccugggagaucucucaagcaagccauuauuucgaaaggcaccuggaguuugaggcccggaccuuguccccuggccauacuugggaagaggcuccacugcuaacacucaagcagaaacaggaauggauaugucuggagacccuuacgcccgacacucaguacgaguuccaaguacgcguuaagccucugcagggggaauuuaccacauggucaccauggagucagccguuggccuuccgaacuaaacccgcagcucucggaaaggauaccaucccuuggcugggccacuuacuggugggucucagcggggccuuuggauucauuauccuugucuaucuguugauuaauugcagaaacacaggcccauggcuaaagaaagugcugaaguguaauacccccgacccuucuaaauuuuucucccaacucucaagcgagcacggcggggaugugcagaaguggcugaguucuccauuucccuccagcucguucucuccgggaggucuugcgccugaaaucucaccccuggaggucuuggaaagggacaaaguuacgcagcuccuguuacagcaagauaaggugccagagccugccucccugaguagcaaccauucccuaacuucuugcuucacaaaucagggcuacuuuuucuuucaccuccccgacgcacuggagauagaggcuugucagguauauuucaccuacgauccauauagcgaagaagaccccgacgaggggguggccggagcuccuacuggcucaaguccacagccgcuucaacccuuguccggugaagaugacgccuacugcacauuuccuagccgggaugaccugcuccuguucucuccaucacuucugggagggcccaguccuccaagcaccgcacccggcggcuccggggccggagaggagcguaugccgccuucuuugcaggaacgcgucccaagagauugggacccccagccucucggucccccaacgccuggcgugcccgaucugguugacuuucagccaccgccugaguuagugcugagggaagcuggggaggaaguccccgaugcgggaccacgggagggcgugucguuccccuggagccgaccuccaggucaaggggaguuucgcgcacuaaacgccagacucccccugaauaccgacgcuuaccuuuccuugcaggaacugcagggccaggauccuacacaucucguauga

SEQ ID NO: 1999 - RNA, 1656 nt, Artificial Sequence
  derived and/or modified sequence opt4 from IL2-RB__Homo_sapiens__AAA59143
auggccgcccccgcccugagcuggagacugccccugcugauccugcugcugccccuggccaccagcugggccagcgccgccgugaacggcaccagccaguucaccugcuucuacaacagcagagccaacaucagcugcguguggagccaggacggcgcccugcaggacaccagcugccaggugcacgccuggcccgacagaagaagauggaaccagaccugcgagcugcugcccgugagccaggccagcugggccugcaaccugauccugggcgcccccgacagccagaagcugaccaccguggacaucgugacccugagagugcugugcagagagggcgugagauggagagugauggccauccaggacuucaagcccuucgagaaccugagacugauggcccccaucagccugcagguggugcacguggagacccacagaugcaacaucagcugggagaucagccaggccagccacuacuucgagagacaccuggaguucgaggccagaacccugagccccggccacaccugggaggaggccccccugcugacccugaagcagaagcaggaguggaucugccuggagacccugacccccgacacccaguacgaguuccaggugagagugaagccccugcagggcgaguucaccaccuggagccccuggagccagccccuggccuucagaaccaagcccgccgcccugggcaaggacaccauccccuggcugggccaccugcuggugggccugagcggcgccuucggcuucaucauccugguguaccugcugaucaacugcagaaacaccggccccuggcugaagaaggugcugaagugcaacacccccgaccccagcaaguucuucagccagcugagcagcgagcacggcggcgacgugcagaaguggcugagcagccccuuccccagcagcagcuucagccccggcggccuggcccccgagaucagcccccuggaggugcuggagagagacaaggugacccagcugcugcugcagcaggacaaggugcccgagcccgccagccugagcagcaaccacagccugaccagcugcuucaccaaccagggcuacuucuucuuccaccugcccgacgcccuggagaucgaggccugccagguguacuucaccuacgaccccuacagcgaggaggaccccgacgagggcguggccggcgcccccaccggcagcagcccccagccccugcagccccugagcggcgaggacgacgccuacugcaccuuccccagcagagacgaccugcugcuguucagccccagccugcugggcggccccagcccccccagcaccgcccccggcggcagcggcgccggcgaggagagaaugccccccagccugcaggagagagugcccagagacugggacccccagccccugggcccccccacccccggcgugcccgaccugguggacuuccagcccccccccgagcuggugcugagagaggccggcgaggaggugcccgacgccggccccagagagggcgugagcuuccccuggagcagaccccccggccagggcgaguucagagcccugaacgccagacugccccugaacaccgacgccuaccugagccugcaggagcugcagggccaggaccccacccaccugguguga

SEQ ID NO: 2000 - RNA, 1656 nt, Artificial Sequence
  derived and/or modified sequence opt5 from IL2-RB__Homo_sapiens__AAA59143
auggccgcucccgcccugagcuggagacucccucugcuuauccugcuccugccgcuugcgaccuccugggcuucugccgccgugaacggcacaagccaguucacgugcuuuuacaauucccgggcuaacauuucuugugucuggagccaagacggggcccugcaggauaccuccugccagguucacgcuuggcccgaccgcagacgguggaaucagacaugugagcuccugccugugucucaagccagcugggcgugcaaccugauccucggagcccccgauucccagaagcugaccacaguggacauugucacccuucgcgugcuguguagagaaggcguucgguggcgcgugauggcuauccaggauuucaaaccuuuugagaaucucagacugauggcccccauuagccuucaggucgugcauguugaaacacaccggugcaacaucucuugggagaucucccaagcuagccauuauuucgaacgccaccuggaguuugaggccagaacccucucuccugggcauacgugggaagaggcgccgcugcugacccucaagcagaaacaggaauggauuugucuggagacacuuacccccgacacacaguacgaguuccaagugcgggucaagccucugcagggagaauuuaccacguggucccccuggagccagccucucgccuuccgcacaaaacccgcugcccugggcaaggauaccaucccguggcuugggcaucugcucgugggacugucuggcgcuuuuggcuucauuauccugguguaucuccugauuaauugcagaaacacagggccuuggcuuaagaaaguccugaaguguaauacccccgacccuuccaaauuuuucagccaacucuccucugagcacggaggcgauguucagaaguggcugagcucccccuuucccuccucuuccuucagcccugggggacuugccccggaaaucucuccccuggaggugcucgaacgggacaaagugacccagcugcugcuccagcaagauaaggucccugagcccgccagccuguccucuaaccacagccuuacauccugcuucacgaaucagggcuacuuuuucuuucaucugccugacgcucucgagauugaagcgugucagguguauuucaccuacgaucccuauagcgaggaagacccggacgaggggguugccggagcuccuacaggcucuagcccccagccucugcaaccccugagcggcgaagaugacgccuacugcaccuuuccuucucgcgaugaccuucuccuguucucccccagccugcucgggggaccguccccucccucuacagcccccggcgggagcggagcuggcgaggagagaaugccuccgucccugcaggaacgggugcccagagauugggacccucagccccuugggccucccaccccuggaguccccgaucugguggacuuucagccgccucccgagcucguucugcgcgaagccggcgaggaagugccugaugcgggcccccgggagggggucucuuucccguggagcagaccucccggacaaggcgaguuucgcgcucugaacgcccggcuuccucucaauacggacgccuaccugucccugcaggaacuccaggggcaggaucccacacaccugguguga

SEQ ID NO: 2001 - protein, 369 aa, Artificial Sequence
  IL2-RG__Homo_sapiens__P31785
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 2002 - RNA, 1110 nt, Artificial Sequence
  IL2-RG__Homo_sapiens__AAA59145
auguugaagccaucauuaccauucacaucccucuuauuccugcagcugccccugcugggaguggggcugaacacgacaauucugacgcccaaugggaaugaagacaccacagcugauuucuuccugaccacuaugcccacugacucccucaguguuuccacucuaccccucccagagguucaguguuuuguguucaaugucgaguacaugaauugcacuuggaacagcagcucugagccccagccuaccaaccucacucugcauuauugguacaagaacucggauaaugauaaaguccagaagugcagccacuaucuauucucugaagaaaucacuucuggcugucaguugcaaaaaaaggagauccaccucuaccaaacauuuguuguucagcuccaggacccacgggaacccaggagacaggccacacagaugcuaaaacugcagaaucuggugauccccugggcuccagagaaccuaacacuucacaaacugagugaaucccagcuagaacugaacuggaacaacagauucuugaaccacuguuuggagcacuuggugcaguaccggacugacugggaccacagcuggacugaacaaucaguggauuauagacauaaguucuccuugccuaguguggaugggcagaaacgcuacacguuucguguucggagccgcuuuaacccacucuguggaagugcucagcauuggagugaauggagccacccaauccacugggggagcaauacuucaaaagagaauccuuuccuguuugcauuggaagccgugguuaucucuguuggcuccaugggauugauuaucagccuucucuguguguauuucuggcuggaacggacgaugccccgaauucccacccugaagaaccuagaggaucuuguuacugaauaccacgggaacuuuucggccuggaguggugugucuaagggacuggcugagagucugcagccagacuacagugaacgacucugccucgucagugagauucccccaaaaggaggggcccuuggggaggggccuggggccuccccaugcaaccagcauagccccuacugggcccccccauguuacacccuaaagccugaaaccuga

SEQ ID NO: 2003 - RNA, 1110 nt, Artificial Sequence
  derived and/or modified sequence opt1 from IL2-RG__Homo_sapiens__AAA59145
augcugaagcccagccucccguucaccucccugcuguuccuccagcugccccugcucggcguggggcugaacaccacgauccugacccccaacggcaacgaggacaccaccgccgacuucuuccucacgaccaugcccaccgacagccuguccgucagcacccugccgcuccccgaggugcagugcuucguguucaacgucgaguacaugaacugcacguggaacuccagcuccgagccccagcccaccaaccugacccugcacuacugguacaagaacagcgacaacgacaaggugcagaagugcucccacuaccucuucagcgaggagaucaccuccgggugccagcugcagaagaaggagauccaccuguaccagacguucgugguccagcuccaggacccgcgcgagccccggcgccaggccacccagaugcugaagcugcagaaccucgugauccccugggcgcccgagaaccugacccugcacaagcucagcgagucccagcuggagcugaacuggaacaaccgguuccucaaccacugccuggagcaccuggugcaguaccgcaccgacugggaccacagcuggacggagcaguccgucgacuaccggcacaaguucagccucccguccguggacggccagaagcgcuacaccuuccgggugcgcagccgguucaacccccugugcggguccgcccagcacuggagcgaguggagccaccccauccacuggggcuccaacaccagcaaggagaaccccuuccuguucgcccucgaggccgucgugaucuccgugggcagcauggggcugaucaucucccugcucugcgucuacuucuggcuggagcgcaccaugccgcggauccccacgcugaagaaccucgaggaccuggugaccgaguaccacggcaacuucagcgccugguccggggugagcaagggccuggcggagucccuccagcccgacuacagcgagcgccugugccuggucuccgagaucccgcccaagggcggggcccucggcgaggggcccggcgccagccccugcaaccagcacucccccuacugggccccgcccugcuacacccugaagcccgagaccuga

SEQ ID NO: 2004 - RNA, 1110 nt, Artificial Sequence
  derived and/or modified sequence opt2 from IL2-RG__Homo_sapiens__AAA59145
augcucaagcccucccuccccuucaccucccuccucuuccuccagcucccccuccucggcgucggccucaacaccaccauccucacccccaacggcaacgaggacaccaccgccgacuucuuccucaccaccaugcccaccgacucccucuccgucuccacccucccccuccccgagguccagugcuucgucuucaacgucgaguacaugaacugcaccuggaacuccuccuccgagccccagcccaccaaccucacccuccacuacugguacaagaacuccgacaacgacaagguccagaagugcucccacuaccucuucuccgaggagaucaccuccggcugccagcuccagaagaaggagauccaccucuaccagaccuucgucguccagcuccaggacccccgcgagccccgccgccaggccacccagaugcucaagcuccagaaccucgucauccccugggcccccgagaaccucacccuccacaagcucuccgagucccagcucgagcucaacuggaacaaccgcuuccucaaccacugccucgagcaccucguccaguaccgcaccgacugggaccacuccuggaccgagcaguccgucgacuaccgccacaaguucucccuccccuccgucgacggccagaagcgcuacaccuuccgcguccgcucccgcuucaacccccucugcggcuccgcccagcacugguccgaguggucccaccccauccacuggggcuccaacaccuccaaggagaaccccuuccucuucgcccucgaggccgucgucaucuccgucggcuccaugggccucaucaucucccuccucugcgucuacuucuggcucgagcgcaccaugccccgcauccccacccucaagaaccucgaggaccucgucaccgaguaccacggcaacuucuccgccugguccggcgucuccaagggccucgccgagucccuccagcccgacuacuccgagcgccucugccucgucuccgagaucccccccaagggcggcgcccucggcgagggccccggcgccucccccugcaaccagcacucccccuacugggccccccccugcuacacccucaagcccgagaccuga

SEQ ID NO: 2005 - RNA, 1110 nt, Artificial Sequence
  derived and/or modified sequence opt3 from IL2-RG__Homo_sapiens__AAA59145
augcugaagcccagccucccuuucaccucccuucuguuuuugcaguuaccacugcuaggcguggggcucaacacaacuauccugacgccgaauggaaacgaggacaccacagccgauuucuuucuuacuaccaugcccacagacucucugucagucaguaccuugccucucccagaaguucaaugcuucguguuuaauguagaguacaugaacuguacuuggaauagcuccucugaaccccagccuacaaaccugacccugcacuauugguacaaaaauucggauaacgacaaggugcagaaaugcucacauuaucucuucagcgaggaaaucacgagugguugucaguuacaaaagaaagagauacaccuguaccagacuuuugucgugcagcuucaggauccaagagagcccaggcggcaagcuacccagauguugaagcugcagaaucuaguuaucccuugggcaccagaaaaccucacacugcauaaacuuuccgagucucagcuggaauugaauuggaacaaucgcuuccucaaccacugccuggagcauuuagugcaauaucgaacugacugggaucacagcuggaccgagcaguccgucgacuaccgucacaaguuuucacugccgaguguggauggccagaagagauauacauucaggguacggagccgcuuuaauccccucugugggucugcccaacauugguccgaauggucacacccuauucauuggggaagcaacaccaguaaagagaacccauuccuuuuugcgcuggaagcuguugugaucucugucggcuccauggguuugauuaucagccuacugugcguguacuucuggcucgagagaacgaugcccaggauaccuacucugaagaaucuugaagaccuggugacagaguaccacgggaacuucucggccuggucuggagucuccaaaggcuuggcagagucacuccagccagauuauagugaacggcuguguuuaguuagcgagauucccccgaagggcggggcccugggagaagguccuggcgcuucccccugcaaucagcacucuccauacugggcaccucccuguuauacccuaaagccagagacuuga

SEQ ID NO: 2006 - RNA, 1110 nt, Artificial Sequence
  derived and/or modified sequence opt4 from IL2-RG__Homo_sapiens__AAA59145
augcugaagcccagccugcccuucaccagccugcuguuccugcagcugccccugcugggcgugggccugaacaccaccauccugacccccaacggcaacgaggacaccaccgccgacuucuuccugaccaccaugcccaccgacagccugagcgugagcacccugccccugcccgaggugcagugcuucguguucaacguggaguacaugaacugcaccuggaacagcagcagcgagccccagcccaccaaccugacccugcacuacugguacaagaacagcgacaacgacaaggugcagaagugcagccacuaccuguucagcgaggagaucaccagcggcugccagcugcagaagaaggagauccaccuguaccagaccuucguggugcagcugcaggaccccagagagcccagaagacaggccacccagaugcugaagcugcagaaccuggugauccccugggcccccgagaaccugacccugcacaagcugagcgagagccagcuggagcugaacuggaacaacagauuccugaaccacugccuggagcaccuggugcaguacagaaccgacugggaccacagcuggaccgagcagagcguggacuacagacacaaguucagccugcccagcguggacggccagaagagauacaccuucagagugagaagcagauucaacccccugugcggcagcgcccagcacuggagcgaguggagccaccccauccacuggggcagcaacaccagcaaggagaaccccuuccuguucgcccuggaggccguggugaucagcgugggcagcaugggccugaucaucagccugcugugcguguacuucuggcuggagagaaccaugcccagaauccccacccugaagaaccuggaggaccuggugaccgaguaccacggcaacuucagcgccuggagcggcgugagcaagggccuggccgagagccugcagcccgacuacagcgagagacugugccuggugagcgagaucccccccaagggcggcgcccugggcgagggccccggcgccagccccugcaaccagcacagccccuacugggccccccccugcuacacccugaagcccgagaccuga

SEQ ID NO: 2007 - RNA, 1110 nt, Artificial Sequence
  derived and/or modified sequence opt5 from IL2-RG__Homo_sapiens__AAA59145
augcugaagcccagccucccuuucaccucccugcuuuuucugcagcucccgcugcuuggcguggggcugaacacaacgauccucacccccaauggaaacgaggacacaaccgccgauuucuuucugacaaccaugccuacagacucucugagcgucuccacccucccccugccugaaguucaaugcuucguguuuaauguggaguacaugaacuguacguggaacucuagcuccgaaccccagccuaccaaucuuacacugcacuauugguacaaaaauucugauaacgacaagguccagaaaugcagccauuaucucuucuccgaggaaaucaccagcggcugucagcugcaaaagaaagagauccaccuuuaccagacauuugugguucagcugcaggauccgagagagccccggcgccaagccacccagaugcucaagcugcagaaucuggugauuccuugggcccccgaaaaccucacgcugcauaaacuuucugagucccagcuggaacucaauuggaacaauagauuccugaaccacugccuugagcaucugguccaauaucggacagacugggaucacagcuggaccgagcagucuguggacuaccgccacaaguuuucccucccuagcguugaugggcagaagagauauacauuccgggugcgcucuagauuuaauccccuguguggauccgcgcaacauuggagcgaauggucccacccgauccauuggggcucuaacaccagcaaagagaacccuuuccuguuugcucucgaagccgucgugauuuccguggggagcaugggacugaucaucucucuucugugcgucuacuucuggcucgagcggaccaugccccgcauuccuacacugaagaaucuugaagaccugguuacggaguaccacggcaacuucuccgccuggagcggcgugucuaaagggcucgcugagagccugcagcccgauuauuccgaaagacugugucucgugucugagauucccccuaagggaggcgcccugggggaaggaccgggcgcuagccccugcaaucagcacuccccuuacugggcucccccuuguuauacccuuaagcccgagacauga

SEQ ID NO: 2008 - protein, 184 aa, Artificial Sequence
  IMP3__Homo_sapiens__Q9NV31
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 2009 - RNA, 555 nt, Artificial Sequence
  IMP3__Homo_sapiens__AAH06487
auggugcggaagcuuaaguuccacgagcagaagcugcugaagcagguggacuuccugaacugggaggucaccgaccacaaccugcacgagcugcgcgugcugcggcguuaccggcugcagcggcgggaggacuacacgcgcuacaaccagcugagccgugccgugcgugagcuggcgcggcgccugcgcgaccugcccgaacgcgaccaguuccgcgugcgcgcuucggccgcgcugcuggacaagcuguaugcucucggcuuggugcccacgcgcgguucgcuggagcucugcgacuucgucacggccucguccuucugccgccgccgccuccccaccgugcuccucaagcugcgcauggcgcagcaccuucaggcugcaguggccuuuguggagcaagggcacguacgcgugggcccugacgugguuaccgaccccgccuuccuugucacgcgcagcauggaggacuuugucacuuggguggacucguccaagaucaagcggcacgugcuagaguacaaugaggagcgcgaugacuucgaucuggaagccuag

SEQ ID NO: 2010 - RNA, 555 nt, Artificial Sequence
  derived and/or modified sequence opt1 from IMP3__Homo_sapiens__AAH06487
auggugcgcaagcugaaguuccacgagcagaagcuccugaagcaggucgacuuccugaacugggaggugaccgaccacaaccuccacgagcugcgggugcugcgccgguaccgccuccagcggcgcgaggacuacacccgguacaaccagcugagccgcgccguccgggagcuggcccgccggcuccgcgaccugcccgagcgggaccaguuccgcgugcgggcguccgccgcccugcucgacaagcuguacgcccugggccucgugccgacgcgcgggagccuggagcugugcgacuucgucaccgccuccagcuucugccggcgccggcuccccaccgugcugcugaagcuccgcauggcgcagcaccuccaggccgccguggccuucgucgagcagggccacgugcggguggggcccgacgucgugaccgaccccgcguuccuggugacgcgcuccauggaggacuucgucaccuggguggacagcuccaagaucaagcgccacgugcuggaguacaacgaggagcgggacgacuucgaccuggaggccuga

SEQ ID NO: 2011 - RNA, 555 nt, Artificial Sequence
  derived and/or modified sequence opt2 from IMP3__Homo_sapiens__AAH06487
augguccgcaagcucaaguuccacgagcagaagcuccucaagcaggucgacuuccucaacugggaggucaccgaccacaaccuccacgagcuccgcguccuccgccgcuaccgccuccagcgccgcgaggacuacacccgcuacaaccagcucucccgcgccguccgcgagcucgcccgccgccuccgcgaccuccccgagcgcgaccaguuccgcguccgcgccuccgccgcccuccucgacaagcucuacgcccucggccucguccccacccgcggcucccucgagcucugcgacuucgucaccgccuccuccuucugccgccgccgccuccccaccguccuccucaagcuccgcauggcccagcaccuccaggccgccgucgccuucgucgagcagggccacguccgcgucggccccgacgucgucaccgaccccgccuuccucgucacccgcuccauggaggacuucgucaccugggucgacuccuccaagaucaagcgccacguccucgaguacaacgaggagcgcgacgacuucgaccucgaggccuga

SEQ ID NO: 2012 - RNA, 555 nt, Artificial Sequence
  derived and/or modified sequence opt3 from IMP3__Homo_sapiens__AAH06487
auggugagaaagcugaaauuccacgagcagaagcuccuuaaacaagucgacuuucugaacugggaaguuaccgaucauaauuugcacgaguuaagggugcugcggcgcuaccgacuacagcguagagaagacuauacaagguacaaccagcucagccgggccguacgcgagcuggcuagaaggcuucgggaucugcccgaacgcgaccaguuccgagugagagcauccgccgcguugcucgauaagcuguaugcucugggccucgucccuacuagggggucuuuagagcugugcgacuuugugacggccucaaguuucugucggcgucgccuuccaaccguuuugcugaaacuaagaauggcacaacaucuccaggccgcuguggcauuugucgagcagggacacgugaggguagguccggauguugugacagaccccgccuuccuggucacucggagcauggaagauuuugugaccuggguggacuccucuaagaucaagcgacauguccuugaguacaaugaggaacgcgaugacuucgaucuggaggcuuga

SEQ ID NO: 2013 - RNA, 555 nt, Artificial Sequence
  derived and/or modified sequence opt4 from IMP3__Homo_sapiens__AAH06487
auggugagaaagcugaaguuccacgagcagaagcugcugaagcagguggacuuccugaacugggaggugaccgaccacaaccugcacgagcugagagugcugagaagauacagacugcagagaagagaggacuacaccagauacaaccagcugagcagagccgugagagagcuggccagaagacugagagaccugcccgagagagaccaguucagagugagagccagcgccgcccugcuggacaagcuguacgcccugggccuggugcccaccagaggcagccuggagcugugcgacuucgugaccgccagcagcuucugcagaagaagacugcccaccgugcugcugaagcugagaauggcccagcaccugcaggccgccguggccuucguggagcagggccacgugagagugggccccgacguggugaccgaccccgccuuccuggugaccagaagcauggaggacuucgugaccuggguggacagcagcaagaucaagagacacgugcuggaguacaacgaggagagagacgacuucgaccuggaggccuga

SEQ ID NO: 2014 - RNA, 555 nt, Artificial Sequence
  derived and/or modified sequence opt5 from IMP3__Homo_sapiens__AAH06487
auggugagaaagcugaaauuccacgagcagaagcuccugaaacaagucgacuuucuuaacugggaaguuaccgaucauaaucugcacgagcuccgggugcugcgcagauaccggcuucagcgcagagaagacuauacacgguacaaccagcugagccgcgccgugagagagcucgcucggcgccugagagaucugcccgaacgggaccaguuccgcgucagagccuccgcggcucuccuggauaaacuuuaugcccugggccucgugccuacgcgggggucucuggagcuuugcgacuuuguuaccgccagcuccuucugucgcagacggcugccgacagugcuccugaagcugagaauggcucaacaucuccaggccgcugucgccuuuguggagcagggacacguucgcgugggccccgaugucgugaccgacccugcguuccuggugacacggucuauggaagauuuugucaccuggguugacagcuccaagaucaagagacaugugcuugaguacaaugaggaacgcgaugacuucgaucuggaggccuga

SEQ ID NO: 2015 - protein, 1049 aa, Artificial Sequence
  ITA5__Homo_sapiens__P08648
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 2016 - RNA, 3150 nt, Artificial Sequence
  ITA5__Homo_sapiens__AAH08786
auggggagccggacgccagaguccccucuccacgccgugcagcugcgcuggggcccccggcgccgacccccgcugcugccgcugcuguugcugcugcugccgccgccacccagggucgggggcuucaacuuagacgcggaggccccagcaguacucucggggcccccgggcuccuucuucggauucucaguggaguuuuaccggccgggaacagacggggucagugugcuggugggagcacccaaggcuaauaccagccagccaggagugcugcaggguggugcugucuaccucuguccuuggggugccagccccacacagugcacccccauugaauuugacagcaaaggcucucggcuccuggaguccucacuguccagcucagagggagaggagccuguggaguacaaguccuugcagugguucggggcaacaguucgagcccauggcuccuccaucuuggcaugcgcuccacuguacagcuggcgcacagagaaggagccacugagcgaccccgugggcaccugcuaccucuccacagauaacuucacccgaauucuggaguaugcacccugccgcucagauuucagcugggcagcaggacaggguuacugccaaggaggcuucagugccgaguucaccaagacuggccgugugguuuuagguggaccaggaagcuauuucuggcaaggccagauccugucugccacucaggagcagauugcagaaucuuauuaccccgaguaccugaucaaccugguucaggggcagcugcagacucgccaggccaguuccaucuaugaugacagcuaccuaggauacucuguggcuguuggugaauucaguggugaugacacagaagacuuuguugcuggugugcccaaagggaaccucacuuacggcuaugucaccauccuuaauggcucagacauucgaucccucuacaacuucucaggggaacagauggccuccuacuuuggcuaugcaguggccgccacagacgucaauggggacgggcuggaugacuugcuggugggggcaccccugcucauggaucggaccccugacgggcggccucaggaggugggcagggucuacgucuaccugcagcacccagccggcauagagcccacgcccacccuuacccucacuggccaugaugaguuuggccgauuuggcagcuccuugaccccccugggggaccuggaccaggauggcuacaaugauguggccaucggggcucccuuugguggggagacccagcagggaguaguguuuguauuuccugggggcccaggagggcugggcucuaagccuucccagguucugcagccccugugggcagccagccacaccccagacuucuuuggcucugcccuucgaggaggccgagaccuggauggcaauggauauccugaucugauugugggguccuuugguguggacaaggcugugguauacaggggccgccccaucguguccgcuagugccucccucaccaucuuccccgccauguucaacccagaggagcggagcugcagcuuagaggggaacccuguggccugcaucaaccuuagcuucugccucaaugcuucuggaaaacacguugcugacuccauugguuucacaguggaacuucagcuggacuggcagaagcagaagggagggguacggcgggcacuguuccuggccuccaggcaggcaacccugacccagacccugcucauccagaauggggcucgagaggauugcagagagaugaagaucuaccucaggaacgagucagaauuucgagacaaacucucgccgauucacaucgcucucaacuucuccuuggacccccaagccccaguggacagccacggccucaggccagcccuacauuaucagagcaagagccggauagaggacaaggcucagaucuugcuggacuguggagaagacaacaucugugugccugaccugcagcuggaaguguuuggggagcagaaccauguguaccugggugacaagaaugcccugaaccucacuuuccaugcccagaaugugggugaggguggcgccuaugaggcugagcuucgggucaccgccccuccagaggcugaguacucaggacucgucagacacccagggaacuucuccagccugagcugugacuacuuugccgugaaccagagccgccugcuggugugugaccugggcaaccccaugaaggcaggagccagucugugggguggccuucgguuuacagucccucaucuccgggacacuaagaaaaccauccaguuugacuuccagauccucagcaagaaucucaacaacucgcaaagcgacgugguuuccuuucggcucuccguggaggcucaggcccaggucacccugaacggugucuccaagccugaggcagugcuauucccaguaagcgacuggcauccccgagaccagccucagaaggaggaggaccugggaccugcuguccaccaugucuaugagcucaucaaccaaggccccagcuccauuagccagggugugcuggaacucagcuguccccaggcucuggaaggucagcagcuccuauaugugaccagaguuacgggacucaacugcaccaccaaucaccccauuaacccaaagggccuggaguuggaucccgaggguucccugcaccaccagcaaaaacgggaagcuccaagccgcagcucugcuuccucgggaccucagauccugaaaugcccggaggcugaguguuucaggcugcgcugugagcucgggccccugcaccaacaagagagccaaagucugcaguugcauuuccgagucugggccaagacuuucuugcagcgggagcaccagccauuuagccugcagugugaggcuguguacaaagcccugaagaugcccuaccgaauccugccucggcagcugccccaaaaagagcgucagguggccacagcugugcaauggaccaaggcagaaggcagcuauggcgucccacuguggaucaucauccuagccauccuguuuggccuccugcuccuaggucuacucaucuacauccucuacaagcuuggauucuucaaacgcucccucccauauggcaccgccauggaaaaagcucagcucaagccuccagccaccucugaugccuga

SEQ ID NO: 2017 - RNA, 3150 nt, Artificial Sequence
  derived and/or modified sequence opt1 from ITA5__Homo_sapiens__AAH08786
augggcagccgcacccccgaguccccgcugcacgccgugcagcuccggugggggccccgccggcgccccccccugcugccgcuccugcugcuccugcugcccccccccccgcgggucggcggguucaaccucgacgccgaggcgcccgccgugcugagcggcccccccggguccuucuucggcuucagcguggaguucuaccgcccgggcaccgacggggucuccgugcuggugggcgcccccaaggccaacacgagccagcccgggguccuccagggcggggccguguaccugugccccuggggcgcguccccgacccagugcacccccaucgaguucgacagcaagggcucccggcugcucgagagcucccugagcuccagcgagggggaggagcccguggaguacaagucccugcagugguucggcgccaccguccgcgcccacgggagcuccauccucgccugcgcgccccuguacagcuggcggacggagaaggagccgcuguccgaccccgugggcaccugcuaccucagcaccgacaacuucacccgcauccuggaguacgcccccugccggagcgacuucuccugggccgccggccagggguacugccagggcggguucagcgccgaguucacgaagaccggccgcgugguccuggggggccccggcuccuacuucuggcaggggcagauccucagcgcgacccaggagcagaucgccgaguccuacuacccggaguaccugaucaaccuggugcagggccagcuccagacccggcaggccagcuccaucuacgacgacagcuaccugggguacuccguggccgucggcgaguucagcggggacgacacggaggacuucguggccggcgugcccaagggcaaccugaccuacggguacgucaccauccucaacggcuccgacauccgcagccuguacaacuucuccggggagcagauggcgagcuacuucggcuacgccguggccgccaccgacgugaacggggacggccuggacgaccuccuggucggcgccccccugcucauggaccggacgcccgacgggcgcccgcaggaggugggccggguguacgucuaccugcagcaccccgcggggaucgagcccaccccgacccugacccucacgggccacgacgaguucggccgcuucggguccagccugaccccccugggcgaccucgaccaggacggguacaacgacguggccaucggcgcccccuucgggggcgagacccagcagggcgucguguucguguuccccgggggcccggggggccugggguccaagcccagccagguccugcagccccucugggccgccucccacacccccgacuucuucggcagcgcgcugcggggcgggcgcgaccuggacggcaacggguacccggaccucaucgugggcagcuucgggguggacaaggccgucguguaccggggccgccccaucguguccgccagcgccucccugacgaucuuccccgcgauguucaaccccgaggagcgcagcugcucccuggagggcaacccggucgccugcaucaaccugagcuucugccucaacgccuccgggaagcacguggccgacagcaucggcuucaccguggagcugcagcuggacuggcagaagcagaaggggggcguccggcgcgcccucuuccuggcgucccggcaggccacccugacccagacgcuccugauccagaacggggcccgcgaggacugccgggagaugaagaucuaccugcgcaacgagagcgaguuccgggacaagcucucccccauccacaucgcccugaacuucagccuggacccccaggcccccguggacucccacggccuccgcccggcgcugcacuaccagagcaagucccggaucgaggacaaggcccagauccugcucgacugcggcgaggacaacaucugcgugcccgaccugcagcuggaggucuucggggagcagaaccacguguaccucggcgacaagaacgcccugaaccugaccuuccacgcccagaacgugggggagggcggcgccuacgaggcggagcuccgcgucaccgccccccccgaggccgaguacagcgggcuggugcggcacccgggcaacuucuccagccugagcugcgacuacuucgccgugaaccagucccgccuccuggucugcgaccuggggaaccccaugaaggcgggcgccagccucugggggggccugcgguucaccgugccccaccugcgcgacacgaagaagaccauccaguucgacuuccagauccucuccaagaaccugaacaacagccaguccgacguggucagcuuccggcuguccguggaggcccaggcccaggugacccucaacggcgucagcaagcccgaggccgugcuguucccgguguccgacuggcacccccgcgaccagccccagaaggaggaggaccuggggccggcgguccaccacguguacgagcucaucaaccagggccccagcuccaucagccagggggugcuggagcuguccugcccccaggcccucgagggccagcagcugcuguacgucacccgggugacggggcucaacugcaccaccaaccaccccaucaacccgaagggccuggagcuggaccccgagggcagccuccaccaccagcagaagcgcgaggcccccucccggagcuccgccagcuccgggccccagauccugaagugcccggaggccgagugcuuccgccugcgcugcgagcucggcccccugcaccagcaggagagccagagccugcagcuccacuuccgggugugggcgaagaccuuccugcagcgcgagcaccagcccuucucccugcagugcgaggccgucuacaaggcccucaagaugcccuaccggauccugccgcgccagcugccccagaaggagcggcagguggccaccgccgugcaguggacgaaggcggaggggagcuacggcgucccccucuggaucaucauccuggccauccuguucgggcuccugcugcucggccugcugaucuacauccucuacaagcugggcuucuucaagcgcucccugcccuacgggaccgccauggagaaggcccagcucaagccgcccgcgaccagcgacgccuga

SEQ ID NO: 2018 - RNA, 3150 nt, Artificial Sequence
  derived and/or modified sequence opt2 from ITA5__Homo_sapiens__AAH08786
augggcucccgcacccccgaguccccccuccacgccguccagcuccgcuggggcccccgccgccgccccccccuccucccccuccuccuccuccuccuccccccccccccccgcgucggcggcuucaaccucgacgccgaggcccccgccguccucuccggcccccccggcuccuucuucggcuucuccgucgaguucuaccgccccggcaccgacggcgucuccguccucgucggcgcccccaaggccaacaccucccagcccggcguccuccagggcggcgccgucuaccucugccccuggggcgccucccccacccagugcacccccaucgaguucgacuccaagggcucccgccuccucgaguccucccucuccuccuccgagggcgaggagcccgucgaguacaagucccuccagugguucggcgccaccguccgcgcccacggcuccuccauccucgccugcgccccccucuacuccuggcgcaccgagaaggagccccucuccgaccccgucggcaccugcuaccucuccaccgacaacuucacccgcauccucgaguacgcccccugccgcuccgacuucuccugggccgccggccagggcuacugccagggcggcuucuccgccgaguucaccaagaccggccgcgucguccucggcggccccggcuccuacuucuggcagggccagauccucuccgccacccaggagcagaucgccgaguccuacuaccccgaguaccucaucaaccucguccagggccagcuccagacccgccaggccuccuccaucuacgacgacuccuaccucggcuacuccgucgccgucggcgaguucuccggcgacgacaccgaggacuucgucgccggcguccccaagggcaaccucaccuacggcuacgucaccauccucaacggcuccgacauccgcucccucuacaacuucuccggcgagcagauggccuccuacuucggcuacgccgucgccgccaccgacgucaacggcgacggccucgacgaccuccucgucggcgccccccuccucauggaccgcacccccgacggccgcccccaggaggucggccgcgucuacgucuaccuccagcaccccgccggcaucgagcccacccccacccucacccucaccggccacgacgaguucggccgcuucggcuccucccucaccccccucggcgaccucgaccaggacggcuacaacgacgucgccaucggcgcccccuucggcggcgagacccagcagggcgucgucuucgucuuccccggcggccccggcggccucggcuccaagcccucccagguccuccagccccucugggccgccucccacacccccgacuucuucggcuccgcccuccgcggcggccgcgaccucgacggcaacggcuaccccgaccucaucgucggcuccuucggcgucgacaaggccgucgucuaccgcggccgccccaucgucuccgccuccgccucccucaccaucuuccccgccauguucaaccccgaggagcgcuccugcucccucgagggcaaccccgucgccugcaucaaccucuccuucugccucaacgccuccggcaagcacgucgccgacuccaucggcuucaccgucgagcuccagcucgacuggcagaagcagaagggcggcguccgccgcgcccucuuccucgccucccgccaggccacccucacccagacccuccucauccagaacggcgcccgcgaggacugccgcgagaugaagaucuaccuccgcaacgaguccgaguuccgcgacaagcucucccccauccacaucgcccucaacuucucccucgacccccaggcccccgucgacucccacggccuccgccccgcccuccacuaccaguccaagucccgcaucgaggacaaggcccagauccuccucgacugcggcgaggacaacaucugcguccccgaccuccagcucgaggucuucggcgagcagaaccacgucuaccucggcgacaagaacgcccucaaccucaccuuccacgcccagaacgucggcgagggcggcgccuacgaggccgagcuccgcgucaccgccccccccgaggccgaguacuccggccucguccgccaccccggcaacuucuccucccucuccugcgacuacuucgccgucaaccagucccgccuccucgucugcgaccucggcaaccccaugaaggccggcgccucccucuggggcggccuccgcuucaccgucccccaccuccgcgacaccaagaagaccauccaguucgacuuccagauccucuccaagaaccucaacaacucccaguccgacgucgucuccuuccgccucuccgucgaggcccaggcccaggucacccucaacggcgucuccaagcccgaggccguccucuuccccgucuccgacuggcacccccgcgaccagccccagaaggaggaggaccucggccccgccguccaccacgucuacgagcucaucaaccagggccccuccuccaucucccagggcguccucgagcucuccugcccccaggcccucgagggccagcagcuccucuacgucacccgcgucaccggccucaacugcaccaccaaccaccccaucaaccccaagggccucgagcucgaccccgagggcucccuccaccaccagcagaagcgcgaggcccccucccgcuccuccgccuccuccggcccccagauccucaagugccccgaggccgagugcuuccgccuccgcugcgagcucggcccccuccaccagcaggagucccagucccuccagcuccacuuccgcgucugggccaagaccuuccuccagcgcgagcaccagcccuucucccuccagugcgaggccgucuacaaggcccucaagaugcccuaccgcauccucccccgccagcucccccagaaggagcgccaggucgccaccgccguccaguggaccaaggccgagggcuccuacggcgucccccucuggaucaucauccucgccauccucuucggccuccuccuccucggccuccucaucuacauccucuacaagcucggcuucuucaagcgcucccuccccuacggcaccgccauggagaaggcccagcucaagccccccgccaccuccgacgccuga

SEQ ID NO: 2019 - RNA, 3150 nt, Artificial Sequence
  derived and/or modified sequence opt3 from ITA5__Homo_sapiens__AAH08786
augggcagcagaacccccgaguccccucugcacgccgugcagcucaggugggggccacggcgccgaccgccccuucugccuuuguuacugcuacuccugccacccccuccacgugucggagguuucaaccuugacgcugaagcacccgccguucugucuggcccuccagggucauuuuucggauuuaguguggaguucuacagaccgggcacagaugguguaagcguguuggucggggcgcccaaggcuaauacuucccaaccuggagugcuccagggcggcgccguuuaucugugcccauggggagcaucucccacgcaguguaccccuaucgaauuugacucgaaagggucaaggcugcucgagagcaguuuauccucuagcgaaggugaggagccaguggaauacaagucccugcagugguucggcgccacaguccgggcucaugggucaaguauucuugcaugcgcccccuuguauagcuggcgcacugagaaagaaccgcugucugauccugugggaaccuguuaccuauccacagacaacuuuaccagaauacucgaguaugcucccugcaggucagauuucagcugggccgcgggccaagguuacugucaagggggauuuagugcagaguucacuaagacaggccggguaguucugggcgggccaggaucuuauuuuuggcagggucagauccuuuccgccacccaggaacagauugcugagagcuacuacccugaauaucugaucaauuuggugcagggccagcuccaaacgcgccaggccucgucuauuuacgacgauuccuaucugggguacucagucgcagugggagaguucaguggcgacgauacugaagacuuuguggcugguguccccaaagggaacuuaaccuauggcuacguuacaauccugaauggaagcgauauacgaucccucuauaacuucucuggcgagcagauggccagcuacuucggguacgcgguggccgcaacugacguaaauggagauggucuugacgaccuguuggugggcgcuccacuacugauggauagaacccccgacgggaggccucaagaggucggacggguguauguuuaccuccagcacccagccggcaucgaaccgacacccacccugacgcuuacuggucaugaugaguuugggcguuucggcucaagucugacaccuuugggagaccucgaucaggacggcuauaacgauguggcuauuggggccccauuuggaggugaaacccagcaaggcgucguguucguauuucccgggggaccuggcggucugggguccaagccaagccagguuuuacagccccugugggcagccucucacacuccggacuucuuuggcucagcucuacgcggaggcagagaucucgacgggaauggauacccugaucugaucgugggcaguuucggugucgacaaggcgguggucuauagggggcggccaauugugagcgcauccgccucucuuacaaucuuucccgcuauguucaacccugaggaacgaucgugcagcuuggagggaaaucccguugccuguauaaaccuguccuuuugccucaaugcaucaggcaaacauguggccgacaguauugguuucaccguagagcugcagcuugauuggcaaaagcagaaaggcgggguccgcagagcucuguuuuuggccucuaggcaggcaacgcucacccagacacuguuaauccaaaacggagcgcgggaagacugucgcgagaugaagauuuaccugagaaaugaaagcgaguucagggauaaacuauccccaauccacaucgcucucaacuucucacuggacccucaggcccccguggauagccacggccuucguccagcauugcauuaucagucuaagucccggauugaagacaaggcccagauacugcucgauugcggggaggacaacaucuguguuccggaucugcaauuagagguguuuggagaacagaaucacgucuaccugggcgacaaaaacgcucuuaauuugacuuuccaugcccagaacgugggugaagggggagcauacgaggcugagcuccgaguaaccgccccucccgaggcggaauauaguggccuggugagacacccagguaauuuuagcucucuauccugcgauuacuucgccguuaaccaaucaaggcugcucgucugcgaccugggcaaucccaugaaggcuggggcaagucuuuggggaggcuugcgcuuuacagugccucaucugcgggauacuaaaaagaccauucaguucgacuuucagaucuuaagcaaaaaccucaauaacucgcaguccgacguggucucuuucagacugagcguugaggcccaagcucaggugacacuuaauggggugucaaagccagaagccguacuguuucccgucagugauuggcacccuagggaccagccgcagaaagaggaagauuugggaccagcagugcaccauguuuaugagcucauaaaccaaggccccuccucuauuagccagggugugcuggagcuauccuguccucaggcgcuggaagggcagcaacuccuguacgucacccgcgugacuggacuuaauugcacgacaaaccacccaaucaaucccaagggcuuggagcuggacccugaagguucauuacaucaccagcagaagcgagaggccccgagccggaguucugcuuccagcggcccccaaauccucaaauguccagaagccgagugcuuccgucugagaugugagcuugggccucugcaccagcaggaaucgcagucacuacaacuccauuuuaggguuugggcaaagaccuuccugcagcgcgagcaccagcccuuuucuuugcagugcgaagcuguguauaaagcccugaagaugccauaccggauuuuaccuagacaacucccccagaaagagaggcagguagcaacugccguccaguggaccaaggcugaaggaaguuauggcgugccacuguggaucauuauacuugcgauccuguucggguugcuccugcuaggacugcuuauuuacauccucuacaagcugggcuucuuuaaacgauccuugccguaugguacagccauggagaaggcacaacugaaaccucccgcuaccagcgaugccuga

SEQ ID NO: 2020 - RNA, 3150 nt, Artificial Sequence
  derived and/or modified sequence opt4 from ITA5__Homo_sapiens__AAH08786
augggcagcagaacccccgagagcccccugcacgccgugcagcugagauggggccccagaagaagacccccccugcugccccugcugcugcugcugcugccccccccccccagagugggcggcuucaaccuggacgccgaggcccccgccgugcugagcggcccccccggcagcuucuucggcuucagcguggaguucuacagacccggcaccgacggcgugagcgugcuggugggcgcccccaaggccaacaccagccagcccggcgugcugcagggcggcgccguguaccugugccccuggggcgccagccccacccagugcacccccaucgaguucgacagcaagggcagcagacugcuggagagcagccugagcagcagcgagggcgaggagcccguggaguacaagagccugcagugguucggcgccaccgugagagcccacggcagcagcauccuggccugcgccccccuguacagcuggagaaccgagaaggagccccugagcgaccccgugggcaccugcuaccugagcaccgacaacuucaccagaauccuggaguacgcccccugcagaagcgacuucagcugggccgccggccagggcuacugccagggcggcuucagcgccgaguucaccaagaccggcagaguggugcugggcggccccggcagcuacuucuggcagggccagauccugagcgccacccaggagcagaucgccgagagcuacuaccccgaguaccugaucaaccuggugcagggccagcugcagaccagacaggccagcagcaucuacgacgacagcuaccugggcuacagcguggccgugggcgaguucagcggcgacgacaccgaggacuucguggccggcgugcccaagggcaaccugaccuacggcuacgugaccauccugaacggcagcgacaucagaagccuguacaacuucagcggcgagcagauggccagcuacuucggcuacgccguggccgccaccgacgugaacggcgacggccuggacgaccugcuggugggcgccccccugcugauggacagaacccccgacggcagaccccaggaggugggcagaguguacguguaccugcagcaccccgccggcaucgagcccacccccacccugacccugaccggccacgacgaguucggcagauucggcagcagccugaccccccugggcgaccuggaccaggacggcuacaacgacguggccaucggcgcccccuucggcggcgagacccagcagggcgugguguucguguuccccggcggccccggcggccugggcagcaagcccagccaggugcugcagccccugugggccgccagccacacccccgacuucuucggcagcgcccugagaggcggcagagaccuggacggcaacggcuaccccgaccugaucgugggcagcuucggcguggacaaggccgugguguacagaggcagacccaucgugagcgccagcgccagccugaccaucuuccccgccauguucaaccccgaggagagaagcugcagccuggagggcaaccccguggccugcaucaaccugagcuucugccugaacgccagcggcaagcacguggccgacagcaucggcuucaccguggagcugcagcuggacuggcagaagcagaagggcggcgugagaagagcccuguuccuggccagcagacaggccacccugacccagacccugcugauccagaacggcgccagagaggacugcagagagaugaagaucuaccugagaaacgagagcgaguucagagacaagcugagccccauccacaucgcccugaacuucagccuggacccccaggcccccguggacagccacggccugagacccgcccugcacuaccagagcaagagcagaaucgaggacaaggcccagauccugcuggacugcggcgaggacaacaucugcgugcccgaccugcagcuggagguguucggcgagcagaaccacguguaccugggcgacaagaacgcccugaaccugaccuuccacgcccagaacgugggcgagggcggcgccuacgaggccgagcugagagugaccgccccccccgaggccgaguacagcggccuggugagacaccccggcaacuucagcagccugagcugcgacuacuucgccgugaaccagagcagacugcuggugugcgaccugggcaaccccaugaaggccggcgccagccuguggggcggccugagauucaccgugccccaccugagagacaccaagaagaccauccaguucgacuuccagauccugagcaagaaccugaacaacagccagagcgacguggugagcuucagacugagcguggaggcccaggcccaggugacccugaacggcgugagcaagcccgaggccgugcuguuccccgugagcgacuggcaccccagagaccagccccagaaggaggaggaccugggccccgccgugcaccacguguacgagcugaucaaccagggccccagcagcaucagccagggcgugcuggagcugagcugcccccaggcccuggagggccagcagcugcuguacgugaccagagugaccggccugaacugcaccaccaaccaccccaucaaccccaagggccuggagcuggaccccgagggcagccugcaccaccagcagaagagagaggcccccagcagaagcagcgccagcagcggcccccagauccugaagugccccgaggccgagugcuucagacugagaugcgagcugggcccccugcaccagcaggagagccagagccugcagcugcacuucagagugugggccaagaccuuccugcagagagagcaccagcccuucagccugcagugcgaggccguguacaaggcccugaagaugcccuacagaauccugcccagacagcugccccagaaggagagacagguggccaccgccgugcaguggaccaaggccgagggcagcuacggcgugccccuguggaucaucauccuggccauccuguucggccugcugcugcugggccugcugaucuacauccuguacaagcugggcuucuucaagagaagccugcccuacggcaccgccauggagaaggcccagcugaagccccccgccaccagcgacgccuga

SEQ ID NO: 2021 - RNA, 3150 nt, Artificial Sequence
  derived and/or modified sequence opt5 from ITA5__Homo_sapiens__AAH08786
augggcagcagaacccccgagucuccccugcacgccgugcagcuccggugggggccgcgcagacggcccccucugcuuccccugcuccugcuucugcucccucccccuccgcgcgucggaggcuucaaccuggacgcugaagcccccgcgguucuguccgggccucccggcagcuuuuucggcuuuuccguggaguucuacagaccugggacagauggagugucuguccucgugggcgcucccaaggccaauacgagccaaccgggcguucugcaagggggagccguguaucuuugcccuuggggcgcuucccccacccaguguacaccuaucgaauuugacucuaaagggagccggcugcucgaguccagccugucuuccagcgaaggagaggagcccgucgaauacaagucucuucagugguucggcgccaccgugcgcgcucauggguccagcauucuggccugcgcgccccucuauucuuggagaacagagaaagaaccucuguccgauccgguuggaaccuguuaccugagcacagacaacuuuacccggauccucgaguaugcccccugccgcuccgauuucucuugggcugccggccagggcuacugucaagggggauuuagcgcugaguucacgaagaccggcagagugguccuugggggaccuggcuccuauuuuuggcaggggcagauucugagcgccacacaggaacagaucgcggagucuuacuaccccgaauaucugauuaaucucgugcagggacagcugcaaacccggcaggccuccagcaucuacgacgauucuuaucuuggcuacagcguggcugucggcgaguucuccggggacgauacagaagacuuuguugccggagugccuaaaggcaaccugaccuauggguacgugacgauccucaauggaucugauauucgcagccuguauaacuucuccggcgagcagauggcuagcuacuucggguacgccgucgccgcuacagacgugaauggcgauggacuggacgaccuccugguuggcgcgccccuucugauggauagaaccccggacgggcggccucaagaggugggacgcgucuauguguaccuccagcaccccgccggcaucgaaccuacacccacccugacccuuacagggcaugaugaguuuggaagauucggaucuucccugacgccucucggggaccuggaucaggacggcuauaacgauguugcuauuggagcccccuuuggcggggaaacccagcaaggaguggucuucguguuuccgggcgggccuggaggccuggggagcaagcccucucagguccuccagccccugugggccgcuucccacacaccugacuucuuuggcagcgcccuucggggaggcagagaucuggacgggaauggauacccggaucucaucgugggcuccuucgggguugacaaggcgguggucuaucgcggacggcccauugugucugcuagcgccucccugaccaucuuuccugccauguucaaccccgaggaaagaucuugcagccuggagggcaauccuguugcuuguauuaaccuuuccuuuugccucaaugccagcgggaaacauguggcugacucuaucggcuucacagucgagcugcagcuggauuggcaaaagcagaaaggaggcgugcgccgggcccucuuucuggcguccagacaggccacccuuacgcagacacugcucauccaaaacggggcucgcgaagacugucgggagaugaagauuuaccugagaaaugaaagcgaguuccgcgauaaacugucucccauccacauugcccuuaacuucucccucgacccucaggcucccguggauagccacggacugcggccggcccugcauuaucagucuaagagcagaaucgaagacaaggcgcagauucuccuggauugcggcgaggacaacaucuguguuccugaucuucaacuggaggucuuuggggaacagaaucacguguaccucggagacaaaaacgcccugaaucugaccuuccaugcucagaacgugggcgagggcggggccuacgaagcugagcuucgcgucaccgcucccccugaggccgaauauuccggacucgugcggcaccccggcaauuuuagcucucuguccugcgauuacuucgccguuaaccaaagcagacugcucgugugcgaccuggggaauccgaugaaggcgggagccucccuuuggggcgggcugcgguuuacagucccucaccuccgcgauaccaaaaagacaauccaguucgacuuucagauucugucuaaaaaccugaauaacagccaguccgacgugguuucuuucagacuuagcguggaggcucaagcccaggucacgcucaauggaguguccaagcccgaagccguucuguuuccugugucugauuggcauccccgggaccagccccagaaagaggaagaucugggcccugcuguccaccauguguaugagcucaucaaccaaggcccgagcuccauuagccagggggugcuggagcuuucuuguccccaggcccuggaaggacagcaacuccuguacgucaccagaguuacaggccugaauugcaccacaaaccacccuaucaaucccaaggggcuugagcuggacccugaaggaucccuccaucaccagcagaagcgcgaggcgcccagccggucuuccgcuagcucuggcccucaaauucugaaauguccggaagccgagugcuucagacuccgcugugagcuggggccccuucaccagcaggaaucccagagccugcaacuccauuuuagagugugggccaagaccuuccugcagcgggagcaccagccuuuuucccugcagugcgaagcuguguauaaagcccuuaagaugcccuaccgcauccugccuagacaacucccccagaaagagcggcaggucgcgacggcugugcaguggaccaaggccgaaggaagcuauggcguuccgcuguggaucauuauccucgccauucuguucggccuucugcuccuggggcugcuuaucuacauucuguacaagcucggauucuuuaaacgcucucugccuuauggcacagcuauggagaaggcccaacucaaaccucccgcuaccagcgaugccuga

SEQ ID NO: 2022 - protein, 798 aa, Artificial Sequence
  ITB1__Homo_sapiens__P05556
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 2023 - RNA, 2397 nt, Artificial Sequence
  ITB1__Homo_sapiens__AAH20057
augaauuuacaaccaauuuucuggauuggacugaucaguucaguuugcuguguguuugcucaaacagaugaaaauagauguuuaaaagcaaaugccaaaucauguggagaauguauacaagcagggccaaauuguggguggugcacaaauucaacauuuuuacaggaaggaaugccuacuucugcacgaugugaugauuuagaagccuuaaaaaagaaggguugcccuccagaugacauagaaaaucccagaggcuccaaagauauaaagaaaaauaaaaauguaaccaaccguagcaaaggaacagcagagaagcucaagccagaggauauuacucagauccaaccacagcaguugguuuugcgauuaagaucaggggagccacagacauuuacauuaaaauucaagagagcugaagacuaucccauugaccucuacuaccuuauggaccugucuuacucaaugaaagacgauuuggagaauguaaaaagucuuggaacagaucugaugaaugaaaugaggaggauuacuucggacuucagaauuggauuuggcucauuuguggaaaagacugugaugccuuacauuagcacaacaccagcuaagcucaggaacccuugcacaagugaacagaacugcaccagcccauuuagcuacaaaaaugugcucagucuuacuaauaaaggagaaguauuuaaugaacuuguuggaaaacagcgcauaucuggaaauuuggauucuccagaaggugguuucgaugccaucaugcaaguugcaguuuguggaucacugauuggcuggaggaauguuacacggcugcugguguuuuccacagaugccggguuucacuuugcuggagaugggaaacuugguggcauuguuuuaccaaaugauggacaaugucaccuggaaaauaauauguacacaaugagccauuauuaugauuauccuucuauugcucaccuuguccagaaacugagugaaaauaauauucagacaauuuuugcaguuacugaagaauuucagccuguuuacaaggagcugaaaaacuugaucccuaagucagcaguaggaacauuaucugcaaauucuagcaauguaauucaguugaucauugaugcauacaauucccuuuccucagaagucauuuuggaaaacggcaaauugucagaaggaguaacaauaaguuacaaaucuuacugcaagaacggggugaauggaacaggggaaaauggaagaaaauguuccaauauuuccauuggagaugagguucaauuugaaauuagcauaacuucaaauaaguguccaaaaaaggauucugacagcuuuaaaauuaggccucugggcuuuacggaggaaguagagguuauucuucaguacaucugugaaugugaaugccaaagcgaaggcaucccugaaagucccaagugucaugaaggaaaugggacauuugaguguggcgcgugcaggugcaaugaagggcguguugguagacauugugaaugcagcacagaugaaguuaacagugaagacauggaugcuuacugcaggaaagaaaacaguucagaaaucugcaguaacaauggagagugcgucugcggacaguguguuuguaggaagagggauaauacaaaugaaauuuauucuggcaaauucugcgagugugauaauuucaacugugauagauccaauggcuuaauuuguggaggaaaugguguuugcaagugucgugugugugagugcaaccccaacuacacuggcagugcaugugacuguucuuuggauacuaguacuugugaagccagcaacggacagaucugcaauggccggggcaucugugaguguggugucuguaaguguacagauccgaaguuucaagggcaaacgugugagaugugucagaccugccuuggugucugugcugagcauaaagaauguguucagugcagagccuucaauaaaggagaaaagaaagacacaugcacacaggaauguuccuauuuuaacauuaccaagguagaaagucgggacaaauuaccccagccgguccaaccugauccugugucccauuguaaggagaaggauguugacgacuguugguucuauuuuacguauucagugaaugggaacaacgaggucaugguucauguuguggagaauccagagugucccacugguccagacaucauuccaauuguagcuggugugguugcuggaauuguucuuauuggccuugcauuacugcugauauggaagcuuuuaaugauaauucaugacagaagggaguuugcuaaauuugaaaaggagaaaaugaaugccaaaugggacacgggugaaaauccuauuuauaagagugccguaacaacuguggucaauccgaaguaugagggaaaauga

SEQ ID NO: 2024 - RNA, 2397 nt, Artificial Sequence
  derived and/or modified sequence opt1 from ITB1__Homo_sapiens__AAH20057
augaaccugcagcccaucuucuggaucggccucaucagcuccgugugcugcgucuucgcccagaccgacgagaaccgcugccugaaggccaacgccaagagcugcggggagugcauccaggcgggcccgaacugcggguggugcaccaacuccacguuccugcaggagggcaugcccaccagcgcccggugcgacgaccucgaggcccugaagaagaaggggugcccgcccgacgacaucgagaacccccgcggcuccaaggacaucaagaagaacaagaacgugaccaaccggagcaagggcaccgccgagaagcugaagcccgaggacaucacgcagauccagccccagcagcucgugcugcgccugcgguccggggagccccagaccuucacccucaaguucaagcgcgcggaggacuacccgaucgaccuguacuaccugauggaccucagcuacuccaugaaggacgaccuggagaacgucaagagccugggcaccgaccucaugaacgagaugcggcgcaucacguccgacuuccggaucggguucggcagcuucguggagaagaccgugaugcccuacaucuccaccacccccgccaagcugcgcaaccccugcacgagcgagcagaacugcaccuccccguucagcuacaagaacguccugucccucaccaacaagggggagguguucaacgagcuggugggcaagcagcggaucagcggcaaccuggacucccccgagggcggguucgacgccaucaugcaggucgccgugugcgggagccucaucggcuggcgcaacgugacccggcugcuggucuucagcacggacgcgggcuuccacuucgccggggacggcaagcucgggggcaucgugcugcccaacgacgggcagugccaccuggagaacaacauguacaccaugucccacuacuacgacuaccccagcaucgcccaccucgugcagaagcuguccgagaacaacauccagaccaucuucgccgucaccgaggaguuccagccgguguacaaggagcugaagaaccucauccccaagagcgccgugggcacgcuguccgcgaacagcuccaacgucauccagcugaucaucgacgccuacaacagccucuccagcgaggugauccuggagaacggcaagcuguccgagggggugaccaucagcuacaaguccuacugcaagaacggcgucaacgggaccggcgagaacgggcgcaagugcagcaacaucuccaucggcgacgaggugcaguucgagaucagcaucaccuccaacaagugccccaagaaggacagcgacuccuucaagauccggccccucggcuucacggaggagguggaggucauccugcaguacaucugcgagugcgagugccagagcgaggggaucccggagagccccaagugccacgagggcaacgggaccuucgagugcggcgccugccgcugcaacgaggggcgggugggccgccacugcgagugcuccaccgacgaggucaacagcgaggacauggacgccuacugccggaaggagaacuccagcgagaucugcuccaacaacggcgagugcgugugcgggcagugcgugugccgcaagcgggacaacaccaacgagaucuacagcggcaaguucugcgagugcgacaacuucaacugcgaccgcuccaacgggcugaucugcggcggcaacggggucugcaagugccgcgugugcgagugcaaccccaacuacacgggcagcgccugcgacugcucccucgacaccagcacgugcgaggcguccaacgggcagaucugcaacggccgggggaucugcgagugcggcgugugcaagugcaccgaccccaaguuccagggccagaccugcgagaugugccagaccugccugggggucugcgccgagcacaaggagugcgugcagugccgcgccuucaacaagggcgagaagaaggacacgugcacccaggagugcagcuacuucaacaucaccaagguggagucccgggacaagcugccgcagcccguccagcccgaccccgugagccacugcaaggagaaggacguggacgacugcugguucuacuucaccuacuccgucaacgggaacaacgaggugauggugcacgucguggagaacccggagugccccaccggccccgacaucaucccgaucguggccggggucguggccggcaucgugcucaucggccuggcgcugcuccugaucuggaagcugcucaugaucauccacgaccgccgggaguucgccaaguucgagaaggagaagaugaacgccaagugggacaccggggagaaccccaucuacaagagcgccgucaccacgguggugaaccccaaguacgagggcaaguga

SEQ ID NO: 2025 - RNA, 2397 nt, Artificial Sequence
  derived and/or modified sequence opt2 from ITB1__Homo_sapiens__AAH20057
augaaccuccagcccaucuucuggaucggccucaucuccuccgucugcugcgucuucgcccagaccgacgagaaccgcugccucaaggccaacgccaaguccugcggcgagugcauccaggccggccccaacugcggcuggugcaccaacuccaccuuccuccaggagggcaugcccaccuccgcccgcugcgacgaccucgaggcccucaagaagaagggcugcccccccgacgacaucgagaacccccgcggcuccaaggacaucaagaagaacaagaacgucaccaaccgcuccaagggcaccgccgagaagcucaagcccgaggacaucacccagauccagccccagcagcucguccuccgccuccgcuccggcgagccccagaccuucacccucaaguucaagcgcgccgaggacuaccccaucgaccucuacuaccucauggaccucuccuacuccaugaaggacgaccucgagaacgucaagucccucggcaccgaccucaugaacgagaugcgccgcaucaccuccgacuuccgcaucggcuucggcuccuucgucgagaagaccgucaugcccuacaucuccaccacccccgccaagcuccgcaaccccugcaccuccgagcagaacugcaccucccccuucuccuacaagaacguccucucccucaccaacaagggcgaggucuucaacgagcucgucggcaagcagcgcaucuccggcaaccucgacucccccgagggcggcuucgacgccaucaugcaggucgccgucugcggcucccucaucggcuggcgcaacgucacccgccuccucgucuucuccaccgacgccggcuuccacuucgccggcgacggcaagcucggcggcaucguccuccccaacgacggccagugccaccucgagaacaacauguacaccaugucccacuacuacgacuaccccuccaucgcccaccucguccagaagcucuccgagaacaacauccagaccaucuucgccgucaccgaggaguuccagcccgucuacaaggagcucaagaaccucauccccaaguccgccgucggcacccucuccgccaacuccuccaacgucauccagcucaucaucgacgccuacaacucccucuccuccgaggucauccucgagaacggcaagcucuccgagggcgucaccaucuccuacaaguccuacugcaagaacggcgucaacggcaccggcgagaacggccgcaagugcuccaacaucuccaucggcgacgagguccaguucgagaucuccaucaccuccaacaagugccccaagaaggacuccgacuccuucaagauccgcccccucggcuucaccgaggaggucgaggucauccuccaguacaucugcgagugcgagugccaguccgagggcauccccgagucccccaagugccacgagggcaacggcaccuucgagugcggcgccugccgcugcaacgagggccgcgucggccgccacugcgagugcuccaccgacgaggucaacuccgaggacauggacgccuacugccgcaaggagaacuccuccgagaucugcuccaacaacggcgagugcgucugcggccagugcgucugccgcaagcgcgacaacaccaacgagaucuacuccggcaaguucugcgagugcgacaacuucaacugcgaccgcuccaacggccucaucugcggcggcaacggcgucugcaagugccgcgucugcgagugcaaccccaacuacaccggcuccgccugcgacugcucccucgacaccuccaccugcgaggccuccaacggccagaucugcaacggccgcggcaucugcgagugcggcgucugcaagugcaccgaccccaaguuccagggccagaccugcgagaugugccagaccugccucggcgucugcgccgagcacaaggagugcguccagugccgcgccuucaacaagggcgagaagaaggacaccugcacccaggagugcuccuacuucaacaucaccaaggucgagucccgcgacaagcucccccagcccguccagcccgaccccgucucccacugcaaggagaaggacgucgacgacugcugguucuacuucaccuacuccgucaacggcaacaacgaggucaugguccacgucgucgagaaccccgagugccccaccggccccgacaucauccccaucgucgccggcgucgucgccggcaucguccucaucggccucgcccuccuccucaucuggaagcuccucaugaucauccacgaccgccgcgaguucgccaaguucgagaaggagaagaugaacgccaagugggacaccggcgagaaccccaucuacaaguccgccgucaccaccgucgucaaccccaaguacgagggcaaguga

SEQ ID NO: 2026 - RNA, 2397 nt, Artificial Sequence
  derived and/or modified sequence opt3 from ITB1__Homo_sapiens__AAH20057
augaaccugcagcccaucuucuggauuggccucauaagcuccgugugcugugucuuugcccaaaccgacgagaauagaugccuuaaggcuaacgcaaaaucuuguggggaaugcauccaggccggaccuaauugugguuggugcacaaacucaacuuuccugcaggagggcaugccaacgagugcgaggugugaugacuuggaggcuuuaaagaaaaaggggugcccgcccgaugacauugaaaauccucggggaagcaaagauaucaagaagaacaaaaauguuaccaaccgcuccaagggcacagccgaaaaacugaagccagaggacauuacucagauccaaccccagcagcuagugcuccgacugcguucuggugagccucagaccuuuacacuuaaauucaagagagcagaagauuacccaauagaccuguauuacuugauggaucucucguauucaaugaaggacgaucuggagaauguaaaaagccuggggaccgaccucaugaacgaaaugaggcggaucacaagugauuuucgcauuggauucggcuccuuuguggagaagacugucaugcccuacaucucuaccacgccugccaaauuaagaaauccauguacuagcgagcaaaacugcaccuccccguucucauauaagaaugugcugagucuuacaaacaaaggcgaaguuuuuaaugaguugguggggaagcagaggauuagcggaaaccuggacucucccgaagguggcuucgacgcuaucaugcaggucgcagugugugggucccuaauaggauggcggaacguaacucgccuccugguuuuuagcaccgaugccggcuuccacuuugcuggugacgggaaacuuggaggcauugugcugccuaaugauggccagugccauuuggagaacaauauguacacaaugagccacuauuacgacuacccaaguaucgcccaucucguccaaaagcugucugaaaacaauauucagaccaucuucgcggugacggaggaguuccagcccguguauaaggaacugaaaaacuuaaucccuaaguccgcagucgggacucucagcgccaauucgucuaacguuauucaacuuauaaucgaugcuuacaauucccugucaagugaggugauuuuggaaaacggaaaacuaagcgaggguguaacaaucuccuauaagucuuacugcaaaaauggcgugaacgggaccggagaaaauggccgaaaguguagcaacauaucaauuggugacgagguccaguuugagaucaguaucacuuccaauaagugccccaaaaaggauagcgacucuuucaaaauuagaccacugggguuuacagaagagguggaaguuauccuccaguauauuugugagugcgaaugucagucagagggcauaccggagaguccuaagugccacgaaggaaacggcaccuucgaguguggggccuguaggugcaacgaaggacgggugggucgucauugcgaguguagcacggaugaggucaauuccgaagacauggaugcauacugccgcaaagagaacucuucggaaaucugcagcaauaacggcgagugugugugcgggcaauguguaugcagaaagagggacaauaccaacgaaauuuauuccggaaaguuuugugagugcgacaauuucaacugugaucggucaaauggccugaucugcggugggaacggcguuuguaaaugccgagugugugagugcaaucccaacuacacaggaagugcuugcgacuguucucuugauacuucaaccugcgaagccuccaauggccagaucuguaacgggcgcggaauuugcgaguguggugucugcaaguguacagacccaaaauuucagggccagacuugcgaaaugugucaaaccugccugggggugugugcggagcacaaggaaugcguccagugcagagccuucaauaaaggagagaagaaggauacauguacccaggagugcucauacuuuaacauaacuaaaguggaaagcagggacaaguugccucagcccguucaaccagaucccgugucucacuguaaagagaaggacguagaugacugcugguucuauuuuacguacuccgucaacggcaauaacgaagugaugguucauguggucgagaauccugaauguccaacagguccggauaucauucccaucguggcagggguaguggcuggcauuguucucaucggacuggccuuacugcuaauauggaaacuccugaugaucauucacgaccggcgcgaguucgcuaaguuugagaaagaaaagaugaacgccaagugggauaccggcgagaauccuaucuauaaaagugcagucacuaccguggugaacccaaaguacgaagggaaauga

SEQ ID NO: 2027 - RNA, 2397 nt, Artificial Sequence
  derived and/or modified sequence opt4 from ITB1__Homo_sapiens__AAH20057
augaaccugcagcccaucuucuggaucggccugaucagcagcgugugcugcguguucgcccagaccgacgagaacagaugccugaaggccaacgccaagagcugcggcgagugcauccaggccggccccaacugcggcuggugcaccaacagcaccuuccugcaggagggcaugcccaccagcgccagaugcgacgaccuggaggcccugaagaagaagggcugcccccccgacgacaucgagaaccccagaggcagcaaggacaucaagaagaacaagaacgugaccaacagaagcaagggcaccgccgagaagcugaagcccgaggacaucacccagauccagccccagcagcuggugcugagacugagaagcggcgagccccagaccuucacccugaaguucaagagagccgaggacuaccccaucgaccuguacuaccugauggaccugagcuacagcaugaaggacgaccuggagaacgugaagagccugggcaccgaccugaugaacgagaugagaagaaucaccagcgacuucagaaucggcuucggcagcuucguggagaagaccgugaugcccuacaucagcaccacccccgccaagcugagaaaccccugcaccagcgagcagaacugcaccagccccuucagcuacaagaacgugcugagccugaccaacaagggcgagguguucaacgagcuggugggcaagcagagaaucagcggcaaccuggacagccccgagggcggcuucgacgccaucaugcagguggccgugugcggcagccugaucggcuggagaaacgugaccagacugcugguguucagcaccgacgccggcuuccacuucgccggcgacggcaagcugggcggcaucgugcugcccaacgacggccagugccaccuggagaacaacauguacaccaugagccacuacuacgacuaccccagcaucgcccaccuggugcagaagcugagcgagaacaacauccagaccaucuucgccgugaccgaggaguuccagcccguguacaaggagcugaagaaccugauccccaagagcgccgugggcacccugagcgccaacagcagcaacgugauccagcugaucaucgacgccuacaacagccugagcagcgaggugauccuggagaacggcaagcugagcgagggcgugaccaucagcuacaagagcuacugcaagaacggcgugaacggcaccggcgagaacggcagaaagugcagcaacaucagcaucggcgacgaggugcaguucgagaucagcaucaccagcaacaagugccccaagaaggacagcgacagcuucaagaucagaccccugggcuucaccgaggagguggaggugauccugcaguacaucugcgagugcgagugccagagcgagggcauccccgagagccccaagugccacgagggcaacggcaccuucgagugcggcgccugcagaugcaacgagggcagagugggcagacacugcgagugcagcaccgacgaggugaacagcgaggacauggacgccuacugcagaaaggagaacagcagcgagaucugcagcaacaacggcgagugcgugugcggccagugcgugugcagaaagagagacaacaccaacgagaucuacagcggcaaguucugcgagugcgacaacuucaacugcgacagaagcaacggccugaucugcggcggcaacggcgugugcaagugcagagugugcgagugcaaccccaacuacaccggcagcgccugcgacugcagccuggacaccagcaccugcgaggccagcaacggccagaucugcaacggcagaggcaucugcgagugcggcgugugcaagugcaccgaccccaaguuccagggccagaccugcgagaugugccagaccugccugggcgugugcgccgagcacaaggagugcgugcagugcagagccuucaacaagggcgagaagaaggacaccugcacccaggagugcagcuacuucaacaucaccaagguggagagcagagacaagcugccccagcccgugcagcccgaccccgugagccacugcaaggagaaggacguggacgacugcugguucuacuucaccuacagcgugaacggcaacaacgaggugauggugcacgugguggagaaccccgagugccccaccggccccgacaucauccccaucguggccggcgugguggccggcaucgugcugaucggccuggcccugcugcugaucuggaagcugcugaugaucauccacgacagaagagaguucgccaaguucgagaaggagaagaugaacgccaagugggacaccggcgagaaccccaucuacaagagcgccgugaccaccguggugaaccccaaguacgagggcaaguga

SEQ ID NO: 2028 - RNA, 2397 nt, Artificial Sequence
  derived and/or modified sequence opt5 from ITB1__Homo_sapiens__AAH20057
augaaccugcagcccaucuucuggauuggccucaucagcuccgugugcugugucuuugcccaaaccgacgagaauagaugccugaaggcuaacgccaaaucuuguggggaaugcauucaggcgggaccuaauuguggcuggugcacaaacagcacguuccuucaggaggggaugccgaccuccgcucggugugaugaccuggaagcccucaagaaaaagggaugucccccugaugacaucgagaauccccgcggcucuaaagauauuaagaagaacaaaaauguuacaaacagaagcaaggggaccgccgaaaaacugaagccugaggacaucacacagauccaaccccagcagcuugugcugcggcuccgcuccggagagccucagaccuuuacacugaaauucaagagagcugaagauuacccgauugaccuguauuaccucauggaucugucuuauagcaugaaggacgaucuugagaaugugaaaucccugggcaccgaccucaugaacgaaaugcggcgcaucacgagcgauuuuagaauuggcuucgggucuuuugucgagaagaccgugaugcccuacaucuccacaaccccugccaaacugcggaaucccugcacaagcgagcaaaacugcaccucuccuuucuccuauaagaauguucuuagccugacgaacaaaggagaaguguuuaaugagcucgucggcaagcagcgcauuucugggaaccuggacucccccgaaggaggcuucgacgcuaucaugcaaguggccguuugugggagccugauuggauggagaaacgugacacggcuccuggucuuuuccaccgaugcgggcuuccacuuugccggcgacgggaaacuuggaggcaucgugcugccgaaugaugggcagugccaucucgagaacaauauguacacaaugucucacuauuacgacuacccuagcaucgcucaucuggugcagaaacuuuccgaaaacaauauucagaccaucuucgccgucaccgaggaguuccagcccguuuauaaggaacugaagaaccucauuccuaagagcgcugugggaacacugucugccaauuccagcaacgugauccaacugauuaucgaugcguacaauucucucagcuccgaggucauccuggaaaacggcaaacuuucugagggggugacgauuagcuauaaguccuacugcaaaaauggaguuaacggcaccggcgaaaaugggcgcaaguguagcaacaucucuauuggagacgaggugcaguuugagaucuccauuacaagcaauaagugccccaaaaaggauucugacuccuucaaaaucagaccccugggcuuuaccgaagaggucgaagugauccuccaguauauuugugagugcgaaugucagagcgaggggaucccugaguccccgaagugccacgaaggaaacggcacauucgaguguggggccugccgguguaacgaaggccgcguuggaagacauugcgaguguucuaccgaugaggugaauagcgaagacauggaugcuuacugccggaaagagaacuccucugaaauuugcagcaauaacggcgagugugucugcgggcaaugugugugcagaaagcgcgacaauacgaacgaaaucuauuccggaaaguuuugugagugcgacaauuucaacugugaucggagcaauggccugauuugcgggggaaacggcgucuguaaaugcagagugugugagugcaaucccaacuacacagggucugccugcgacuguucccuugauaccucuaccugcgaagcuagcaauggccagaucuguaacggacgcggcauuugcgagugugggguuugcaaguguacagacccuaaauuucagggacagaccugcgaaaugugucaaacaugccugggcgugugugccgagcacaaggaaugcguccagugccgggccuucaauaaaggggagaagaaggauacguguacccaggagugcuccuacuuuaacaucacaaaaguggaaagcagagacaagcucccccagccuguucaacccgauccggugucucacuguaaagagaaggacgucgaugacugcugguucuauuuuaccuacagcgugaacggaaauaacgaagugaugguucaugucguggagaauccugaaugucccacaggcccugauaucauucccaucguggcuggggucguggcgggcauuguucugaucggacuggcccuccugcuuauuuggaaacugcucaugaucauccacgaccgccgggaguucgcuaaguuugagaaagaaaagaugaacgccaagugggauaccggcgagaauccuauuuauaaauccgccgugacgaccgucgugaaccccaaguacgaagggaaauga

SEQ ID NO: 2029 - protein, 788 aa, Artificial Sequence
  ITB6__Homo_sapiens__P18564
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 2030 - RNA, 2367 nt, Artificial Sequence
  ITB6__Homo_sapiens__AAA36122
auggggauugaacugcuuugccuguucuuucuauuucuaggaaggaaugaucacguacaagguggcugugcccugggaggugcagaaaccugugaagacugccugcuuauuggaccucagugugccuggugugcucaggagaauuuuacucauccaucuggaguuggcgaaaggugugauaccccagcaaaccuuuuagcuaaaggaugucaauuaaacuucaucgaaaacccugucucccaaguagaaauacuuaaaaauaagccucucaguguaggcagacagaaaaauaguucugacauuguucagauugcgccucaaagcuugauccuuaaguugagaccagguggugcgcagacucugcaggugcauguccgccagacugaggacuacccgguggauuuguauuaccucauggaccucuccgccuccauggaugacgaccucaacacaauaaaggagcugggcucccggcuuuccaaagagaugucuaaauuaaccagcaacuuuagacugggcuucggaucuuuuguggaaaaaccuguauccccuuucgugaaaacaacaccagaagaaauugccaacccuugcaguaguauuccauacuucuguuuaccuacauuuggauucaagcacauuuugccauugacaaaugaugcugaaagauucaaugaaauugugaagaaucagaaaauuucugcuaauauugacacacccgaagguggauuugaugcaauuaugcaagcugcuguguguaaggaaaaaauuggcuggcggaaugacucccuccaccuccuggucuuugugagugaugcugauucucauuuuggaauggacagcaaacuagcaggcaucgucauuccuaaugacgggcucugucacuuggacagcaagaaugaauacuccaugucaacugucuuggaauauccaacaauuggacaacucauugauaaacugguacaaaacaacguguuauugaucuucgcuguaacccaagaacaaguucauuuauaugagaauuacgcaaaacuuauuccuggagcuacaguaggucuacuucagaaggacuccggaaacauucuccagcugaucaucucagcuuaugaagaacugcggucugagguggaacuggaaguauuaggagacacugaaggacucaacuugucauuuacagccaucuguaacaacgguacccucuuccaacaccaaaagaaaugcucucacaugaaagugggagacacagcuuccuucagcgugacugugaauaucccacacugcgagagaagaagcaggcacauuaucauaaagccuguggggcugggggaugcccuggaauuacuugucagcccagaaugcaacugcgacugucagaaagaaguggaagugaacagcuccaaaugucaccacgggaacggcucuuuccaguguggggugugugccugccacccuggccacauggggccucgcugugaguguggcgaggacaugcugagcacagauuccugcaaggaggccccagaucaucccuccugcagcggaaggggugacugcuacugugggcaguguaucugccacuugucucccuauggaaacauuuaugggccuuauugccagugugacaauuucuccugcgugagacacaaagggcugcucugcggagguaacggcgacugugacuguggugaaugugugugcaggagcggcuggacuggcgaguacugcaacugcaccaccagcacggacuccugcgucucugaagauggagugcucugcagcgggcgcggggacuguguuuguggcaaguguguuugcacaaacccuggagccucaggaccaaccugugaacgauguccuaccuguggugaccccuguaacucuaaacggagcugcauugagugccaccugucagcagcuggccaagcccgagaagaauguguggacaagugcaaacuagcuggugcgaccaucagugaagaagaagauuucucaaaggaugguucuguuuccugcucucugcaaggagaaaaugaaugucuuauuacauuccuaauaacuacagauaaugaggggaaaaccaucauucacagcaucaaugaaaaagauuguccgaagccuccaaacauucccaugaucauguuagggguuucccuggcuauucuucucaucgggguuguccuacugugcaucuggaagcuacuggugucauuucaugaucguaaagaaguugccaaauuugaagcagaacgaucaaaagccaaguggcaaacgggaaccaauccacucuacagaggauccacaaguacuuuuaaaaauguaacuuauaaacacagggaaaaacaaaagguagaccuuuccacagauugcuag

SEQ ID NO: 2031 - RNA, 2367 nt, Artificial Sequence
  derived and/or modified sequence opt1 from ITB6__Homo_sapiens__AAA36122
augggcaucgagcugcucugccuguucuuccuguuccucgggcgcaacgaccacgugcagggcgggugcgcccugggcggggccgagaccugcgaggacugccugcucaucggcccccagugcgcguggugcgcccaggagaacuucacccacccgagcggcgucggggagcggugcgacacgcccgccaaccugcuggccaagggcugccagcucaacuucaucgagaaccccgugucccagguggagauccugaagaacaagccccugagcgucgggcgccagaagaacuccagcgacaucgugcagaucgccccgcagucccucauccugaagcugcggcccggcggggcgcagacccuccaggugcacguccgccagaccgaggacuaccccguggaccuguacuaccugauggaccucagcgccuccauggacgacgaccugaacaccaucaaggagcugggcagccggcucuccaaggagaugagcaagcugacguccaacuuccgccugggcuucgggagcuucguggagaagcccgucuccccguucgugaagaccacccccgaggagaucgccaaccccugcagcuccauccccuacuucugccucccgaccuucggcuucaagcacauccugccccugacgaacgacgccgagcgguucaacgagaucgugaagaaccagaagaucagcgcgaacaucgacacccccgagggcggguucgacgccaucaugcaggccgccgucugcaaggagaagaucggcuggcgcaacgacucccuccaccuccugguguucgugagcgacgccgacucccacuucgggauggacagcaagcuggcgggcaucgucauccccaacgacgggcugugccaccuggacagcaagaacgaguacuccaugagcaccgugcucgaguacccgaccaucggccagcugaucgacaagcuggugcagaacaacguccuccugaucuucgccgugacgcaggagcagguccaccuguacgagaacuacgccaagcucauccccggggccaccgugggccugcugcagaaggacuccggcaacauccuccagcugaucaucagcgccuacgaggagcugcgguccgagguggagcucgaggugcugggggacaccgagggccugaaccucagcuucaccgcgaucugcaacaacgggacgcuguuccagcaccagaagaagugcucccacaugaaggucggcgacaccgccagcuucuccgugaccgucaacaucccccacugcgagcgccggagccgccacaucaucaucaagcccguggggcugggcgacgcccuggagcuccugguguccccggagugcaacugcgacugccagaaggaggucgaggugaacagcuccaagugccaccacggcaacgggagcuuccagugcggcgugugcgccugccaccccgggcacaugggcccccggugcgagugcggggaggacaugcuguccaccgacagcugcaaggaggcccccgaccacccguccugcagcggccgcggcgacugcuacugcgggcagugcaucugccaccucucccccuacggcaacaucuacgggcccuacugccagugcgacaacuucagcugcguccggcacaagggccugcugugcggcgggaacggcgacugcgacugcggggagugcgugugccgcagcggcuggacgggggaguacugcaacugcaccaccuccaccgacagcugcguguccgaggacggcguccucugcagcggccgcggggacugcgugugcggcaagugcgugugcacgaaccccggggcguccggcccgaccugcgagcggugcccgaccugcggggaccccugcaacagcaagcgguccugcaucgagugccaccugagcgccgccggccaggcccgcgaggagugcgucgacaagugcaagcuggccggcgcgaccaucuccgaggaggaggacuucagcaaggacggguccgugagcugcucccuccagggcgagaacgagugccugaucacguuccugaucaccaccgacaacgaggggaagaccaucauccacagcaucaacgagaaggacugccccaagccgcccaacauccccaugaucaugcucggcgugucccuggccauccugcucaucggggucgugcugcugugcaucuggaagcuccuggugagcuuccacgaccggaaggaggucgccaaguucgaggccgagcgcuccaaggcgaaguggcagacgggcaccaacccccuguaccgcggcagcaccagcaccuucaagaacgugacguacaagcaccgggagaagcagaagguggaccucuccaccgacugcuga

SEQ ID NO: 2032 - RNA, 2367 nt, Artificial Sequence
  derived and/or modified sequence opt2 from ITB6__Homo_sapiens__AAA36122
augggcaucgagcuccucugccucuucuuccucuuccucggccgcaacgaccacguccagggcggcugcgcccucggcggcgccgagaccugcgaggacugccuccucaucggcccccagugcgccuggugcgcccaggagaacuucacccaccccuccggcgucggcgagcgcugcgacacccccgccaaccuccucgccaagggcugccagcucaacuucaucgagaaccccgucucccaggucgagauccucaagaacaagccccucuccgucggccgccagaagaacuccuccgacaucguccagaucgccccccagucccucauccucaagcuccgccccggcggcgcccagacccuccagguccacguccgccagaccgaggacuaccccgucgaccucuacuaccucauggaccucuccgccuccauggacgacgaccucaacaccaucaaggagcucggcucccgccucuccaaggagauguccaagcucaccuccaacuuccgccucggcuucggcuccuucgucgagaagcccgucucccccuucgucaagaccacccccgaggagaucgccaaccccugcuccuccauccccuacuucugccuccccaccuucggcuucaagcacauccucccccucaccaacgacgccgagcgcuucaacgagaucgucaagaaccagaagaucuccgccaacaucgacacccccgagggcggcuucgacgccaucaugcaggccgccgucugcaaggagaagaucggcuggcgcaacgacucccuccaccuccucgucuucgucuccgacgccgacucccacuucggcauggacuccaagcucgccggcaucgucauccccaacgacggccucugccaccucgacuccaagaacgaguacuccauguccaccguccucgaguaccccaccaucggccagcucaucgacaagcucguccagaacaacguccuccucaucuucgccgucacccaggagcagguccaccucuacgagaacuacgccaagcucauccccggcgccaccgucggccuccuccagaaggacuccggcaacauccuccagcucaucaucuccgccuacgaggagcuccgcuccgaggucgagcucgagguccucggcgacaccgagggccucaaccucuccuucaccgccaucugcaacaacggcacccucuuccagcaccagaagaagugcucccacaugaaggucggcgacaccgccuccuucuccgucaccgucaacaucccccacugcgagcgccgcucccgccacaucaucaucaagcccgucggccucggcgacgcccucgagcuccucgucucccccgagugcaacugcgacugccagaaggaggucgaggucaacuccuccaagugccaccacggcaacggcuccuuccagugcggcgucugcgccugccaccccggccacaugggcccccgcugcgagugcggcgaggacaugcucuccaccgacuccugcaaggaggcccccgaccaccccuccugcuccggccgcggcgacugcuacugcggccagugcaucugccaccucucccccuacggcaacaucuacggccccuacugccagugcgacaacuucuccugcguccgccacaagggccuccucugcggcggcaacggcgacugcgacugcggcgagugcgucugccgcuccggcuggaccggcgaguacugcaacugcaccaccuccaccgacuccugcgucuccgaggacggcguccucugcuccggccgcggcgacugcgucugcggcaagugcgucugcaccaaccccggcgccuccggccccaccugcgagcgcugccccaccugcggcgaccccugcaacuccaagcgcuccugcaucgagugccaccucuccgccgccggccaggcccgcgaggagugcgucgacaagugcaagcucgccggcgccaccaucuccgaggaggaggacuucuccaaggacggcuccgucuccugcucccuccagggcgagaacgagugccucaucaccuuccucaucaccaccgacaacgagggcaagaccaucauccacuccaucaacgagaaggacugccccaagccccccaacauccccaugaucaugcucggcgucucccucgccauccuccucaucggcgucguccuccucugcaucuggaagcuccucgucuccuuccacgaccgcaaggaggucgccaaguucgaggccgagcgcuccaaggccaaguggcagaccggcaccaacccccucuaccgcggcuccaccuccaccuucaagaacgucaccuacaagcaccgcgagaagcagaaggucgaccucuccaccgacugcuga

SEQ ID NO: 2033 - RNA, 2367 nt, Artificial Sequence
  derived and/or modified sequence opt3 from ITB6__Homo_sapiens__AAA36122
augggcaucgagcugcucugccuuuucuuucuguucuuggggagaaacgaccacgugcagggagguugugccuuaggcggggcugaaaccugcgaggauugucugcuaauuggaccccaaugcgcauggugugcccaggaaaauuuuacacauccuagcggcgucggugagaggugcgacacuccagcgaaccuccuggcuaaggggugucagcuuaauuucauagaaaacccgguuucccagguggagauccugaaaaauaagcccuugucuguaggacggcagaaaaacucaagugauauugugcaaaucgccccucagagccucauucugaagcugcgcccaggcggcgcacagacgcuccaaguccacgugcgacagaccgaggacuaccccguugauuuauauuaccugauggaccuuuccgccucuauggaugacgauuugaauacaaucaaagaacuggggucgcgucuaucaaaggagaugagcaagcucacuuccaacuuuagacugggauucgguuccuuuguggaaaaaccugucucuccauucgugaagaccacacccgaggagauagcuaauccuugcagcuccaucccauauuuuugucuuccgaccuucggcuuuaaacauauucugcccuugacuaacgacgcagaaagguucaaugagaucguaaagaaccagaaaauuucagccaauaucgauacaccugaagggggauuugacgcuauaaugcaggccgcgguuugcaaggagaagauuggcuggcggaacgauagucuccaccuguuaguguucgucagcgacgcagacucucauuucgguauggauuccaaacuggccgggaucgugauuccaaaugacggacucugucaccuugauucaaagaacgaauacagcaugaguaccgugcuggaguaucccacgaucggccaauugaucgacaagcuaguccagaacaauguucugcucauuuuugcugugacucaggagcaaguacaccuguacgaaaacuaugccaaacuuauaccuggcgcaaccguggggcuguugcagaaagauucuggaaauauccuccagcugauuaucuccgcuuacgaggaauuacgcagcgaggucgaacuggaggugcuaggugacacagagggccucaaccugucguucacugccauaugcaauaacgggacccuuuuucagcaucaaaagaaaugcucucacaugaagguuggagauacagcguccuucucagugaccgucaauauuccacauugugaaagaaggagucggcacaucaucauuaagcccgugggcuugggugacgcccuggagcuccugguaagcccggaaugcaacugugauugccagaaagagguugaagugaauaguucuaagugucaccaugggaacggcagcuuucagugcggagucugugcaugccacccuggccauauggggccccgcugugagugcggagaggacaugcuuucaacggauaguuguaaagaagcuccagaccacccuuccugcagcggucgaggcgacugcuacugugggcagugcaucugucaucugucucccuauggaaauauuuacggcccauauugccaaugugauaacuucucaugcgugagacacaaggguuugcucugugggggcaauggagacugcgauuguggcgagugcgucuguaggaguggguggacuggagaauacugcaacugcacaaccagcacugacuccugugugucugaggaugguguucugugcucgggccguggggacugugugugcggaaaauguguaugcacaaaucccggcgccagcgguccuaccugugagcggugcccaacguguggggauccgugcaacuccaagcgcucauguauagaaugccacuuaagugcugccggccaggcaagagaggaaugcgucgacaaguguaaacuggccggagcuaccaucucugaggaagaggauuuuagcaaggacggcuccgugucaugcagccuacagggggagaacgaaugucucauuacauuccugaucacuaccgauaaugagggaaaaacaaucauucauucuauaaacgaaaaggacugccccaaaccuccaaauauccccaugauuaugcuuggcguuuccuuggcgauccugcucauuggugugguccuguuauguaucuggaagcugcuugugaguuuucacgauaggaaggagguagcaaaauucgaagccgagcggagcaaggcuaaauggcagacugggaccaacccuuuguaucgaggaucuacauccaccuuuaagaaugugacuuacaaacaucgcgagaagcaaaagguugaccucucaacggacugcuga

SEQ ID NO: 2034 - RNA, 2367 nt, Artificial Sequence
  derived and/or modified sequence opt4 from ITB6__Homo_sapiens__AAA36122
augggcaucgagcugcugugccuguucuuccuguuccugggcagaaacgaccacgugcagggcggcugcgcccugggcggcgccgagaccugcgaggacugccugcugaucggcccccagugcgccuggugcgcccaggagaacuucacccaccccagcggcgugggcgagagaugcgacacccccgccaaccugcuggccaagggcugccagcugaacuucaucgagaaccccgugagccagguggagauccugaagaacaagccccugagcgugggcagacagaagaacagcagcgacaucgugcagaucgccccccagagccugauccugaagcugagacccggcggcgcccagacccugcaggugcacgugagacagaccgaggacuaccccguggaccuguacuaccugauggaccugagcgccagcauggacgacgaccugaacaccaucaaggagcugggcagcagacugagcaaggagaugagcaagcugaccagcaacuucagacugggcuucggcagcuucguggagaagcccgugagccccuucgugaagaccacccccgaggagaucgccaaccccugcagcagcauccccuacuucugccugcccaccuucggcuucaagcacauccugccccugaccaacgacgccgagagauucaacgagaucgugaagaaccagaagaucagcgccaacaucgacacccccgagggcggcuucgacgccaucaugcaggccgccgugugcaaggagaagaucggcuggagaaacgacagccugcaccugcugguguucgugagcgacgccgacagccacuucggcauggacagcaagcuggccggcaucgugauccccaacgacggccugugccaccuggacagcaagaacgaguacagcaugagcaccgugcuggaguaccccaccaucggccagcugaucgacaagcuggugcagaacaacgugcugcugaucuucgccgugacccaggagcaggugcaccuguacgagaacuacgccaagcugauccccggcgccaccgugggccugcugcagaaggacagcggcaacauccugcagcugaucaucagcgccuacgaggagcugagaagcgagguggagcuggaggugcugggcgacaccgagggccugaaccugagcuucaccgccaucugcaacaacggcacccuguuccagcaccagaagaagugcagccacaugaaggugggcgacaccgccagcuucagcgugaccgugaacaucccccacugcgagagaagaagcagacacaucaucaucaagcccgugggccugggcgacgcccuggagcugcuggugagccccgagugcaacugcgacugccagaaggagguggaggugaacagcagcaagugccaccacggcaacggcagcuuccagugcggcgugugcgccugccaccccggccacaugggccccagaugcgagugcggcgaggacaugcugagcaccgacagcugcaaggaggcccccgaccaccccagcugcagcggcagaggcgacugcuacugcggccagugcaucugccaccugagccccuacggcaacaucuacggccccuacugccagugcgacaacuucagcugcgugagacacaagggccugcugugcggcggcaacggcgacugcgacugcggcgagugcgugugcagaagcggcuggaccggcgaguacugcaacugcaccaccagcaccgacagcugcgugagcgaggacggcgugcugugcagcggcagaggcgacugcgugugcggcaagugcgugugcaccaaccccggcgccagcggccccaccugcgagagaugccccaccugcggcgaccccugcaacagcaagagaagcugcaucgagugccaccugagcgccgccggccaggccagagaggagugcguggacaagugcaagcuggccggcgccaccaucagcgaggaggaggacuucagcaaggacggcagcgugagcugcagccugcagggcgagaacgagugccugaucaccuuccugaucaccaccgacaacgagggcaagaccaucauccacagcaucaacgagaaggacugccccaagccccccaacauccccaugaucaugcugggcgugagccuggccauccugcugaucggcguggugcugcugugcaucuggaagcugcuggugagcuuccacgacagaaaggagguggccaaguucgaggccgagagaagcaaggccaaguggcagaccggcaccaacccccuguacagaggcagcaccagcaccuucaagaacgugaccuacaagcacagagagaagcagaagguggaccugagcaccgacugcuga

SEQ ID NO: 2035 - RNA, 2367 nt, Artificial Sequence
  derived and/or modified sequence opt5 from ITB6__Homo_sapiens__AAA36122
augggcaucgagcugcucugccuguucuuucuuuuccuggggagaaacgaccacgugcagggaggcugugcccucgggggagcugaaaccugcgaggauugucugcuuauuggcccccaaugcgccuggugugcgcaggaaaauuuuacacauccuagcggggucggagagcggugcgacacgccggcuaaccugcucgccaagggcugucagcugaauuucaucgaaaaccccguuucccagguggagauucugaaaaauaagccucucucugugggccgccaaaagaacagcuccgauaucguccagauugcuccccagucucugauccuuaagcugagaccugggggagcccagacccuccaagugcacguucggcagacagaggacuaccccguggaucuguauuaccuuauggaccugagcgccuccauggaugacgaucucaauaccaucaaagaacugggcucucgccugagcaaggagauguccaagcucacaagcaacuuuagacugggguucggaucuuuugucgaaaaaccuguguccccguucguuaagaccacacccgaggagauugcuaauccuugcagcucuauccccuauuuuugucuuccuaccuucggcuuuaaacauauucugccccucacgaacgacgccgaacgguucaaugagaucgugaagaaccagaaaauuuccgcgaauaucgauaccccggaagggggauuugacgccauuaugcaggcugccgucugcaaggagaagaucggcuggcgcaacgauagccugcaccuucugguguucgugucugacgcugacucccauuucggcauggauagcaaacucgccgggaucgucauuccuaaugacggacugugucaccuggauuccaagaacgaauacucuaugagcacaguucucgaguaucccaccaucggccaacugauugacaaacuugugcagaacaaugugcugcucaucuuugcggucacacaggagcaagugcaccuguacgaaaacuaugccaaacuuauuccuggggcuaccguuggacugcuccagaaagauuccggcaauauccugcagcugaucauuagcgccuacgaggaacucagaucugagguggaacuggagguccuuggggacacggagggacugaaccucuccuucacagcuaucugcaauaacggcacccuguuucagcaucaaaagaaaugcagccacaugaaggugggcgauacagccucuuucagcguuaccgugaauauuccccauugugaacggcgcuccagacacaucauuaucaagcccgucgggcugggagacgcccuugagcuccuggugucuccugaaugcaacugugauugccagaaagaggucgaagugaauagcuccaagugucaccauggcaacgggagcuuucagugcggaguuugugcuugccacccgggccauauggggccccggugugagugcggcgaggacaugcugucuaccgauuccuguaaagaagcgccugaccaccccagcugcucuggacgcggcgacugcuacugugggcagugcaucugucaucucuccccuuauggaaauauuuacggccccuauugccaaugugauaacuucagcugcgugagacacaaggggcugcuuuguggaggcaauggggacugcgauuguggcgagugcgucugucgguccggauggacaggcgaauacugcaacugcacgaccucuacagacagcuguguguccgaggaugggguucugugcucuggacgcggcgacugugugugcgggaaaugugucugcaccaauccgggagccagcggcccuacaugugagagaugccccaccuguggggauccuugcaacuccaagcggagcuguaucgaaugccaccucucugcugccggccaggccagagaggaaugcguggacaaguguaaacuggcuggagccacgauuuccgaggaagaggauuuuagcaaggacggcucuguguccugcagccugcagggggagaacgaaugucuuaucacauuccucauuaccaccgauaaugagggaaaaacaaucauucauucuaucaacgaaaaggacugccccaaaccucccaauaucccgaugauuaugcugggcguuagccuggcgauccuccugauuggggucgugcuucuguguaucuggaagcuccugguguccuuucacgaucgcaaggaggucgcuaaauucgaagccgagcggagcaaggccaaauggcagaccggaacaaacccucuguauagaggcucuacguccaccuuuaagaaugugacauacaaacaucgcgagaagcaaaagguugaccuuagcaccgacugcuga

SEQ ID NO: 2036 - protein, 261 aa, Artificial Sequence
  kallikrein-2__Homo_sapiens__A0A024R4J4
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 2037 - RNA, 786 nt, Artificial Sequence
  kallikrein-2__Homo_sapiens__EAW71937
augugggaccugguucucuccaucgccuugucuguggggugcacuggugccgugccccucauccagucucggauugugggaggcugggagugugagaagcauucccaacccuggcagguggcuguguacagucauggaugggcacacuguggggguguccuggugcacccccagugggugcucacagcugcccauugccuaaagaagaauagccaggucuggcugggucggcacaaccuguuugagccugaagacacaggccagagggucccugucagccacagcuucccacacccgcucuacaauaugagccuucugaagcaucaaagccuuagaccagaugaagacuccagccaugaccucaugcugcuccgccugucagagccugccaagaucacagauguugugaagguccugggccugcccacccaggagccagcacuggggaccaccugcuacgccucaggcuggggcagcaucgaaccagaggaguucuugcgccccaggagucuucagugugugagccuccaucuccuguccaaugacaugugugcuagagcuuacucugagaaggugacagaguucauguugugugcugggcucuggacaggugguaaagacacuugugggggugauucuggggguccacuugucuguaauggugugcuucaagguaucacaucauggggcccugagccaugugcccugccugaaaagccugcuguguacaccaagguggugcauuaccggaaguggaucaaggacaccaucgcagccaaccccuga

SEQ ID NO: 2038 - RNA, 786 nt, Artificial Sequence
  derived and/or modified sequence opt1 from kallikrein-2__Homo_sapiens__EAW71937
augugggaccuggugcucagcaucgcccuguccgucggcugcaccggggccgugccccugauccagagccgcaucgugggcgggugggagugcgagaagcacucccagccguggcaggucgcgguguacagccacggcugggcccacugcgggggcgugcucguccacccccagugggugcugaccgccgcccacugccugaagaagaacucccagguguggcucggccggcacaaccuguucgagcccgaggacacggggcagcgcguccccgugagccacuccuucccgcacccccuguacaacaugagccuccugaagcaccagucccugcggcccgacgaggacagcucccacgaccucaugcugcugcgccucagcgagcccgccaagaucaccgacguggucaaggugcugggccugccgacccaggagcccgcgcucgggaccacgugcuacgccuccggcugggggagcaucgagcccgaggaguuccugcggccccgcucccugcagugcgugagccuccaccuccuguccaacgacaugugcgcccgggccuacagcgagaaggucaccgaguucaugcugugcgcgggccuguggaccggcgggaaggacacgugcggcggggacuccggcggcccgcuggugugcaacggggugcuccagggcaucaccagcugggggcccgagcccugcgcccugcccgagaagccggccgucuacaccaagguggugcacuaccgcaaguggaucaaggacaccaucgccgccaaccccuga

SEQ ID NO: 2039 - RNA, 786 nt, Artificial Sequence
  derived and/or modified sequence opt2 from kallikrein-2__Homo_sapiens__EAW71937
augugggaccucguccucuccaucgcccucuccgucggcugcaccggcgccgucccccucauccagucccgcaucgucggcggcugggagugcgagaagcacucccagcccuggcaggucgccgucuacucccacggcugggcccacugcggcggcguccucguccacccccaguggguccucaccgccgcccacugccucaagaagaacucccaggucuggcucggccgccacaaccucuucgagcccgaggacaccggccagcgcguccccgucucccacuccuucccccacccccucuacaacaugucccuccucaagcaccagucccuccgccccgacgaggacuccucccacgaccucaugcuccuccgccucuccgagcccgccaagaucaccgacgucgucaagguccucggccuccccacccaggagcccgcccucggcaccaccugcuacgccuccggcuggggcuccaucgagcccgaggaguuccuccgcccccgcucccuccagugcgucucccuccaccuccucuccaacgacaugugcgcccgcgccuacuccgagaaggucaccgaguucaugcucugcgccggccucuggaccggcggcaaggacaccugcggcggcgacuccggcggcccccucgucugcaacggcguccuccagggcaucaccuccuggggccccgagcccugcgcccuccccgagaagcccgccgucuacaccaaggucguccacuaccgcaaguggaucaaggacaccaucgccgccaaccccuga

SEQ ID NO: 2040 - RNA, 786 nt, Artificial Sequence
  derived and/or modified sequence opt3 from kallikrein-2__Homo_sapiens__EAW71937
augugggaccuggugcucagcaucgcccuuuccgucggcugcaccggggcuguuccccugauucagucuagaauagugggagguugggagugugaaaagcacucacaaccuuggcagguagcaguguacagucauggcugggcccacugcgggggagucuuggugcauccacaguggguuuuaacagcggcucacugucugaaaaagaacagccagguguggcuaggcaggcauaaucucuucgagccggaagauacuggucaacggguccccgugucccacucuuuuccucacccacuguauaacaugucgcuucugaaacaucagucauugcgccccgacgaggauagcagucacgaccucaugcugcugcgacucuccgaaccugccaagaucacggauguaguuaaaguguuagggcugccaacccaggagcccgcacuuggaacaacuugcuacgccucuggcuggggcagcauugagccugaagaguucuugcguccaagaucccugcagugugucucacuacaucuccugaguaaugacaugugcgcuagggcauauagcgaaaaggugaccgaguuuaugcuuugugccgggcuguggacaggagguaaggauaccugcggcggggacucuggaggcccguugguguguaacgguguccuccaagggaucacuuccuggggacccgagccuugcgcucugccagaaaaacccgccguuuacacaaaggugguacacuaucggaaauggauuaaggauaccaucgcggcaaauccuuga

SEQ ID NO: 2041 - RNA, 786 nt, Artificial Sequence
  derived and/or modified sequence opt4 from kallikrein-2__Homo_sapiens__EAW71937
augugggaccuggugcugagcaucgcccugagcgugggcugcaccggcgccgugccccugauccagagcagaaucgugggcggcugggagugcgagaagcacagccagcccuggcagguggccguguacagccacggcugggcccacugcggcggcgugcuggugcacccccagugggugcugaccgccgcccacugccugaagaagaacagccagguguggcugggcagacacaaccuguucgagcccgaggacaccggccagagagugcccgugagccacagcuucccccacccccuguacaacaugagccugcugaagcaccagagccugagacccgacgaggacagcagccacgaccugaugcugcugagacugagcgagcccgccaagaucaccgacguggugaaggugcugggccugcccacccaggagcccgcccugggcaccaccugcuacgccagcggcuggggcagcaucgagcccgaggaguuccugagacccagaagccugcagugcgugagccugcaccugcugagcaacgacaugugcgccagagccuacagcgagaaggugaccgaguucaugcugugcgccggccuguggaccggcggcaaggacaccugcggcggcgacagcggcggcccccuggugugcaacggcgugcugcagggcaucaccagcuggggccccgagcccugcgcccugcccgagaagcccgccguguacaccaagguggugcacuacagaaaguggaucaaggacaccaucgccgccaaccccuga

SEQ ID NO: 2042 - RNA, 786 nt, Artificial Sequence
  derived and/or modified sequence opt5 from kallikrein-2__Homo_sapiens__EAW71937
augugggaccuggugcucagcaucgcccuguccgucggcugcaccggggcuguuccccuuauucagucuagaaucgugggaggcugggagugugaaaagcacagccaaccuuggcaaguggccgucuacucccaugggugggcgcacugcggaggcgugcugguucauccgcagugggugcucacagcugcccacugucugaaaaagaacucucaggucuggcuugggcggcauaaucuguucgagcccgaagauacgggacagcgcgugccuguuagccacuccuuuccccacccucucuauaacaugucucugcugaaacaucagagccucagacccgacgaggauuccagccacgaccugaugcuucugcggcucucugaaccugccaagauuaccgauguggucaaagugcugggccuuccgacacaggagcccgcucugggcaccacaugcuacgccuccggguggggaagcaucgagccugaagaguuccuccgccccagaucucugcagugugugucccugcaucuccugagcaaugacaugugcgcucgggccuauucugaaaaggucaccgaguuuaugcuuugugcgggccuguggacagggggaaaggauaccugcggcggggacuccggaggcccucucguuuguaacggcgugcugcaagggauuacgagcuggggacccgagccgugcgcccuuccugaaaaacccgcuguguacaccaaggucgugcacuaucgcaaauggaucaaggauacaaucgccgcuaauccuuga

SEQ ID NO: 2043 - protein, 223 aa, Artificial Sequence
  kallikrein-2__Homo_sapiens__A0A024R4N3
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 2044 - RNA, 672 nt, Artificial Sequence
  kallikrein-2__Homo_sapiens__EAW71938
augugggaccugguucucuccaucgccuugucuguggggugcacuggugccgugccccucauccagucucggauugugggaggcugggagugugagaagcauucccaacccuggcagguggcuguguacagucauggaugggcacacuguggggguguccuggugcacccccagugggugcucacagcugcccauugccuaaagaagaauagccaggucuggcugggucggcacaaccuguuugagccugaagacacaggccagagggucccugucagccacagcuucccacacccgcucuacaauaugagccuucugaagcaucaaagccuuagaccagaugaagacuccagccaugaccucaugcugcuccgccugucagagccugccaagaucacagauguugugaagguccugggccugcccacccaggagccagcacuggggaccaccugcuacgccucaggcuggggcagcaucgaaccagaggaguucuugcgccccaggagucuucagugugugagccuccaucuccuguccaaugacaugugugcuagagcuuacucugagaaggugacagaguucauguugugugcugggcucuggacaggugguaaagacacuuguggggugagucaucccuacucccaacaucuggaggggaaaggguga

SEQ ID NO: 2045 - RNA, 672 nt, Artificial Sequence
  derived and/or modified sequence opt1 from kallikrein-2__Homo_sapiens__EAW71938
augugggaccuggugcucagcaucgcccuguccgucggcugcaccggggccgugccccugauccagagccgcaucgugggcgggugggagugcgagaagcacucccagccguggcaggucgcgguguacagccacggcugggcccacugcgggggcgugcucguccacccccagugggugcugaccgccgcccacugccugaagaagaacucccagguguggcucggccggcacaaccuguucgagcccgaggacaccgggcagcgcguccccgugagccacuccuucccgcacccccuguacaacaugagccuccugaagcaccagucccugcggcccgacgaggacagcucccacgaccucaugcugcugcgccucagcgagcccgccaagaucaccgacguggucaaggugcugggccugccgacccaggagcccgcgcucgggaccacgugcuacgccuccggcugggggagcaucgagcccgaggaguuccugcggccccgcucccugcagugcgugagccuccaccuccuguccaacgacaugugcgcccgggccuacagcgagaaggucaccgaguucaugcugugcgcgggccuguggaccggcgggaaggacacgugcggcgugucccacccguacagccagcaccuggaggggaagggcuga

SEQ ID NO: 2046 - RNA, 672 nt, Artificial Sequence
  derived and/or modified sequence opt2 from kallikrein-2__Homo_sapiens__EAW71938
augugggaccucguccucuccaucgcccucuccgucggcugcaccggcgccgucccccucauccagucccgcaucgucggcggcugggagugcgagaagcacucccagcccuggcaggucgccgucuacucccacggcugggcccacugcggcggcguccucguccacccccaguggguccucaccgccgcccacugccucaagaagaacucccaggucuggcucggccgccacaaccucuucgagcccgaggacaccggccagcgcguccccgucucccacuccuucccccacccccucuacaacaugucccuccucaagcaccagucccuccgccccgacgaggacuccucccacgaccucaugcuccuccgccucuccgagcccgccaagaucaccgacgucgucaagguccucggccuccccacccaggagcccgcccucggcaccaccugcuacgccuccggcuggggcuccaucgagcccgaggaguuccuccgcccccgcucccuccagugcgucucccuccaccuccucuccaacgacaugugcgcccgcgccuacuccgagaaggucaccgaguucaugcucugcgccggccucuggaccggcggcaaggacaccugcggcgucucccaccccuacucccagcaccucgagggcaagggcuga

SEQ ID NO: 2047 - RNA, 672 nt, Artificial Sequence
  derived and/or modified sequence opt3 from kallikrein-2__Homo_sapiens__EAW71938
augugggaccuggugcucagcaucgcccuuuccgucggcugcaccggggcuguuccccugauucagucuagaauagugggagguugggagugugaaaagcacucacaaccuuggcagguagcaguguacagucauggcugggcccacugcgggggagucuuggugcauccacaguggguuuuaacagcggcucacugucugaaaaagaacagccagguguggcuaggcaggcauaaucucuucgagccggaagauacuggucaacggguccccgugucccacucuuuuccucacccacuguauaacaugucgcuucugaaacaucagucauugcgccccgacgaggauagcagucacgaccucaugcugcugcgacucuccgaaccugccaagaucacggauguaguuaaaguguuagggcugccaacccaggagcccgcacuuggaacaacuugcuacgccucuggcuggggcagcauugagccugaagaguucuugcguccaagaucccugcagugugucucacuacaucuccugaguaaugacaugugcgcuagggcauauagcgaaaaggugaccgaguuuaugcuuugugccgggcuguggacaggagguaaggauaccugcggcgugucucacccguacucccaacacuuggaggggaaaggauga

SEQ ID NO: 2048 - RNA, 672 nt, Artificial Sequence
  derived and/or modified sequence opt4 from kallikrein-2__Homo_sapiens__EAW71938
augugggaccuggugcugagcaucgcccugagcgugggcugcaccggcgccgugccccugauccagagcagaaucgugggcggcugggagugcgagaagcacagccagcccuggcagguggccguguacagccacggcugggcccacugcggcggcgugcuggugcacccccagugggugcugaccgccgcccacugccugaagaagaacagccagguguggcugggcagacacaaccuguucgagcccgaggacaccggccagagagugcccgugagccacagcuucccccacccccuguacaacaugagccugcugaagcaccagagccugagacccgacgaggacagcagccacgaccugaugcugcugagacugagcgagcccgccaagaucaccgacguggugaaggugcugggccugcccacccaggagcccgcccugggcaccaccugcuacgccagcggcuggggcagcaucgagcccgaggaguuccugagacccagaagccugcagugcgugagccugcaccugcugagcaacgacaugugcgccagagccuacagcgagaaggugaccgaguucaugcugugcgccggccuguggaccggcggcaaggacaccugcggcgugagccaccccuacagccagcaccuggagggcaagggcuga

SEQ ID NO: 2049 - RNA, 672 nt, Artificial Sequence
  derived and/or modified sequence opt5 from kallikrein-2__Homo_sapiens__EAW71938
augugggaccuggugcucagcaucgcccuguccgucggcugcaccggggcuguuccccuuauucagucuagaaucgugggaggcugggagugugaaaagcacagccaaccuuggcaaguggccgucuacucccaugggugggcgcacugcggaggcgugcugguucauccgcagugggugcucacagcugcccacugucugaaaaagaacucucaggucuggcuugggcggcauaaucuguucgagcccgaagauacgggacagcgcgugccuguuagccacuccuuuccccacccucucuauaacaugucucugcugaaacaucagagccucagacccgacgaggauuccagccacgaccugaugcuucugcggcucucugaaccugccaagauuaccgauguggucaaagugcugggccuuccgacacaggagcccgcucugggcaccacaugcuacgccuccggguggggaagcaucgagccugaagaguuccuccgccccagaucucugcagugugugucccugcaucuccugagcaaugacaugugcgcucgggccuauucugaaaaggucaccgaguuuaugcuuugugcgggccuguggacagggggaaaggauaccugcggcguuucccacccuuacagccaacaccucgaggggaaaggauga

SEQ ID NO: 2050 - protein, 62 aa, Artificial Sequence
  kallikrein-2__Homo_sapiens__B0AZU9
MSLLKHQSLRPDEDSSHDLMLLRLSEPAKITDVVKVLGLPTQEPALGTTCYASGWGSIEPEE

SEQ ID NO: 2051 - RNA, 189 nt, Artificial Sequence
  kallikrein-2__Homo_sapiens__BAF98781
augagccuucugaagcaucaaagccuuagaccagaugaagacuccagccaugaccucaugcugcuucgccugucagagccugccaagaucacagauguugugaagguccugggccugcccacccaggagccagcacuggggaccaccugcuacgccucaggcuggggcagcaucgaaccagaggaguga

SEQ ID NO: 2052 - RNA, 189 nt, Artificial Sequence
  derived and/or modified sequence opt1 from kallikrein-2__Homo_sapiens__BAF98781
augagccugcucaagcaccagucccugcgccccgacgaggacagcucccacgaccugaugcuccugcggcugagcgagccggccaagaucaccgacguggucaaggugcucggccugcccacccaggagcccgcccuggggacgaccugcuacgcguccggcugggggagcaucgagcccgaggaguga

SEQ ID NO: 2053 - RNA, 189 nt, Artificial Sequence
  derived and/or modified sequence opt2 from kallikrein-2__Homo_sapiens__BAF98781
augucccuccucaagcaccagucccuccgccccgacgaggacuccucccacgaccucaugcuccuccgccucuccgagcccgccaagaucaccgacgucgucaagguccucggccuccccacccaggagcccgcccucggcaccaccugcuacgccuccggcuggggcuccaucgagcccgaggaguga

SEQ ID NO: 2054 - RNA, 189 nt, Artificial Sequence
  derived and/or modified sequence opt3 from kallikrein-2__Homo_sapiens__BAF98781
augagccugcucaagcaccagucccuuagacccgacgaggauucuucacaugaccugauguuguuaaggcugagugaaccugccaaaaucaccgauguggucaagguucuaggccucccaacacaagagccggcucuggggacuacgugcuacgcaagcggaugggguuccauugaacccgaggaauga

SEQ ID NO: 2055 - RNA, 189 nt, Artificial Sequence
  derived and/or modified sequence opt4 from kallikrein-2__Homo_sapiens__BAF98781
augagccugcugaagcaccagagccugagacccgacgaggacagcagccacgaccugaugcugcugagacugagcgagcccgccaagaucaccgacguggugaaggugcugggccugcccacccaggagcccgcccugggcaccaccugcuacgccagcggcuggggcagcaucgagcccgaggaguga

SEQ ID NO: 2056 - RNA, 189 nt, Artificial Sequence
  derived and/or modified sequence opt5 from kallikrein-2__Homo_sapiens__BAF98781
augagccugcucaagcaccagucccugagacccgacgaggauucuagccaugaccuuaugcugcuccggcuguccgaaccugccaaaaucaccgauguggucaagguucuuggccugccgacacaagagcccgcucucgggacgaccugcuacgccucuggauggggcagcauugaaccugaggaauga

SEQ ID NO: 2057 - protein, 244 aa, Artificial Sequence [sequence omitted]

SEQ ID NO: 2058 - RNA, 735 nt, Artificial Sequence
  kallikrein-2__Homo_sapiens__BAG62239
augggcacacuguggggguguccuggugcacccccagugggugcucacagcugcccauugccuaaagaaguaaguaggacccugggaucuggggagggaauggcugugucccacaggaauaacagcgggaugcuucccccagggucacuucucaggaauagccaggucuggcugggucggcacaaccuguuugagccugaagacacaggccggagggucccugucagccacagcuucccacacccgcucuacaauaugagccuucugaagcaucaaagccuuagaccagaugaagacuccagccaugaccucaugcugcuccgccugucagagccugccaagaucacagauguugugaagguccugggccugcccacccaggagccagcacuggggaccaccugcuacgccucaggcuggggcagcaucgaaccagaggaguucuugcgccccaggagucuucagugugugagccuccaucuccuguccaaugacaugugugcuagagcuuacucugagaaggugacagaguucauguugugugcugggcucuggacaggugguaaagacacuugugggggugauucuggggguccacuugucuguaauggugugcuucaagguaucacaucauggggcccugagccaugugcccugccugaaaagccugcuguguacaccaagguggugcauuaccggaaguggaucaaggacaccaucgcagccaaccccuga

SEQ ID NO: 2059 - RNA, 735 nt, Artificial Sequence
  derived and/or modified sequence opt1 from kallikrein-2__Homo_sapiens__BAG62239
augggcacccugugggggugccccggcgccccgcccgugggggcccacagcugcccccuccccaaggaggucucccgcacccugggcagcggggagggcauggcggugucccaccggaacaacagcggcaugcugccgcccgggucccuccugcgcaacagccagguguggcugggccggcacaaccucuucgagcccgaggacacggggcgccggguccccgugucccacagcuucccgcacccccuguacaacaugucccugcucaagcaccagagccugcgccccgacgaggacuccagccacgaccugaugcuccugcggcuguccgagcccgccaagaucaccgacguggucaaggugcucggccugccgacccaggagcccgcccuggggaccacgugcuacgccagcggcuggggcuccaucgagcccgaggaguuccuccgcccccggagccugcagugcgugucccugcaccuccugagcaacgacaugugcgcccgcgcguacuccgagaaggucaccgaguucaugcugugcgccgggcucuggaccggcgggaaggacacgugcggcggcgacagcgggggcccgcuggugugcaacggggugcugcagggcaucaccagcugggggcccgagcccugcgcccuccccgagaagccggccgucuacaccaagguggugcacuaccggaaguggaucaaggacaccaucgcggccaaccccuga

SEQ ID NO: 2060 - RNA, 735 nt, Artificial Sequence
  derived and/or modified sequence opt2 from kallikrein-2__Homo_sapiens__BAG62239
augggcacccucuggggcugccccggcgccccccccgucggcgcccacuccugcccccuccccaaggaggucucccgcacccucggcuccggcgagggcauggccgucucccaccgcaacaacuccggcaugcucccccccggcucccuccuccgcaacucccaggucuggcucggccgccacaaccucuucgagcccgaggacaccggccgccgcguccccgucucccacuccuucccccacccccucuacaacaugucccuccucaagcaccagucccuccgccccgacgaggacuccucccacgaccucaugcuccuccgccucuccgagcccgccaagaucaccgacgucgucaagguccucggccuccccacccaggagcccgcccucggcaccaccugcuacgccuccggcuggggcuccaucgagcccgaggaguuccuccgcccccgcucccuccagugcgucucccuccaccuccucuccaacgacaugugcgcccgcgccuacuccgagaaggucaccgaguucaugcucugcgccggccucuggaccggcggcaaggacaccugcggcggcgacuccggcggcccccucgucugcaacggcguccuccagggcaucaccuccuggggccccgagcccugcgcccuccccgagaagcccgccgucuacaccaaggucguccacuaccgcaaguggaucaaggacaccaucgccgccaaccccuga

SEQ ID NO: 2061 - RNA, 735 nt, Artificial Sequence
  derived and/or modified sequence opt3 from kallikrein-2__Homo_sapiens__BAG62239
augggcacccugugggggugccccggagccccuccagugggugcucacagcuguccgcuccccaaggaggucuccagaacacuuggcucuggggaaggaauggcaguuucacauaggaacaauaguggcaugcugccuccagguagcuuguuacggaacucccagguguggcuggggcgccacaaucuauucgagcccgaagacacuggacgacguguaccugugucucauucguuuccacacccccucuacaacaugucacugcuuaaacaucaaagccugagaccugaugaggacaguucccacgauuugaugcuccugaggcugucugaaccagccaagaucacggacgucgugaaaguucucggcuuaccgacccaggagcccgcgcugggcacaacuugcuaugcuagcggguggggauccauugagccugaagaguuccuucggccacgcucauugcagugugugagucugcaccuacucagcaaugauaugugcgccagagcauacucugaaaaggucaccgaguuuaugcugugugccggucuuuggacaggcgggaaagauaccugcggaggcgacuccggugggccccugguguguaacggaguauugcagggcauaacuucauggggcccugagccaugcgcucuccccgaaaagccggcaguuuauacaaaggugguccauuacaggaaauggaucaaggacaccauugccgcuaauccuuga

SEQ ID NO: 2062 - RNA, 735 nt, Artificial Sequence
  derived and/or modified sequence opt4 from kallikrein-2__Homo_sapiens__BAG62239
augggcacccuguggggcugccccggcgccccccccgugggcgcccacagcugcccccugcccaaggaggugagcagaacccugggcagcggcgagggcauggccgugagccacagaaacaacagcggcaugcugccccccggcagccugcugagaaacagccagguguggcugggcagacacaaccuguucgagcccgaggacaccggcagaagagugcccgugagccacagcuucccccacccccuguacaacaugagccugcugaagcaccagagccugagacccgacgaggacagcagccacgaccugaugcugcugagacugagcgagcccgccaagaucaccgacguggugaaggugcugggccugcccacccaggagcccgcccugggcaccaccugcuacgccagcggcuggggcagcaucgagcccgaggaguuccugagacccagaagccugcagugcgugagccugcaccugcugagcaacgacaugugcgccagagccuacagcgagaaggugaccgaguucaugcugugcgccggccuguggaccggcggcaaggacaccugcggcggcgacagcggcggcccccuggugugcaacggcgugcugcagggcaucaccagcuggggccccgagcccugcgcccugcccgagaagcccgccguguacaccaagguggugcacuacagaaaguggaucaaggacaccaucgccgccaaccccuga

SEQ ID NO: 2063 - RNA, 735 nt, Artificial Sequence
  derived and/or modified sequence opt5 from kallikrein-2__Homo_sapiens__BAG62239
augggcacccugugggggugccccggagccccuccggugggcgcucacagcuguccccucccuaaggaggucuccagaacacuggggucuggagaaggcauggccguuagccaucggaacaauuccgggaugcuucccccuggaucucugcuccgcaacagccagguguggcugggcagacacaaucuuuucgagcccgaagacacgggccggcgcgugccugucucccauucuuuuccgcacccccuguacaacaugagccuccugaaacaucaaucccugagaccugaugaggacagcucucacgaucucaugcugcuucggcuguccgaacccgcgaagaucaccgacgugguuaaagugcucgggcugccuacacaggagcccgcucuuggaaccacaugcuaugccagcggcugggggucuauugagccggaagaguuccugcgcccuagaucccuccagugugucagccugcaucugcucucuaaugauaugugcgcccgggcuuacuccgaaaaggugaccgaguuuaugcugugugccggacuuuggacaggcgggaaagauaccugcggaggcgacagcggcgggccccugguuuguaacggagugcuccagggcaucacguccugggggccugagcccugcgcucugcccgaaaagccugccgucuauaccaagguggugcacuaccgcaaauggauuaaggacacaaucgcggccaauccguga

SEQ ID NO: 2064 - protein, 261 aa, Artificial Sequence; identical to SEQ ID NO: 2036
  kallikrein-2__Homo_sapiens__P20151

SEQ ID NO: 2065 - RNA, 786 nt, Artificial Sequence
  kallikrein-2__Homo_sapiens__AAA74454
augugggaccugguucucuccaucgccuugucuguggggugcacuggugccgugccccucauccagucucggauugugggaggcugggagugugagaagcauucccaacccuggcagguggcuguguacagucauggaugggcacacuguggggguguccuggugcacccccagugggugcucacagcugcccauugccuaaagaagaauagccaggucuggcugggucggcacaaccuguuugagccugaagacacaggccagagggucccugucagccacagcuucccacacccgcucuacaauaugagccuucugaagcaucaaagccuuagaccagaugaagacuccagccaugaccucaugcugcuccgccugucagagccugccaagaucacagauguugugaagguccugggccugcccacccaggagccagcacuggggaccaccugcuacgccucaggcuggggcagcaucgaaccagaggaguucuugcgccccaggagucuucagugugugagccuccaucuccuguccaaugacaugugugcuagagcuuacucugagaaggugacagaguucauguugugugcugggcucuggacaggugguaaagacacuugugggggugauucuggggguccacuugucuguaauggggugcuucaagguaucacaucauggggcccugagccaugugcccugccugaaaagccugcuguguacaccaagguggugcauuaccggaaguggaucaaggacaccaucgcagccaaccccuga

SEQ ID NO: 2066 - RNA, 786 nt, Artificial Sequence; identical to SEQ ID NO: 2038
  derived and/or modified sequence opt1 from kallikrein-2__Homo_sapiens__AAA74454

SEQ ID NO: 2067 - RNA, 786 nt, Artificial Sequence; identical to SEQ ID NO: 2039
  derived and/or modified sequence opt2 from kallikrein-2__Homo_sapiens__AAA74454

SEQ ID NO: 2068 - RNA, 786 nt, Artificial Sequence; identical to SEQ ID NO: 2040
  derived and/or modified sequence opt3 from kallikrein-2__Homo_sapiens__AAA74454

SEQ ID NO: 2069 - RNA, 786 nt, Artificial Sequence; identical to SEQ ID NO: 2041
  derived and/or modified sequence opt4 from kallikrein-2__Homo_sapiens__AAA74454

SEQ ID NO: 2070 - RNA, 786 nt, Artificial Sequence; identical to SEQ ID NO: 2042
  derived and/or modified sequence opt5 from kallikrein-2__Homo_sapiens__AAA74454

SEQ ID NO: 2071 - protein, 49 aa, Artificial Sequence
  kallikrein-2__Homo_sapiens__Q6T774
MWDLVLSIALSVGCTGIARSGWVGTTCLSLKTQARGSLSATASHTRSTI

SEQ ID NO: 2072 - RNA, 150 nt, Artificial Sequence
  kallikrein-2__Homo_sapiens__AAR10469
augugggaccugguucucuccaucgccuugucuguggggugcacuggaauagccaggucuggcugggucggcacaaccuguuugagccugaagacacaggccagagggucccugucagccacagcuucccacacccgcucuacaauauga

SEQ ID NO: 2073 - RNA, 150 nt, Artificial Sequence
  derived and/or modified sequence opt1 from kallikrein-2__Homo_sapiens__AAR10469
augugggaccuggugcucagcaucgcccuguccgucggcugcaccgggaucgcccgcagcggcuggguggggaccacgugccugucccucaagacccaggcgcggggcagccuguccgccaccgccagccacacccgcuccacgaucuga

SEQ ID NO: 2074 - RNA, 150 nt, Artificial Sequence
  derived and/or modified sequence opt2 from kallikrein-2__Homo_sapiens__AAR10469
augugggaccucguccucuccaucgcccucuccgucggcugcaccggcaucgcccgcuccggcugggucggcaccaccugccucucccucaagacccaggcccgcggcucccucuccgccaccgccucccacacccgcuccaccaucuga

SEQ ID NO: 2075 - RNA, 150 nt, Artificial Sequence
  derived and/or modified sequence opt3 from kallikrein-2__Homo_sapiens__AAR10469
augugggaccuggugcucagcaucgcccuuuccgucggcugcaccgggauugcuagaucuggauggguugguacaacuugucugucauugaagacgcaggcaaggggcaguuuaagcgccaccgcgucccacacacggucuacuauauga

SEQ ID NO: 2076 - RNA, 150 nt, Artificial Sequence
  derived and/or modified sequence opt4 from kallikrein-2__Homo_sapiens__AAR10469
augugggaccuggugcugagcaucgcccugagcgugggcugcaccggcaucgccagaagcggcugggugggcaccaccugccugagccugaagacccaggccagaggcagccugagcgccaccgccagccacaccagaagcaccaucuga

SEQ ID NO: 2077 - RNA, 150 nt, Artificial Sequence
  derived and/or modified sequence opt5 from kallikrein-2__Homo_sapiens__AAR10469
augugggaccuggugcucagcaucgcccuguccgucggcugcaccgggauugcuagaucuggauggguuggcacaacgugucuuagccugaagacccaggcccgggggucccucucugcgacagcuagccacacccgcuccacaaucuga

SEQ ID NO: 2078 - protein, 180 aa, Artificial Sequence
  kallikrein-2__Homo_sapiens__Q6T775
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEECTPGPDGVAGSPDAWV

SEQ ID NO: 2079 - RNA, 543 nt, Artificial Sequence
  kallikrein-2__Homo_sapiens__AAR10468
augugggaccugguucucuccaucgccuugucuguggggugcacuggugccgugccccucauccagucucggauugugggaggcugggagugugagaagcauucccaacccuggcagguggcuguguacagucauggaugggcacacuguggggguguccuggugcacccccagugggugcucacagcugcccauugccuaaagaagaauagccaggucuggcugggucggcacaaccuguuugagccugaagacacaggccagagggucccugucagccacagcuucccacacccgcucuacaauaugagccuucugaagcaucaaagccuuagaccagaugaagacuccagccaugaccucaugcugcuccgccugucagagccugccaagaucacagauguugugaagguccugggccugcccacccaggagccagcacuggggaccaccugcuacgccucaggcuggggcagcaucgaaccagaggaguguacgccugggccagaugguguagcugggagcccagaugccugggucuga

SEQ ID NO: 2080 - RNA, 543 nt, Artificial Sequence
  derived and/or modified sequence opt1 from kallikrein-2__Homo_sapiens__AAR10468
augugggaccuggugcucagcaucgcccuguccgucggcugcaccggggccgugccccugauccagagccgcaucgugggcgggugggagugcgagaagcacucccagccguggcaggucgcgguguacagccacggcugggcccacugcgggggcgugcucguccacccccagugggugcugaccgccgcccacugccugaagaagaacucccagguguggcucggccggcacaaccuguucgagcccgaggacacggggcagcgcguccccgugagccacuccuucccgcacccccuguacaacaugagccuccugaagcaccagucccugcggcccgacgaggacagcucccacgaccucaugcugcugcgccucagcgagcccgccaagaucaccgacguggucaaggugcugggccugccgacccaggagcccgcgcucgggaccacgugcuacgccuccggcugggggagcaucgagcccgaggagugcacccccggcccggacggcguggccgggucccccgacgccugggucuga

SEQ ID NO: 2081 - RNA, 543 nt, Artificial Sequence
  derived and/or modified sequence opt2 from kallikrein-2__Homo_sapiens__AAR10468
augugggaccucguccucuccaucgcccucuccgucggcugcaccggcgccgucccccucauccagucccgcaucgucggcggcugggagugcgagaagcacucccagcccuggcaggucgccgucuacucccacggcugggcccacugcggcggcguccucguccacccccaguggguccucaccgccgcccacugccucaagaagaacucccaggucuggcucggccgccacaaccucuucgagcccgaggacaccggccagcgcguccccgucucccacuccuucccccacccccucuacaacaugucccuccucaagcaccagucccuccgccccgacgaggacuccucccacgaccucaugcuccuccgccucuccgagcccgccaagaucaccgacgucgucaagguccucggccuccccacccaggagcccgcccucggcaccaccugcuacgccuccggcuggggcuccaucgagcccgaggagugcacccccggccccgacggcgucgccggcucccccgacgccugggucuga

SEQ ID NO: 2082 - RNA, 543 nt, Artificial Sequence
  derived and/or modified sequence opt3 from kallikrein-2__Homo_sapiens__AAR10468
augugggaccuggugcucagcaucgcccuuuccgucggcugcaccggggcuguuccccugauucagucuagaauagugggagguugggagugugaaaagcacucacaaccuuggcagguagcaguguacagucauggcugggcccacugcgggggagucuuggugcauccacaguggguuuuaacagcggcucacugucugaaaaagaacagccagguguggcuaggcaggcauaaucucuucgagccggaagauacuggucaacggguccccgugucccacucuuuuccucacccacuguauaacaugucgcuucugaaacaucagucauugcgccccgacgaggauagcagucacgaccucaugcugcugcgacucuccgaaccugccaagaucacggauguaguuaaaguguuagggcugccaacccaggagcccgcacuuggaacaacuugcuacgccucuggcuggggcagcauugagccugaagaguguaccccagggccggacggagucgcugguucccccgaugcauggguguga

SEQ ID NO: 2083 - RNA, 543 nt, Artificial Sequence
  derived and/or modified sequence opt4 from kallikrein-2__Homo_sapiens__AAR10468
augugggaccuggugcugagcaucgcccugagcgugggcugcaccggcgccgugccccugauccagagcagaaucgugggcggcugggagugcgagaagcacagccagcccuggcagguggccguguacagccacggcugggcccacugcggcggcgugcuggugcacccccagugggugcugaccgccgcccacugccugaagaagaacagccagguguggcugggcagacacaaccuguucgagcccgaggacaccggccagagagugcccgugagccacagcuucccccacccccuguacaacaugagccugcugaagcaccagagccugagacccgacgaggacagcagccacgaccugaugcugcugagacugagcgagcccgccaagaucaccgacguggugaaggugcugggccugcccacccaggagcccgcccugggcaccaccugcuacgccagcggcuggggcagcaucgagcccgaggagugcacccccggccccgacggcguggccggcagccccgacgccuggguguga

SEQ ID NO: 2084 - RNA, 543 nt, Artificial Sequence
  derived and/or modified sequence opt5 from kallikrein-2__Homo_sapiens__AAR10468
augugggaccuggugcucagcaucgcccuguccgucggcugcaccggggcuguuccccuuauucagucuagaaucgugggaggcugggagugugaaaagcacagccaaccuuggcaaguggccgucuacucccaugggugggcgcacugcggaggcgugcugguucauccgcagugggugcucacagcugcccacugucugaaaaagaacucucaggucuggcuugggcggcauaaucuguucgagcccgaagauacgggacagcgcgugccuguuagccacuccuuuccccacccucucuauaacaugucucugcugaaacaucagagccucagacccgacgaggauuccagccacgaccugaugcuucugcggcucucugaaccugccaagauuaccgauguggucaaagugcugggccuuccgacacaggagcccgcucugggcaccacaugcuacgccuccggguggggaagcaucgagccugaagaguguacccccggcccugacgggguggcuggaucucccgaugccugggucuga

SEQ ID NO: 2085 - protein, 254 aa, Artificial Sequence
  kallikrein-4__Homo_sapiens__A0A0C4DFQ5
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 2086 - RNA, 765 nt, Artificial Sequence
  kallikrein-4__Homo_sapiens__EAW71943
auggccacagcaggaaaucccuggggcugguuccugggguaccucauccuuggugucgcaggaucgcucgucucugguagcugcagccaaaucauaaacggcgaggacugcagcccgcacucgcagcccuggcaggcggcacuggucauggaaaacgaauuguucugcucgggcguccuggugcauccgcagugggugcugucagccgcacacuguuuccagaacuccuacaccaucgggcugggccugcacagucuugaggccgaccaagagccagggagccagaugguggaggccagccucuccguacggcacccagaguacaacagacccuugcucgcuaacgaccucaugcucaucaaguuggacgaauccguguccgagucugacaccauccggagcaucagcauugcuucgcagugcccuaccgcggggaacucuugccucguuucuggcuggggucugcuggcgaacggcagaaugccuaccgugcugcagugcgugaacgugucgguggugucugaggaggucugcaguaagcucuaugacccgcuguaccaccccagcauguucugcgccggcggagggcaagaccagaaggacuccugcaacggugacucuggggggccccugaucugcaacggguacuugcagggccuugugucuuucggaaaagccccguguggccaaguuggcgugccaggugucuacaccaaccucugcaaauucacugaguggauagagaaaaccguccaggccaguuaa

SEQ ID NO: 2087 - RNA, 765 nt, Artificial Sequence
  derived and/or modified sequence opt1 from kallikrein-4__Homo_sapiens__EAW71943
auggccaccgccggcaaccccugggggugguuccugggcuaccucauccuggggguggcgggcagccuggucuccgggagcugcucccagaucaucaacggcgaggacugcagcccgcacucccagcccuggcaggccgcccucgugauggagaacgagcuguucugcagcggcgugcugguccacccccagugggugcucuccgccgcccacugcuuccagaacagcuacaccaucgggcugggccugcacucccucgaggcggaccaggagcccgggagccagaugguggaggccucccugagcguccgccacccggaguacaaccggccccugcucgccaacgaccugaugcugaucaagcucgacgaguccgugagcgaguccgacacgauccgcagcaucuccaucgccagccagugccccaccgcgggcaacuccugccuggugagcggguggggccugcucgccaacggccggaugcccaccguccugcagugcgugaacgugagcgucguguccgaggaggugugcagcaagcuguacgacccgcucuaccaccccuccauguucugcgccgggggcgggcaggaccagaaggacagcugcaacggcgacuccggcgggccccugaucugcaacggcuaccugcaggggcucgucagcuucggcaaggcccccugcggccaggugggggugccgggcgucuacaccaaccugugcaaguucacggaguggaucgagaagaccgugcaggccuccuga

SEQ ID NO: 2088 - RNA, 765 nt, Artificial Sequence
  derived and/or modified sequence opt2 from kallikrein-4__Homo_sapiens__EAW71943
auggccaccgccggcaaccccuggggcugguuccucggcuaccucauccucggcgucgccggcucccucgucuccggcuccugcucccagaucaucaacggcgaggacugcuccccccacucccagcccuggcaggccgcccucgucauggagaacgagcucuucugcuccggcguccucguccacccccaguggguccucuccgccgcccacugcuuccagaacuccuacaccaucggccucggccuccacucccucgaggccgaccaggagcccggcucccagauggucgaggccucccucuccguccgccaccccgaguacaaccgcccccuccucgccaacgaccucaugcucaucaagcucgacgaguccgucuccgaguccgacaccauccgcuccaucuccaucgccucccagugccccaccgccggcaacuccugccucgucuccggcuggggccuccucgccaacggccgcaugcccaccguccuccagugcgucaacgucuccgucgucuccgaggaggucugcuccaagcucuacgacccccucuaccaccccuccauguucugcgccggcggcggccaggaccagaaggacuccugcaacggcgacuccggcggcccccucaucugcaacggcuaccuccagggccucgucuccuucggcaaggcccccugcggccaggucggcguccccggcgucuacaccaaccucugcaaguucaccgaguggaucgagaagaccguccaggccuccuga

SEQ ID NO: 2089 - RNA, 765 nt, Artificial Sequence
  derived and/or modified sequence opt3 from kallikrein-4__Homo_sapiens__EAW71943
auggccaccgcuggcaaccccugggggugguuccugggauaccucauccuugguguggcaggcagccuggucuccgggucuugcucacagauuauaaauggagaggacuguaguccucacagccaaccauggcaggccgcguugguuauggaaaacgaguuauuuugcuccggcgugcugguacauccgcagugggugcuaucugcugcccacuguuuccaaaauucguauacaaucggucucgggcugcauucacuugaagcagaucaggagcccggaagccagauggucgaagccagucuguccgugagacacccugaguacaacaggccauugcucgcuaaugaccugaugcugauuaagcucgaugagucuguuagcgaauccgacacuauccggucaauuaguaucgcaagccagugccccacggccggcaacucuuguuuaguguccggcugggggcugcuugcuaauggacgcaugccuaccgucuugcagugcgugaacguaucaguugugagcgaggaagucuguaguaaacuguaugauccacuauaccaucccucuauguuuugcgccgguggcgggcaagaccagaaggauuccuguaauggagacagcggcgguccucucauaugcaacggguaucugcagggacuugugucguucggcaaagcgccauguggccaggugggggucccgggaguuuacacaaaucugugcaaguuuacugaguggaucgagaaaaccgugcaagcaucuuga

SEQ ID NO: 2090 - RNA, 765 nt, Artificial Sequence
  derived and/or modified sequence opt4 from kallikrein-4__Homo_sapiens__EAW71943
auggccaccgccggcaaccccuggggcugguuccugggcuaccugauccugggcguggccggcagccuggugagcggcagcugcagccagaucaucaacggcgaggacugcagcccccacagccagcccuggcaggccgcccuggugauggagaacgagcuguucugcagcggcgugcuggugcacccccagugggugcugagcgccgcccacugcuuccagaacagcuacaccaucggccugggccugcacagccuggaggccgaccaggagcccggcagccagaugguggaggccagccugagcgugagacaccccgaguacaacagaccccugcuggccaacgaccugaugcugaucaagcuggacgagagcgugagcgagagcgacaccaucagaagcaucagcaucgccagccagugccccaccgccggcaacagcugccuggugagcggcuggggccugcuggccaacggcagaaugcccaccgugcugcagugcgugaacgugagcguggugagcgaggaggugugcagcaagcuguacgacccccuguaccaccccagcauguucugcgccggcggcggccaggaccagaaggacagcugcaacggcgacagcggcggcccccugaucugcaacggcuaccugcagggccuggugagcuucggcaaggcccccugcggccaggugggcgugcccggcguguacaccaaccugugcaaguucaccgaguggaucgagaagaccgugcaggccagcuga

SEQ ID NO: 2091 - RNA, 765 nt, Artificial Sequence
  derived and/or modified sequence opt5 from kallikrein-4__Homo_sapiens__EAW71943
auggccaccgcuggcaaccccugggggugguuccugggauaccucauccugggcguggccgggagccuugucuccggaucuugcagccagauuaucaauggcgaggacuguuccccucacucucaaccguggcaggcggcucugguuauggaaaacgagcucuuuugcagcggggugcuggugcauccccaguggguccuuuccgccgcccacuguuuccaaaauucuuauacaauuggacugggccuccauagccuggaagcugaucaggagccuggcucccagaugguggaagccagccugucuguuagacaccccgaguacaaccggccucuccuggcuaaugaccuuaugcugaucaagcucgaugaguccgugagcgaaucugacacgauucgcuccaucagcaucgccucucagugccccaccgcggggaacuccugucuggucagcggauggggccuucuggccaaugggagaaugccuacagugcuccagugcguuaacguguccgucgugucugaggaaguguguagcaaacuguaugauccgcuguaccaucccuccauguuuugcgcuggaggcgggcaagaccagaaggauagcuguaauggagacucuggcggcccucucauuugcaacggguaucugcagggacuugucuccuucggcaaagcccccugugggcagguuggagugccuggcguguacaccaaucugugcaaguuuacagaguggaucgagaaaaccguccaagcuagcuga

SEQ ID NO: 2092 - protein, 75 aa, Artificial Sequence
  kallikrein-4__Homo_sapiens__Q5BQA0
MATAGNPWGWFLGYLILGVAGSLVSGSCSQIINGEDCSPHSQPWQAALVMENELFCSGVLVHPQWVLSAAHCFQK

SEQ ID NO: 2093 - RNA, 228 nt, Artificial Sequence
  kallikrein-4__Homo_sapiens__AAX30051
auggccacagcaggaaaucccuggggcugguuccugggguaccucauccuuggugucgcaggaucgcucgucucugguagcugcagccaaaucauaaacggcgaggacugcagcccgcacucgcagcccuggcaggcggcacuggucauggaaaacgaauuguucugcucgggcguccuggugcauccgcagugggugcugucagccgcacacuguuuccagaaguga

SEQ ID NO: 2094 - RNA, 228 nt, Artificial Sequence
  derived and/or modified sequence opt1 from kallikrein-4__Homo_sapiens__AAX30051
auggccaccgccggcaaccccugggggugguuccugggcuaccucauccuggggguggcgggcagccuggucuccgggagcugcucccagaucaucaacggcgaggacugcagcccgcacucccagcccuggcaggccgcccucgugauggagaacgagcuguucugcagcggcgugcugguccacccccagugggugcucuccgccgcccacugcuuccagaaguga

SEQ ID NO: 2095 - RNA, 228 nt, Artificial Sequence
  derived and/or modified sequence opt2 from kallikrein-4__Homo_sapiens__AAX30051
auggccaccgccggcaaccccuggggcugguuccucggcuaccucauccucggcgucgccggcucccucgucuccggcuccugcucccagaucaucaacggcgaggacugcuccccccacucccagcccuggcaggccgcccucgucauggagaacgagcucuucugcuccggcguccucguccacccccaguggguccucuccgccgcccacugcuuccagaaguga

SEQ ID NO: 2096 - RNA, 228 nt, Artificial Sequence
  derived and/or modified sequence opt3 from kallikrein-4__Homo_sapiens__AAX30051
auggccaccgcuggcaaccccugggggugguuccugggauaccucauccuugguguggcaggcagccuggucuccgggucuugcucacagauuauaaauggagaggacuguaguccucacagccaaccauggcaggccgcguugguuauggaaaacgaguuauuuugcuccggcgugcugguacauccgcagugggugcuaucugcugcccacuguuuccagaaguga

SEQ ID NO: 2097 - RNA, 228 nt, Artificial Sequence
  derived and/or modified sequence opt4 from kallikrein-4__Homo_sapiens__AAX30051
auggccaccgccggcaaccccuggggcugguuccugggcuaccugauccugggcguggccggcagccuggugagcggcagcugcagccagaucaucaacggcgaggacugcagcccccacagccagcccuggcaggccgcccuggugauggagaacgagcuguucugcagcggcgugcuggugcacccccagugggugcugagcgccgcccacugcuuccagaaguga

SEQ ID NO: 2098 - RNA, 228 nt, Artificial Sequence
  derived and/or modified sequence opt5 from kallikrein-4__Homo_sapiens__AAX30051
auggccaccgcuggcaaccccugggggugguuccugggauaccucauccugggcguggccgggagccuugucuccggaucuugcagccagauuaucaauggcgaggacuguuccccucacucucaaccguggcaggcggcucugguuauggaaaacgagcucuuuugcagcggggugcuggugcauccccaguggguccuuuccgccgcccacuguuuccagaaguga

SEQ ID NO: 2099 - protein, 195 aa, Artificial Sequence
  kallikrein-4__Homo_sapiens__Q96PT0
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGELTGVCLPSSRRSSAQSRGLTQSSASQAECLPCCSA

SEQ ID NO: 2100 - RNA, 588 nt, Artificial Sequence
  kallikrein-4__Homo_sapiens__AAL14782
auggccacagcaggaaaucccuggggcugguuccugggguaccucauccuuggugucgcaggaucucucgucucugguagcugcagccaaaucauaaacggcgaggacugcagcccgcacucgcagcccuggcaggcggcacuggucauggaaaacgaauuguucugcucgggcguccuggugcauccgcagugggugcugucagccgcacacuguuuccagaacuccuacaccaucgggcugggccugcacagucuugaggccgaccaagagccagggagccagaugguggaggccagccucuccguacggcacccagaguacaacagacccuugcucgcuaacgaccucaugcucaucaaguuggacgaauccguguccgagucugacaccauccggagcaucagcauugcuucgcagugcccuaccgcggggaacucuugccucguuucuggcuggggucugcuggcgaacggugagcucacgggugugugucugcccucuucaaggagguccucugcccagucgcgggggcugacccagagcucugcgucccaggcagaaugccuaccgugcugcagugcguga

SEQ ID NO: 2101 - RNA, 588 nt, Artificial Sequence
  derived and/or modified sequence opt1 from kallikrein-4__Homo_sapiens__AAL14782
auggccaccgccggcaaccccugggggugguuccugggcuaccucauccuggggguggcgggcagccuggucuccgggagcugcucccagaucaucaacggcgaggacugcagcccgcacucccagcccuggcaggccgcccucgugauggagaacgagcuguucugcagcggcgugcugguccacccccagugggugcucuccgccgcccacugcuuccagaacagcuacaccaucgggcugggccugcacucccucgaggcggaccaggagcccgggagccagaugguggaggccucccugagcguccgccacccggaguacaaccggccccugcucgccaacgaccugaugcugaucaagcucgacgaguccgugagcgaguccgacacgauccgcagcaucuccaucgccagccagugccccaccgcgggcaacuccugccuggugagcggguggggccugcucgccaacggcgagcugaccggggucugccugcccagcucccggcgcagcuccgcccagagccggggccucacccaguccagcgccucccaggccgagugccugccgugcugcagcgcguga

SEQ ID NO: 2102 - RNA, 588 nt, Artificial Sequence
  derived and/or modified sequence opt2 from kallikrein-4__Homo_sapiens__AAL14782
auggccaccgccggcaaccccuggggcugguuccucggcuaccucauccucggcgucgccggcucccucgucuccggcuccugcucccagaucaucaacggcgaggacugcuccccccacucccagcccuggcaggccgcccucgucauggagaacgagcucuucugcuccggcguccucguccacccccaguggguccucuccgccgcccacugcuuccagaacuccuacaccaucggccucggccuccacucccucgaggccgaccaggagcccggcucccagauggucgaggccucccucuccguccgccaccccgaguacaaccgcccccuccucgccaacgaccucaugcucaucaagcucgacgaguccgucuccgaguccgacaccauccgcuccaucuccaucgccucccagugccccaccgccggcaacuccugccucgucuccggcuggggccuccucgccaacggcgagcucaccggcgucugccuccccuccucccgccgcuccuccgcccagucccgcggccucacccaguccuccgccucccaggccgagugccuccccugcugcuccgccuga

SEQ ID NO: 2103 - RNA, 588 nt, Artificial Sequence
  derived and/or modified sequence opt3 from kallikrein-4__Homo_sapiens__AAL14782
auggccaccgcuggcaaccccugggggugguuccugggauaccucauccuugguguggcaggcagccuggucuccgggucuugcucacagauuauaaauggagaggacuguaguccucacagccaaccauggcaggccgcguugguuauggaaaacgaguuauuuugcuccggcgugcugguacauccgcagugggugcuaucugcugcccacuguuuccaaaauucguauacaaucggucucgggcugcauucacuugaagcagaucaggagcccggaagccagauggucgaagccagucuguccgugagacacccugaguacaacaggccauugcucgcuaaugaccugaugcugauuaagcucgaugagucuguuagcgaauccgacacuauccggucaauuaguaucgcaagccagugccccacggccggcaacucuuguuuaguguccggcugggggcugcuugcuaauggagaguugaccggugucugccugccuucaagccgccgaaguucugcccagucccguggccuaacacaaagcucggcgucucaggcagaaugucucccaugcuguuccgccuga

SEQ ID NO: 2104 - RNA, 588 nt, Artificial Sequence
  derived and/or modified sequence opt4 from kallikrein-4__Homo_sapiens__AAL14782
auggccaccgccggcaaccccuggggcugguuccugggcuaccugauccugggcguggccggcagccuggugagcggcagcugcagccagaucaucaacggcgaggacugcagcccccacagccagcccuggcaggccgcccuggugauggagaacgagcuguucugcagcggcgugcuggugcacccccagugggugcugagcgccgcccacugcuuccagaacagcuacaccaucggccugggccugcacagccuggaggccgaccaggagcccggcagccagaugguggaggccagccugagcgugagacaccccgaguacaacagaccccugcuggccaacgaccugaugcugaucaagcuggacgagagcgugagcgagagcgacaccaucagaagcaucagcaucgccagccagugccccaccgccggcaacagcugccuggugagcggcuggggccugcuggccaacggcgagcugaccggcgugugccugcccagcagcagaagaagcagcgcccagagcagaggccugacccagagcagcgccagccaggccgagugccugcccugcugcagcgccuga

SEQ ID NO: 2105 - RNA, 588 nt, Artificial Sequence
  derived and/or modified sequence opt5 from kallikrein-4__Homo_sapiens__AAL14782
auggccaccgcuggcaaccccugggggugguuccugggauaccucauccugggcguggccgggagccuugucuccggaucuugcagccagauuaucaauggcgaggacuguuccccucacucucaaccguggcaggcggcucugguuauggaaaacgagcucuuuugcagcggggugcuggugcauccccaguggguccuuuccgccgcccacuguuuccaaaauucuuauacaauuggacugggccuccauagccuggaagcugaucaggagccuggcucccagaugguggaagccagccugucuguuagacaccccgaguacaaccggccucuccuggcuaaugaccuuaugcugaucaagcucgaugaguccgugagcgaaucugacacgauucgcuccaucagcaucgccucucagugccccaccgcggggaacuccugucuggucagcggauggggccuucuggccaauggggagcucacaggagugugccugccuuccucuagacggagcuccgcucagagccgcggccugacccaaucuuccgccagccaggcugaaugucucccgugcuguucugccuga

SEQ ID NO: 2106 - protein, 159 aa, Artificial Sequence
  kallikrein-4__Homo_sapiens__Q96PT1
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANG

SEQ ID NO: 2107 - RNA, 480 nt, Artificial Sequence
  kallikrein-4__Homo_sapiens__AAL14781
auggccacagcaggaaaucccuggggcugguuccugggguaccucauccuuggugucgcaggaucucucgucucugguagcugcagccaaaucauaaacggcgaggacugcagcccgcacucgcagcccuggcaggcggcacuggucauggaaaacgaauuguucugcucgggcguccuggugcauccgcagugggugcugucagccgcacacuguuuccagaacuccuacaccaucgggcugggccugcacagucuugaggccgaccaagagccagggagccagaugguggaggccagccucuccguacggcacccagaguacaacagacccuugcucgcuaacgaccucaugcucaucaaguuggacgaauccguguccgagucugacaccauccggagcaucagcauugcuucgcagugcccuaccgcggggaacucuugccucguuucuggcuggggucugcuggcgaacggguga

SEQ ID NO: 2108 - RNA, 480 nt, Artificial Sequence
  derived and/or modified sequence opt1 from kallikrein-4__Homo_sapiens__AAL14781
auggccaccgccggcaaccccugggggugguuccugggcuaccucauccuggggguggcgggcagccuggucuccgggagcugcucccagaucaucaacggcgaggacugcagcccgcacucccagcccuggcaggccgcccucgugauggagaacgagcuguucugcagcggcgugcugguccacccccagugggugcucuccgccgcccacugcuuccagaacagcuacaccaucgggcugggccugcacucccucgaggcggaccaggagcccgggagccagaugguggaggccucccugagcguccgccacccggaguacaaccggccccugcucgccaacgaccugaugcugaucaagcucgacgaguccgugagcgaguccgacacgauccgcagcaucuccaucgccagccagugccccaccgcgggcaacuccugccuggugagcggguggggccugcucgccaacggcuga

SEQ ID NO: 2109 - RNA, 480 nt, Artificial Sequence
  derived and/or modified sequence opt2 from kallikrein-4__Homo_sapiens__AAL14781
auggccaccgccggcaaccccuggggcugguuccucggcuaccucauccucggcgucgccggcucccucgucuccggcuccugcucccagaucaucaacggcgaggacugcuccccccacucccagcccuggcaggccgcccucgucauggagaacgagcucuucugcuccggcguccucguccacccccaguggguccucuccgccgcccacugcuuccagaacuccuacaccaucggccucggccuccacucccucgaggccgaccaggagcccggcucccagauggucgaggccucccucuccguccgccaccccgaguacaaccgcccccuccucgccaacgaccucaugcucaucaagcucgacgaguccgucuccgaguccgacaccauccgcuccaucuccaucgccucccagugccccaccgccggcaacuccugccucgucuccggcuggggccuccucgccaacggcuga

SEQ ID NO: 2110 - RNA, 480 nt, Artificial Sequence
  derived and/or modified sequence opt3 from kallikrein-4__Homo_sapiens__AAL14781
auggccaccgcuggcaaccccugggggugguuccugggauaccucauccuugguguggcaggcagccuggucuccgggucuugcucacagauuauaaauggagaggacuguaguccucacagccaaccauggcaggccgcguugguuauggaaaacgaguuauuuugcuccggcgugcugguacauccgcagugggugcuaucugcugcccacuguuuccaaaauucguauacaaucggucucgggcugcauucacuugaagcagaucaggagcccggaagccagauggucgaagccagucuguccgugagacacccugaguacaacaggccauugcucgcuaaugaccugaugcugauuaagcucgaugagucuguuagcgaauccgacacuauccggucaauuaguaucgcaagccagugccccacggccggcaacucuuguuuaguguccggcugggggcugcuugcuaauggauga

SEQ ID NO: 2111 - RNA, 480 nt, Artificial Sequence
  derived and/or modified sequence opt4 from kallikrein-4__Homo_sapiens__AAL14781
auggccaccgccggcaaccccuggggcugguuccugggcuaccugauccugggcguggccggcagccuggugagcggcagcugcagccagaucaucaacggcgaggacugcagcccccacagccagcccuggcaggccgcccuggugauggagaacgagcuguucugcagcggcgugcuggugcacccccagugggugcugagcgccgcccacugcuuccagaacagcuacaccaucggccugggccugcacagccuggaggccgaccaggagcccggcagccagaugguggaggccagccugagcgugagacaccccgaguacaacagaccccugcuggccaacgaccugaugcugaucaagcuggacgagagcgugagcgagagcgacaccaucagaagcaucagcaucgccagccagugccccaccgccggcaacagcugccuggugagcggcuggggccugcuggccaacggcuga

SEQ ID NO: 2112 - RNA, 480 nt, Artificial Sequence
  derived and/or modified sequence opt5 from kallikrein-4__Homo_sapiens__AAL14781
auggccaccgcuggcaaccccugggggugguuccugggauaccucauccugggcguggccgggagccuugucuccggaucuugcagccagauuaucaauggcgaggacuguuccccucacucucaaccguggcaggcggcucugguuauggaaaacgagcucuuuugcagcggggugcuggugcauccccaguggguccuuuccgccgcccacuguuuccaaaauucuuauacaauuggacugggccuccauagccuggaagcugaucaggagccuggcucccagaugguggaagccagccugucuguuagacaccccgaguacaaccggccucuccuggcuaaugaccuuaugcugaucaagcucgaugaguccgugagcgaaucugacacgauucgcuccaucagcaucgccucucagugccccaccgcggggaacuccugucuggucagcggauggggccuucuggccaauggguga

SEQ ID NO: 2113 - protein, 254 aa, Artificial Sequence
  kallikrein-4__Homo_sapiens__Q9Y5K2
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGHDQKDSCNGDSGGPLICNGYLQGLVSFGKAPCGQVGVPGVYTNLCKFTEWIEKTVQAS

SEQ ID NO: 2114 - RNA, 765 nt, Artificial Sequence
  kallikrein-4__Homo_sapiens__AAD21580
auggccacagcaggaaaucccuggggcugguuccugggguaccucauccuuggugucgcaggaucgcucgucucugguagcugcagccaaaucauaaacggcgaggacugcagcccgcacucgcagcccuggcaggcggcacuggucauggaaaacgaauuguucugcucgggcguccuggugcauccgcagugggugcugucagccgcacacuguuuccagaacuccuacaccaucgggcugggccugcacagucuugaggccgaccaagagccagggagccagaugguggaggccagccucuccguacggcacccagaguacaacagacccuugcucgcuaacgaccucaugcucaucaaguuggacgaauccguguccgagucugacaccauccggagcaucagcauugcuucgcagugcccuaccgcggggaacucuugccucguuucuggcuggggucugcuggcgaacggcagaaugccuaccgugcugcagugcgugaacgugucgguggugucugaggaggucugcaguaagcucuaugacccgcuguaccaccccagcauguucugcgccggcggagggcacgaccagaaggacuccugcaacggugacucuggggggccccugaucugcaacggguacuugcagggccuugugucuuucggaaaagccccguguggccaaguuggcgugccaggugucuacaccaaccucugcaaauucacugaguggauagagaaaaccguccaggccaguuaa

SEQ ID NO: 2115 - RNA, 765 nt, Artificial Sequence
  derived and/or modified sequence opt1 from kallikrein-4__Homo_sapiens__AAD21580
auggccaccgccggcaaccccugggggugguuccugggcuaccucauccuggggguggcgggcagccuggucuccgggagcugcucccagaucaucaacggcgaggacugcagcccgcacucccagcccuggcaggccgcccucgugauggagaacgagcuguucugcagcggcgugcugguccacccccagugggugcucuccgccgcccacugcuuccagaacagcuacaccaucgggcugggccugcacucccucgaggcggaccaggagcccgggagccagaugguggaggccucccugagcguccgccacccggaguacaaccggccccugcucgccaacgaccugaugcugaucaagcucgacgaguccgugagcgaguccgacacgauccgcagcaucuccaucgccagccagugccccaccgcgggcaacuccugccuggugagcggguggggccugcucgccaacggccggaugcccaccguccugcagugcgugaacgugagcgucguguccgaggaggugugcagcaagcuguacgacccgcucuaccaccccuccauguucugcgccgggggcgggcacgaccagaaggacagcugcaacggcgacuccggcgggccccugaucugcaacggcuaccugcaggggcucgucagcuucggcaaggcccccugcggccaggugggggugccgggcgucuacaccaaccugugcaaguucacggaguggaucgagaagaccgugcaggccuccuga

SEQ ID NO: 2116 - RNA, 765 nt, Artificial Sequence
  derived and/or modified sequence opt2 from kallikrein-4__Homo_sapiens__AAD21580
auggccaccgccggcaaccccuggggcugguuccucggcuaccucauccucggcgucgccggcucccucgucuccggcuccugcucccagaucaucaacggcgaggacugcuccccccacucccagcccuggcaggccgcccucgucauggagaacgagcucuucugcuccggcguccucguccacccccaguggguccucuccgccgcccacugcuuccagaacuccuacaccaucggccucggccuccacucccucgaggccgaccaggagcccggcucccagauggucgaggccucccucuccguccgccaccccgaguacaaccgcccccuccucgccaacgaccucaugcucaucaagcucgacgaguccgucuccgaguccgacaccauccgcuccaucuccaucgccucccagugccccaccgccggcaacuccugccucgucuccggcuggggccuccucgccaacggccgcaugcccaccguccuccagugcgucaacgucuccgucgucuccgaggaggucugcuccaagcucuacgacccccucuaccaccccuccauguucugcgccggcggcggccacgaccagaaggacuccugcaacggcgacuccggcggcccccucaucugcaacggcuaccuccagggccucgucuccuucggcaaggcccccugcggccaggucggcguccccggcgucuacaccaaccucugcaaguucaccgaguggaucgagaagaccguccaggccuccuga

SEQ ID NO: 2117 - RNA, 765 nt, Artificial Sequence
  derived and/or modified sequence opt3 from kallikrein-4__Homo_sapiens__AAD21580
auggccaccgcuggcaaccccugggggugguuccugggauaccucauccuugguguggcaggcagccuggucuccgggucuugcucacagauuauaaauggagaggacuguaguccucacagccaaccauggcaggccgcguugguuauggaaaacgaguuauuuugcuccggcgugcugguacauccgcagugggugcuaucugcugcccacuguuuccaaaauucguauacaaucggucucgggcugcauucacuugaagcagaucaggagcccggaagccagauggucgaagccagucuguccgugagacacccugaguacaacaggccauugcucgcuaaugaccugaugcugauuaagcucgaugagucuguuagcgaauccgacacuauccggucaauuaguaucgcaagccagugccccacggccggcaacucuuguuuaguguccggcugggggcugcuugcuaauggacgcaugccuaccgucuugcagugcgugaacguaucaguugugagcgaggaagucuguaguaaacuguaugauccacuauaccaucccucuauguuuugcgccgguggcgggcacgaccaaaaggauuccuguaauggagacagcggcgguccucucauaugcaacggguaucugcagggacuugugucguucggcaaagcgccauguggccaggugggggucccgggaguuuacacaaaucugugcaaguuuacugaguggaucgagaaaaccgugcaggcaucuuga

SEQ ID NO: 2118 - RNA, 765 nt, Artificial Sequence
  derived and/or modified sequence opt4 from kallikrein-4__Homo_sapiens__AAD21580
auggccaccgccggcaaccccuggggcugguuccugggcuaccugauccugggcguggccggcagccuggugagcggcagcugcagccagaucaucaacggcgaggacugcagcccccacagccagcccuggcaggccgcccuggugauggagaacgagcuguucugcagcggcgugcuggugcacccccagugggugcugagcgccgcccacugcuuccagaacagcuacaccaucggccugggccugcacagccuggaggccgaccaggagcccggcagccagaugguggaggccagccugagcgugagacaccccgaguacaacagaccccugcuggccaacgaccugaugcugaucaagcuggacgagagcgugagcgagagcgacaccaucagaagcaucagcaucgccagccagugccccaccgccggcaacagcugccuggugagcggcuggggccugcuggccaacggcagaaugcccaccgugcugcagugcgugaacgugagcguggugagcgaggaggugugcagcaagcuguacgacccccuguaccaccccagcauguucugcgccggcggcggccacgaccagaaggacagcugcaacggcgacagcggcggcccccugaucugcaacggcuaccugcagggccuggugagcuucggcaaggcccccugcggccaggugggcgugcccggcguguacaccaaccugugcaaguucaccgaguggaucgagaagaccgugcaggccagcuga

SEQ ID NO: 2119 - RNA, 765 nt, Artificial Sequence
  derived and/or modified sequence opt5 from kallikrein-4__Homo_sapiens__AAD21580
auggccaccgcuggcaaccccugggggugguuccugggauaccucauccugggcguggccgggagccuugucuccggaucuugcagccagauuaucaauggcgaggacuguuccccucacucucaaccguggcaggcggcucugguuauggaaaacgagcucuuuugcagcggggugcuggugcauccccaguggguccuuuccgccgcccacuguuuccaaaauucuuauacaauuggacugggccuccauagccuggaagcugaucaggagccuggcucccagaugguggaagccagccugucuguuagacaccccgaguacaaccggccucuccuggcuaaugaccuuaugcugaucaagcucgaugaguccgugagcgaaucugacacgauucgcuccaucagcaucgccucucagugccccaccgcggggaacuccugucuggucagcggauggggccuucuggccaaugggagaaugccuacagugcuccagugcguuaacguguccgucgugucugaggaaguguguagcaaacuguaugauccgcuguaccaucccuccauguuuugcgcuggaggcgggcacgaccaaaaggauagcuguaauggagacucuggcggcccucucauuugcaacggguaucugcagggacuugucuccuucggcaaagcccccugugggcagguuggagugccuggcguguacaccaaucugugcaaguuuacagaguggaucgagaaaaccguccaggcuagcuga

SEQ ID NO: 2120 - protein, 890 aa, Artificial Sequence
  KI20A__Homo_sapiens__O95235
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 2121 - RNA, 2673 nt, Artificial Sequence
  KI20A__Homo_sapiens__AAC83230
augucgcaagggauccuuucuccgccagcgggcuugcuguccgaugacgaugucguaguuucucccauguuugaguccacagcugcagauuuggggucugugguacgcaagaaccugcuaucagacugcucugucgucucuaccucccuagaggacaagcagcagguuccaucugaggacaguauggagaaggugaaaguauacuugaggguuaggcccuuguuaccuucagaguuggaacgacaggaagaucaggguuguguccguauugagaauguggagacccuuguucuacaagcacccaaggacucguuugcccugaagagcaaugaacggggaauuggccaagccacacacagguucaccuuuucccagaucuuugggccagaagugggacaggcauccuucuucaaccuaacugugaaggagaugguaaaggauguacucaaagggcagaacuggcucaucuauacauauggagucacuaacucagggaaaacccacacgauucaagguaccaucaaggauggagggauucucccccggucccuggcgcugaucuucaauagccuccaaggccaacuucauccaacaccugaucugaagcccuugcucuccaaugagguaaucuggcuagacagcaagcagauccgacaggaggaaaugaagaagcugucccugcuaaauggaggccuccaagaggaggagcuguccacuuccuugaagaggagugucuacaucgaaagucggauagguaccagcaccagcuucgacaguggcauugcugggcucucuucuaucagucaguguaccagcaguagccagcuggaugaaacaagucaucgaugggcacagccagacacugccccacuaccugucccggcaaacauucgcuucuccaucuggaucucauucuuugagaucuacaacgaacugcuuuaugaccuauuagaaccgccuagccaacagcgcaagaggcagacuuugcggcuaugcgaggaucaaaauggcaaucccuaugugaaagaucucaacuggauucaugugcaagaugcugaggaggccuggaagcuccuaaaagugggucguaagaaccagagcuuugccagcacccaccucaaccagaacuccagccgcagucacagcaucuucucaaucaggauccuacaccuucagggggaaggagauauaguccccaagaucagcgagcugucacucugugaucuggcuggcucagagcgcugcaaagaucagaagaguggugaacgguugaaggaagcaggaaacauuaacaccucucuacacacccugggccgcuguauugcugcccuucgucaaaaccagcagaaccggucaaagcagaaccugguucccuuccgugacagcaaguugacucgaguguuccaagguuucuucacaggccgaggccguuccugcaugauugucaaugugaaucccugugcaucuaccuaugaugaaacucuucauguggccaaguucucagccauugcuagccagcuugugcaugccccaccuaugcaacugggauucccaucccugcacucguucaucaaggaacauagucuucagguaucccccagcuuagagaaaggggcuaaggcagacacaggccuugaugaugauauugaaaaugaagcugacaucuccauguauggcaaagaggagcuccuacaaguuguggaagccaugaagacacugcuuuugaaggaacgacaggaaaagcuacagcuggagaugcaucuccgagaugaaauuugcaaugagaugguagaacagaugcaacagcgggaacaguggugcagugaacauuuggacacccaaaaggaacuauuggaggaaauguaugaagaaaaacuaaauauccucaaggagucacugacaaguuuuuaccaagaagagauucaggagcgggaugaaaagauugaagagcuagaagcucucuugcaggaagccagacaacagucaguggcccaucagcaaucagggucugaauuggcccuacggcggucacaaagguuggcagcuucugccuccacccagcagcuucaggagguuaaagcuaaauuacagcagugcaaagcagagcuaaacucuaccacugaagaguugcauaaguaucagaaaauguuagaaccaccacccucagccaagcccuucaccauugauguggacaagaaguuagaagagggccagaagaauauaaggcuguugcggacagagcuucagaaacuuggugagucucuccaaucagcagagagagcuuguugccacagcacuggggcaggaaaacuucgucaagccuugaccacuugugaugacaucuuaaucaaacaggaccagacucuggcugaacugcagaacaacauggugcuagugaaacuggaccuucggaagaaggcagcauguauugcugagcaguaucauacuguguugaaacuccaaggccagguuucugccaaaaagcgccuugguaccaaccaggaaaaucagcaaccaaaccaacaaccaccagggaagaaaccauuccuucgaaauuuacuuccccgaacaccaaccugccaaagcucaacagacugcagcccuuaugcccggauccuacgcucacggcguuccccuuuacucaaaucugggccuuuuggcaaaaaguacuaa

SEQ ID NO: 2122 - RNA, 2673 nt, Artificial Sequence
  derived and/or modified sequence opt1 from KI20A__Homo_sapiens__AAC83230
augagccagggcauccuguccccgcccgccgggcuccugagcgacgacgacguggucgugucccccauguucgagagcaccgccgcggaccugggcuccgugguccgcaagaaccuccugagcgacugcuccguggugagcaccucccuggaggacaagcagcagguccccagcgaggacuccauggagaaggugaagguguaccuccggguccgcccccugcugccgagcgagcucgagcggcaggaggaccaggggugcgugcgcaucgagaacguggagacgcugguccugcaggcccccaaggacuccuucgcccucaagagcaacgagcggggcaucgggcaggccacccaccgcuucaccuucucccagaucuucggccccgaggugggccaggccagcuucuucaaccugaccgugaaggagauggucaaggacgugcugaaggggcagaacuggcucaucuacacguacggcgugaccaacuccgggaagacccacaccauccagggcacgaucaaggacgggggcauccugccccggagccuggcgcucaucuucaacucccugcagggccagcugcacccgacccccgaccucaagccccugcugagcaacgaggucaucuggcucgacagcaagcagauccgccaggaggagaugaagaagcugucccugcucaacgggggccugcaggaggaggagcugagcaccucccucaagcggagcguguacaucgagucccgcaucgggaccagcacguccuucgacagcggcaucgccggccuguccagcaucucccagugcaccagcuccagccagcuggacgagaccucccaccggugggcccagcccgacaccgccccgcuccccgugcccgcgaacauccgcuucagcaucuggaucuccuucuucgagaucuacaacgagcugcuguacgaccuccuggagcccccgagccagcagcggaagcgccagacgcugcggcucugcgaggaccagaacgggaaccccuacgucaaggaccugaacuggauccacgugcaggacgccgaggaggccuggaagcugcucaaggugggccgcaagaaccaguccuucgccagcacccaccugaaccagaacagcucccggagccacuccaucuucagcauccgcauccugcaccuccagggggagggcgacaucguccccaagaucuccgagcugagccugugcgaccucgccggguccgagcggugcaaggaccagaaguccggcgagcgccugaaggaggcgggcaacaucaacaccucccugcacacccuggggcggugcaucgccgcccuccgccagaaccagcagaaccgcagcaagcagaaccuggugcccuuccgggacuccaagcugacgcgcgucuuccagggcuucuucaccgggcggggccgcagcugcaugaucgugaacgugaacccgugcgccuccaccuacgacgagacccuccacgucgccaaguucagcgcgaucgccucccagcuggugcacgccccgcccaugcagcugggguuccccagccuccacuccuucaucaaggagcacagccuccaggugagccccucccuggagaagggcgccaaggccgacacgggccuggacgacgacaucgagaacgaggcggacaucagcauguacgggaaggaggagcugcugcaggucguggaggccaugaagacccuccugcugaaggagcggcaggagaagcuccagcuggagaugcaccuccgcgacgagaucugcaacgagaugguggagcagaugcagcagcgggagcaguggugcuccgagcaccuggacacccagaaggagcugcuggaggagauguacgaggagaagcucaacauccugaaggagagccugaccuccuucuaccaggaggagauccaggagcgcgacgagaagaucgaggagcucgaggcccugcugcaggaggcccggcagcagagcgucgcccaccagcaguccggcagcgagcucgcgcugcgccggucccagcgccuggccgccagcgccuccacgcagcagcuccaggaggugaaggcgaagcugcagcagugcaaggccgagcugaacagcaccaccgaggagcuccacaaguaccagaagaugcuggagcccccgcccuccgccaagcccuucaccaucgacguggacaagaagcuggaggaggggcagaagaacauccggcuccugcgcacggagcugcagaagcucggcgagagccugcaguccgccgagcgggccugcugccacagcaccggggcgggcaagcugcgccaggcccucacgaccugcgacgacauccugaucaagcaggaccagacccuggccgagcuccagaacaacaugguccuggugaagcuggaccuccggaagaaggccgccugcaucgcggagcaguaccacaccgugcugaagcugcagggccaggucuccgccaagaagcgccucgggaccaaccaggagaaccagcagcccaaccagcagcccccgggcaagaagcccuuccugcggaaccugcucccccgcaccccgaccugccagagcuccacggacugcagccccuacgcccgcauccugcggagccgccggagcccccugcucaagagcgggcccuucggcaagaaguacuga

SEQ ID NO: 2123 - RNA, 2673 nt, Artificial Sequence
  derived and/or modified sequence opt2 from KI20A__Homo_sapiens__AAC83230
augucccagggcauccucuccccccccgccggccuccucuccgacgacgacgucgucgucucccccauguucgaguccaccgccgccgaccucggcuccgucguccgcaagaaccuccucuccgacugcuccgucgucuccaccucccucgaggacaagcagcagguccccuccgaggacuccauggagaaggucaaggucuaccuccgcguccgcccccuccuccccuccgagcucgagcgccaggaggaccagggcugcguccgcaucgagaacgucgagacccucguccuccaggcccccaaggacuccuucgcccucaaguccaacgagcgcggcaucggccaggccacccaccgcuucaccuucucccagaucuucggccccgaggucggccaggccuccuucuucaaccucaccgucaaggagauggucaaggacguccucaagggccagaacuggcucaucuacaccuacggcgucaccaacuccggcaagacccacaccauccagggcaccaucaaggacggcggcauccucccccgcucccucgcccucaucuucaacucccuccagggccagcuccaccccacccccgaccucaagccccuccucuccaacgaggucaucuggcucgacuccaagcagauccgccaggaggagaugaagaagcucucccuccucaacggcggccuccaggaggaggagcucuccaccucccucaagcgcuccgucuacaucgagucccgcaucggcaccuccaccuccuucgacuccggcaucgccggccucuccuccaucucccagugcaccuccuccucccagcucgacgagaccucccaccgcugggcccagcccgacaccgccccccuccccguccccgccaacauccgcuucuccaucuggaucuccuucuucgagaucuacaacgagcuccucuacgaccuccucgagccccccucccagcagcgcaagcgccagacccuccgccucugcgaggaccagaacggcaaccccuacgucaaggaccucaacuggauccacguccaggacgccgaggaggccuggaagcuccucaaggucggccgcaagaaccaguccuucgccuccacccaccucaaccagaacuccucccgcucccacuccaucuucuccauccgcauccuccaccuccagggcgagggcgacaucguccccaagaucuccgagcucucccucugcgaccucgccggcuccgagcgcugcaaggaccagaaguccggcgagcgccucaaggaggccggcaacaucaacaccucccuccacacccucggccgcugcaucgccgcccuccgccagaaccagcagaaccgcuccaagcagaaccucguccccuuccgcgacuccaagcucacccgcgucuuccagggcuucuucaccggccgcggccgcuccugcaugaucgucaacgucaaccccugcgccuccaccuacgacgagacccuccacgucgccaaguucuccgccaucgccucccagcucguccacgccccccccaugcagcucggcuuccccucccuccacuccuucaucaaggagcacucccuccaggucucccccucccucgagaagggcgccaaggccgacaccggccucgacgacgacaucgagaacgaggccgacaucuccauguacggcaaggaggagcuccuccaggucgucgaggccaugaagacccuccuccucaaggagcgccaggagaagcuccagcucgagaugcaccuccgcgacgagaucugcaacgagauggucgagcagaugcagcagcgcgagcaguggugcuccgagcaccucgacacccagaaggagcuccucgaggagauguacgaggagaagcucaacauccucaaggagucccucaccuccuucuaccaggaggagauccaggagcgcgacgagaagaucgaggagcucgaggcccuccuccaggaggcccgccagcaguccgucgcccaccagcaguccggcuccgagcucgcccuccgccgcucccagcgccucgccgccuccgccuccacccagcagcuccaggaggucaaggccaagcuccagcagugcaaggccgagcucaacuccaccaccgaggagcuccacaaguaccagaagaugcucgagcccccccccuccgccaagcccuucaccaucgacgucgacaagaagcucgaggagggccagaagaacauccgccuccuccgcaccgagcuccagaagcucggcgagucccuccaguccgccgagcgcgccugcugccacuccaccggcgccggcaagcuccgccaggcccucaccaccugcgacgacauccucaucaagcaggaccagacccucgccgagcuccagaacaacaugguccucgucaagcucgaccuccgcaagaaggccgccugcaucgccgagcaguaccacaccguccucaagcuccagggccaggucuccgccaagaagcgccucggcaccaaccaggagaaccagcagcccaaccagcagccccccggcaagaagcccuuccuccgcaaccuccucccccgcacccccaccugccaguccuccaccgacugcucccccuacgcccgcauccuccgcucccgccgcuccccccuccucaaguccggccccuucggcaagaaguacuga

SEQ ID NO: 2124 - RNA, 2673 nt, Artificial Sequence
  derived and/or modified sequence opt3 from KI20A__Homo_sapiens__AAC83230
augagccagggcauccugucucccccugccgggcuccuuuccgacgaugacguggucguuucaccaauguucgagaguaccgcugcagaucugggaagcgugguaagaaagaacuuguuauccgacugcucuguggucucgacaucacuggaagauaaacaacaggugccgagcgaggacaguauggaaaagguuaaaguguaccuaaggguccggccccuccugccuuccgagcuugaacgccaggaggaucaggguugugugcgaauugagaauguagaaacucugguuuugcaagccccaaaggacucuuuugcgcucaaaagcaacgagcguggcauagggcaggcuacgcacagauucaccuuuucccagaucuucggacccgaagugggccaggccucauuuuucaaucugacagucaaggagauggugaaggaugugcugaaaggucaaaacuggcucauuuauacuuacggggucaccaauaguggaaagacacauaccauccagggcacuauuaaagacggcgggaucuuaccuaggagccuggcacuuauauuuaacucuuugcagggacagcugcacccaacacccgaucuaaagccucuccuguccaaugagguuaucuggcuugacucaaaacaaauucggcaggaagagaugaagaagcugagcuugcucaacgguggccugcaggaagaggaauuaaguaccucucugaaacgcuccguguauaucgagagcagaauugggacgucgacuucuuucgauuccggaaucgccggccucucaaguauaagccaaugcaccuccucuagccagcuugacgagacaucacauaggugggcucagccagacacugcaccgcugcccguaccugccaauauucgguuuaguaucuggauuuccuucuuugaaaucuacaacgaguugcuauaugaucugcucgaaccacccagccagcaacgcaagcgacagacccugagacuuugugaggaccagaaugguaacccuuacgugaaagaucugaauuggauccacguccaggacgcugaagaggccuggaaguugcucaaaguggggaggaagaaccaaucuuucgcgucaacacaucugaaucagaacaguagccggucccacucuauauuuucgauucguaucuuacaucugcagggagagggcgauauuguuccaaaaaucagcgaacuaucccucugcgaccuggcaggcucagagcgcuguaaggaucagaagaguggggaaagacuuaaagaggccggaaacauaaauaccucuuugcacacgcuggguaggugcauugcugcccuccggcaaaaccagcagaaucgaagcaagcagaaccuggugcccuuccgcgacuccaaacuuacuagagucuuccaaggcuuuuucacagggaggggacggucauguaugaucgugaauguaaacccgugcgcaagcaccuaugaugaaacucugcacguugcuaaguuuucugccaucgcgucccaguuggugcaugccccucccaugcagcucggcuucccaagucugcacagcuuuauuaaagagcacucuuuacaagucuccccuucacuggagaagggugcaaaggcugacacagggcuagaugacgacaucgaaaaugaggccgauauuaguauguacggcaaagaagaacuccuucagguggucgaggcuaugaagacccuguugcugaaagaacgccaggagaagcuccagcuggaaaugcauuuaagagacgagauauguaacgaaaugguggagcaaaugcagcagagggagcaguggugcagcgaacaccuggauacgcaaaaagagcuuuuggaagagauguacgaagagaagcucaauauccugaaggagucgcuaaccuccuucuaucaggaagagauucaggaacgugacgagaaaaucgaggagcuggaggcccuccugcaggaagcacggcaacagucuguugcccaucagcaaagcggaucagagcuugcuuugcgaagaagucagaggcuggcggcauccgccucuacacagcaguuacaagaagugaaggcuaaacuccagcaguguaaggccgagcugaacagcacuaccgaggaacuucacaaauaccagaagaugcuggagcccccacccuccgcaaagccuuuuacaaucgauguagacaaaaaguuggaagagggccagaaaaauauucgccuccugcggacugaacuacaaaagcugggggagucacuccagagcgccgagagagcuugcugccauaguaccggagccgguaaacugaggcaggcacuuacaaccugugaugacauauugaucaagcaagaucagacucuggcggaauuacagaacaauaugguccucgugaaacuggaccuucgcaagaaggcugccugcauugcagagcaguaucacacgguucugaaacuacaaggccaggugucugccaagaaacgacucgggacaaaccaggaaaaucaacagccaaaccagcagccgcccggaaagaaaccuuuccugcggaacuugcugccacguacccccacuugucaauccagcaccgauugcucgccuuacgcuagaaucuuaaggucacgccggucuccacuccugaagaguggccccuuugguaagaaauauuga

SEQ ID NO: 2125 - RNA, 2673 nt, Artificial Sequence
  derived and/or modified sequence opt4 from KI20A__Homo_sapiens__AAC83230
augagccagggcauccugagcccccccgccggccugcugagcgacgacgacgugguggugagccccauguucgagagcaccgccgccgaccugggcagcguggugagaaagaaccugcugagcgacugcagcguggugagcaccagccuggaggacaagcagcaggugcccagcgaggacagcauggagaaggugaagguguaccugagagugagaccccugcugcccagcgagcuggagagacaggaggaccagggcugcgugagaaucgagaacguggagacccuggugcugcaggcccccaaggacagcuucgcccugaagagcaacgagagaggcaucggccaggccacccacagauucaccuucagccagaucuucggccccgaggugggccaggccagcuucuucaaccugaccgugaaggagauggugaaggacgugcugaagggccagaacuggcugaucuacaccuacggcgugaccaacagcggcaagacccacaccauccagggcaccaucaaggacggcggcauccugcccagaagccuggcccugaucuucaacagccugcagggccagcugcaccccacccccgaccugaagccccugcugagcaacgaggugaucuggcuggacagcaagcagaucagacaggaggagaugaagaagcugagccugcugaacggcggccugcaggaggaggagcugagcaccagccugaagagaagcguguacaucgagagcagaaucggcaccagcaccagcuucgacagcggcaucgccggccugagcagcaucagccagugcaccagcagcagccagcuggacgagaccagccacagaugggcccagcccgacaccgccccccugcccgugcccgccaacaucagauucagcaucuggaucagcuucuucgagaucuacaacgagcugcuguacgaccugcuggagccccccagccagcagagaaagagacagacccugagacugugcgaggaccagaacggcaaccccuacgugaaggaccugaacuggauccacgugcaggacgccgaggaggccuggaagcugcugaaggugggcagaaagaaccagagcuucgccagcacccaccugaaccagaacagcagcagaagccacagcaucuucagcaucagaauccugcaccugcagggcgagggcgacaucgugcccaagaucagcgagcugagccugugcgaccuggccggcagcgagagaugcaaggaccagaagagcggcgagagacugaaggaggccggcaacaucaacaccagccugcacacccugggcagaugcaucgccgcccugagacagaaccagcagaacagaagcaagcagaaccuggugcccuucagagacagcaagcugaccagaguguuccagggcuucuucaccggcagaggcagaagcugcaugaucgugaacgugaaccccugcgccagcaccuacgacgagacccugcacguggccaaguucagcgccaucgccagccagcuggugcacgccccccccaugcagcugggcuuccccagccugcacagcuucaucaaggagcacagccugcaggugagccccagccuggagaagggcgccaaggccgacaccggccuggacgacgacaucgagaacgaggccgacaucagcauguacggcaaggaggagcugcugcaggugguggaggccaugaagacccugcugcugaaggagagacaggagaagcugcagcuggagaugcaccugagagacgagaucugcaacgagaugguggagcagaugcagcagagagagcaguggugcagcgagcaccuggacacccagaaggagcugcuggaggagauguacgaggagaagcugaacauccugaaggagagccugaccagcuucuaccaggaggagauccaggagagagacgagaagaucgaggagcuggaggcccugcugcaggaggccagacagcagagcguggcccaccagcagagcggcagcgagcuggcccugagaagaagccagagacuggccgccagcgccagcacccagcagcugcaggaggugaaggccaagcugcagcagugcaaggccgagcugaacagcaccaccgaggagcugcacaaguaccagaagaugcuggagcccccccccagcgccaagcccuucaccaucgacguggacaagaagcuggaggagggccagaagaacaucagacugcugagaaccgagcugcagaagcugggcgagagccugcagagcgccgagagagccugcugccacagcaccggcgccggcaagcugagacaggcccugaccaccugcgacgacauccugaucaagcaggaccagacccuggccgagcugcagaacaacauggugcuggugaagcuggaccugagaaagaaggccgccugcaucgccgagcaguaccacaccgugcugaagcugcagggccaggugagcgccaagaagagacugggcaccaaccaggagaaccagcagcccaaccagcagccccccggcaagaagcccuuccugagaaaccugcugcccagaacccccaccugccagagcagcaccgacugcagccccuacgccagaauccugagaagcagaagaagcccccugcugaagagcggccccuucggcaagaaguacuga

SEQ ID NO: 2126 - RNA, 2673 nt, Artificial Sequence
  derived and/or modified sequence opt5 from KI20A__Homo_sapiens__AAC83230
augagccagggcauccuguccccucccgccgggcugcugucugacgaugacguggucguuagcccgauguucgaguccaccgcugccgaucuuggaucuguggugagaaagaaccugcucagcgacugcuccgucgugucuacaagccuggaagauaaacaacagguucccuccgaggacagcauggaaaaggugaaagucuaccuucgggugcgcccucugcuccccucugagcuggaaagacaggaggaucagggcuguguucggauugagaauguggaaacgcugguccuccaagcgccuaaggacuccuuugcucugaaaagcaacgagcgcgggaucggacaggccacccacagauucacauuuucucagauuuucggccccgaaguggggcaggccuccuuuuucaaucuuaccgugaaggagauggucaaggauguucugaaaggacaaaacuggcucaucuauacauacggcgugaccaauagcggcaagacacauaccauucaggggacgaucaaagacggaggcauccugccucggucucuugcucugauuuuuaacucccuccaggggcagcugcacccgacccccgaucugaagccucuccugagcaaugaggugaucuggcuugacuccaaacaaauucgccaggaagagaugaagaagcugucucuccugaacggaggccuucaggaagaggaacugagcacaucccucaaaagaagcgucuauaucgagucucggauugggaccuccacauccuucgauucuggaaucgccggccugagcuccauuucucaaugcaccagcuccagccagcuggacgagacgucucaucgcugggcucagcccgacacagccccucuccccgugccggcgaauaucagauuuuccaucuggauuagcuucuuugaaaucuacaacgagcugcuuuaugaucugcucgaaccucccucucagcaacggaagcgccagacccugagacuuugugaggaccagaauggcaacccuuacguuaaagaucugaauuggauucacgugcaggacgccgaagaggcuuggaagcuccugaaagucgggcggaagaaccaauccuucgccagcacacaucugaaucagaacuccucucgcagccacuccaucuuuucuauuagaauccuccaucugcagggagagggcgauaucgugcccaaaauuagcgaacuuucccugugcgaccucgcugggagcgagcgguguaaggaucagaagucuggagaaagacugaaagaggccggcaacaucaauaccucccugcacacccuugggcgcugcauugcggcccuccggcaaaaccagcagaauagaagcaagcagaaccugguucccuuccgcgacucuaaacugacacggguguuccaaggauuuuucacgggcagaggccgcuccuguaugaucgucaaugugaacccuugcgcuagcaccuaugaugaaacacuccacgucgccaaguuuucugcuauugccagccagcuggugcaugccccgcccaugcagcuuggguucccuucccugcacagcuuuaucaaagagcacucucuccaaguuucccccagccuggagaagggagcuaaggcggacaccggccuggaugacgacaucgaaaaugaggccgauauuuccauguacgggaaagaagaacuucuccagguggucgaggcuaugaagacacugcugcucaaagaacggcaggagaagcugcagcuugaaaugcaucugagagacgagaucuguaacgaaaugguggagcaaaugcagcagcgcgagcaguggugcucugaacaccucgauacccaaaaagagcugcuggaagagauguacgaagagaaacuuaauauucucaaggagagccugacguccuucuaucaggaagagauccaggaacgggacgagaaaauugaggagcuggaggcccuccugcaggaagccagacaacagucuguugcucaucagcaaagcggauccgagcuugcccugcgccggucucagagacucgcggcuagcgccuccacacagcagcugcaagaagugaaggccaaacugcagcaguguaaggcugagcuuaacagcaccaccgaggaacuccacaaauaccagaagaugcuggagccucccccgucugccaagccuuuuacaaucgaugucgacaaaaagcuggaagagggccaaaagaauauucggcuccugcgcaccgaacuucagaagcugggggagucccuccagagcgcugagagagccugcugccauucuacaggcgcgggaaaacugcggcaggcccugacgaccugugaugacauccuuaucaagcaagaucagacacuggcugaacuccagaacaauauggugcuggugaaacucgaccugagaaagaaggccgcuugcauugccgagcaguaucacaccguucuuaaacugcaaggccaggucuccgcgaagaaacgccucgggacaaaccaggaaaaucaacagcccaaccagcagccucccggaaagaaaccuuuccugcggaaccugcuucccagaaccccgacgugucaaagcucuaccgauugcuccccuuacgcccgcauccugagaagccggcgcagcccccuccucaagagcggccccuuugggaagaaauauuga

SEQ ID NO: 2127 - protein, 370 aa, Artificial Sequence
  KIAA0205__Homo_sapiens__Q92604
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDTTIAYPKAEPIDIQTWILGYRKPTVTHVHYRIFPIKDVPLETDDLTTWLYQRFVEKEDLLSHFYETGAFPPSKGHKEAVSREMTLSNLWIFLIQSFAFLSGYMWYNIIQYFYHCLF

SEQ ID NO: 2128 - RNA, 1113 nt, Artificial Sequence
  KIAA0205__Homo_sapiens__AAH34621
auggcuauaacuuuggaagaagcuccguggcugggcuggcucuuggugaaagcacugaugagguuugccuucauggucgucaacaaccugguugcuauuccauccuacaucugcuauguaauuauacuucagccccuucgagugcuggacaguaagcgguucugguauaucgaaggaaucauguauaaauggcuuuuaggaaugguagcuuccuggggaugguaugcuggauauacagugauggaauggggagaagauauuaaagcaguuucaaaagaugaagcagugauguuggugaaucaucaggcaacaggagaugugugcacacugaugaugugccuccaggacaaaggacugguuguugcucagaugaugugguugauggaucauauuuuuaaguacacaaacuuuggaauuguuucucuaguucauggagacuucuuuauaagacagggaagaucuuaucgugaccaacagcugcugcuucucaagaagcacuuagaaaauaauuacaggagcagagaucgaaaauggauuguuuuguuuccagaagggggcuuccucaggaagaggcgagaaacaagucaggcauuugccaagaaaaauaacuugccauuucuuacaaauguuacucugccaaggucuggggcaacaaaaauuauuuugaaugcacuuguagcacaacagaaaaauggaaguccagcaggaggagaugcuaaagaauuagacagcaaaucaaaaggccuccaguggauaauagauacaacgauagcuuaucccaaagcugaaccuauagauauucaaaccuggauccuuggauacaggaaaccaacagucacacauguacauuacaggaucuuuccaauuaaagauguaccccuggagacugaugaccuuaccacuuggcucuaucagcgguuuguugaaaaagaagaccucuuaucacauuuuuaugaaacaggagcuuuuccaccuuccaagggccauaaggaagcuguuuccagggagaugacccucagcaacuuguggauauuucucauacagucuuuugcauuuuugucaggcuauaugugguacaacaucauucaguauuuuuaccauugccuguuuuag

SEQ ID NO: 2129 - RNA, 1113 nt, Artificial Sequence
  derived and/or modified sequence opt1 from KIAA0205__Homo_sapiens__AAH34621
auggccaucacccuggaggaggcccccuggcucggcuggcugcuggugaaggcgcucaugcgcuucgccuucauggucgugaacaaccugguggccaucccgagcuacaucugcuacgucaucauccugcagccccuccgggugcuggacuccaagcgcuucugguacaucgaggggaucauguacaaguggcugcucggcaugguggccagcugggggugguacgccggcuacaccgucauggaguggggcgaggacaucaaggcgguguccaaggacgaggccgugaugcuggucaaccaccaggccacgggggacgugugcacccugaugaugugccuccaggacaagggccugguggucgcccagaugauguggcugauggaccacaucuucaaguacaccaacuucgggaucgugagccucgugcacggcgacuucuucauccggcaggggcgcuccuaccgggaccagcagcugcugcuccugaagaagcaccuggagaacaacuaccgcagccgggaccgcaaguggaucguccucuuccccgagggcggguuccugcggaagcgccgggagaccucccaggcguucgccaagaagaacaaccugcccuuccucacgaacgugacccugccgcgcagcggcgccaccaagaucauccugaacgcccucguggcccagcagaagaacggcucccccgccgggggcgacgcgaaggagcuggacagcaaguccaaggggcugcaguggaucaucgacaccacgaucgccuaccccaaggccgagcccaucgacauccagaccuggauccucggcuaccggaagccgaccgucacccacgugcacuaccgcaucuuccccaucaaggacgugccccuggagacggacgaccugaccaccuggcucuaccagcgguucgucgagaaggaggaccugcugagccacuucuacgagaccggcgccuucccgcccuccaaggggcacaaggaggcggugagccgcgagaugacgcucuccaaccuguggaucuuccugauccagagcuucgccuuccucuccggcuacaugugguacaacaucauccaguacuucuaccacugccuguucuga

SEQ ID NO: 2130 - RNA, 1113 nt, Artificial Sequence
  derived and/or modified sequence opt2 from KIAA0205__Homo_sapiens__AAH34621
auggccaucacccucgaggaggcccccuggcucggcuggcuccucgucaaggcccucaugcgcuucgccuucauggucgucaacaaccucgucgccauccccuccuacaucugcuacgucaucauccuccagccccuccgcguccucgacuccaagcgcuucugguacaucgagggcaucauguacaaguggcuccucggcauggucgccuccuggggcugguacgccggcuacaccgucauggaguggggcgaggacaucaaggccgucuccaaggacgaggccgucaugcucgucaaccaccaggccaccggcgacgucugcacccucaugaugugccuccaggacaagggccucgucgucgcccagaugauguggcucauggaccacaucuucaaguacaccaacuucggcaucgucucccucguccacggcgacuucuucauccgccagggccgcuccuaccgcgaccagcagcuccuccuccucaagaagcaccucgagaacaacuaccgcucccgcgaccgcaaguggaucguccucuuccccgagggcggcuuccuccgcaagcgccgcgagaccucccaggccuucgccaagaagaacaaccuccccuuccucaccaacgucacccucccccgcuccggcgccaccaagaucauccucaacgcccucgucgcccagcagaagaacggcucccccgccggcggcgacgccaaggagcucgacuccaaguccaagggccuccaguggaucaucgacaccaccaucgccuaccccaaggccgagcccaucgacauccagaccuggauccucggcuaccgcaagcccaccgucacccacguccacuaccgcaucuuccccaucaaggacgucccccucgagaccgacgaccucaccaccuggcucuaccagcgcuucgucgagaaggaggaccuccucucccacuucuacgagaccggcgccuucccccccuccaagggccacaaggaggccgucucccgcgagaugacccucuccaaccucuggaucuuccucauccaguccuucgccuuccucuccggcuacaugugguacaacaucauccaguacuucuaccacugccucuucuga

SEQ ID NO: 2131 - RNA, 1113 nt, Artificial Sequence
  derived and/or modified sequence opt3 from KIAA0205__Homo_sapiens__AAH34621
auggccaucacccuggaggaagcucccuggcucggcuggcuucuggugaaggcauugaugagauucgccuuuauggucguuaacaauuuaguggcgauuccuagcuacauaugcuauguaaucauucugcagccacuaagggugcucgacuccaaacgguucugguacaucgaggggauuauguauaaguggcugcuuggaauggucgcuucuugggguugguacgccggcuauacagugauggaauggggagaggauaucaaagcaguuucaaaggacgaagccgugaugcuggucaaccaccaagcuacuggggauguguguacguugaugaugugccuccaggacaaaggccugguaguugcacagaugauguggcugauggaucauauauuuaaguacaccaauuucgguaucgugagucucguccacggggacuuuuucauucgccagggacgaagcuaucgugaucaacaguuacugcuuuugaagaaacaucuggagaacaauuacagauccagggaccggaaguggaucgugcuauuuccggagggcggcuuccuccgcaaaagaagggaaacaucucaggccuuugcuaagaaaaacaaucugcccuuccuuacuaacgugacccugccucggucgggggccacaaagauuaucuugaaugcgcucgucgcacagcaaaagaacggaucaccagccgguggcgaugcuaaagagcuggacagcaagaguaaaggguuacaguggauaauugauaccacuaucgccuaccccaaggcagaaccuauugacauccagacauggauccugggauaucgcaaaccaaccguuacgcacgugcauuaccgaauuuuucccauaaaggauguaccucucgagacugacgaccuuaccacauggcuguaucagagauucguggagaaagaagauuugcuaucccacuuuuacgagacuggcgcuuucccaccgucuaagggucacaaggaagccgucagcagggagaugacccuguccaaucucuggaucuuccugauucaaucauuugcguuccuuaguggguauaugugguacaacaucauacaguauuuuuaccauugucuguucuga

SEQ ID NO: 2132 - RNA, 1113 nt, Artificial Sequence
  derived and/or modified sequence opt4 from KIAA0205__Homo_sapiens__AAH34621
auggccaucacccuggaggaggcccccuggcugggcuggcugcuggugaaggcccugaugagauucgccuucaugguggugaacaaccugguggccauccccagcuacaucugcuacgugaucauccugcagccccugagagugcuggacagcaagagauucugguacaucgagggcaucauguacaaguggcugcugggcaugguggccagcuggggcugguacgccggcuacaccgugauggaguggggcgaggacaucaaggccgugagcaaggacgaggccgugaugcuggugaaccaccaggccaccggcgacgugugcacccugaugaugugccugcaggacaagggccuggugguggcccagaugauguggcugauggaccacaucuucaaguacaccaacuucggcaucgugagccuggugcacggcgacuucuucaucagacagggcagaagcuacagagaccagcagcugcugcugcugaagaagcaccuggagaacaacuacagaagcagagacagaaaguggaucgugcuguuccccgagggcggcuuccugagaaagagaagagagaccagccaggccuucgccaagaagaacaaccugcccuuccugaccaacgugacccugcccagaagcggcgccaccaagaucauccugaacgcccugguggcccagcagaagaacggcagccccgccggcggcgacgccaaggagcuggacagcaagagcaagggccugcaguggaucaucgacaccaccaucgccuaccccaaggccgagcccaucgacauccagaccuggauccugggcuacagaaagcccaccgugacccacgugcacuacagaaucuuccccaucaaggacgugccccuggagaccgacgaccugaccaccuggcuguaccagagauucguggagaaggaggaccugcugagccacuucuacgagaccggcgccuucccccccagcaagggccacaaggaggccgugagcagagagaugacccugagcaaccuguggaucuuccugauccagagcuucgccuuccugagcggcuacaugugguacaacaucauccaguacuucuaccacugccuguucuga

SEQ ID NO: 2133 - RNA, 1113 nt, Artificial Sequence
  derived and/or modified sequence opt5 from KIAA0205__Homo_sapiens__AAH34621
auggccaucacccuggaggaagcucccuggcucggcuggcugcuugugaaggcccugaugagauucgcguuuauggucguuaacaaucucguggcuauuccuagcuacaucugcuaugugauuauccugcagccgcuucggguccuggacuccaaacgcuucugguacauugaggggaucauguauaaguggcuccugggaaugguggccucuuggggcugguacgccggguauacaguuauggaauggggagaggauaucaaagcugugagcaaggacgaagccgucaugcuggugaaccaccaagcuacgggcgauguuuguacccucaugaugugccugcaggacaaagggcuuguggucgcccagaugauguggcugauggaucauauuuuuaaguacacaaauuucggaaucgugucccucgugcacggcgacuuuuucauuagacagggccggucuuaucgcgaucaacagcugcuucugcucaagaaacaucuggagaacaauuacagaagccgggaccgcaaguggaucguccuguuucccgaagggggauuccucagaaaacggcgcgagaccucccaggcguuugccaagaaaaacaaucugccuuuccuuacaaacguuacccugcccagaucuggcgcuacaaagauuauccucaaugcccugguggcucagcaaaagaacgggagcccugccggaggcgaugcgaaagagcuugacuccaagagcaaagggcugcaguggauuaucgauaccacgaucgccuaccccaaggcugaaccuauugacauccagaccuggauucucggauaucggaaaccgacagugacccacguccauuaccgcaucuuucccauuaaggaugugccucuggagacagacgaccugaccacguggcucuaucagagauucguugagaaagaagaucugcuuucucacuuuuacgagacaggcgccuuucccccuuccaagggccacaaggaagcugugagccgggagaugacccugucuaaucucuggaucuuccugauccaauccuucgccuuccuuagcggguauaugugguacaacauuauccaguauuuuuaccauugucuguucuga

SEQ ID NO: 2134 - protein, 725 aa, Artificial Sequence
  KIF2C__Homo_sapiens__Q99661
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 2135 - RNA, 2178 nt, Artificial Sequence
  KIF2C__Homo_sapiens__AAH14924
auggccauggacucgucgcuucaggcccgccuguuucccggucucgcuaucaagauccaacgcaguaaugguuuaauucacagugccaauguaaggacugugaacuuggagaaauccuguguuucaguggaaugggcagaaggaggugccacaaagggcaaagagauugauuuugaugauguggcugcaauaaacccagaacucuuacagcuucuucccuuacauccgaaggacaaucugcccuugcaggaaaauguaacaauccagaaacaaaaacggagauccgucaacuccaaaauuccugcuccaaaagaaagucuucgaagccgcuccacucgcauguccacugucucagagcuucgcaucacggcucaggagaaugacauggagguggagcugccugcagcugcaaacucccgcaagcaguuuucaguuccuccugcccccacuaggccuuccugcccugcaguggcugaaauaccauugaggauggucagcgaggagauggaagagcaaguccauuccauccgaggcagcucuucugcaaacccugugaacucaguucggaggaaaucaugucuugugaaggaaguggaaaaaaugaagaacaagcgagaagagaagaaggcccagaacucugaaaugagaaugaagagagcucaggaguaugacaguaguuuuccaaacugggaauuugcccgaaugauuaaagaauuucgggcuacuuuggaaugucauccacuuacuaugacugauccuaucgaagagcacagaauaugugucuguguuaggaaacgcccacugaauaagcaagaauuggccaagaaagaaauugaugugauuuccauuccuagcaagugucuccucuugguacaugaacccaaguugaaaguggacuuaacaaaguaucuggagaaccaagcauucugcuuugacuuugcauuugaugaaacagcuucgaaugaaguugucuacagguucacagcaaggccacugguacagacaaucuuugaagguggaaaagcaacuuguuuugcauauggccagacaggaaguggcaagacacauacuaugggcggagaccucucugggaaagcccagaaugcauccaaagggaucuaugccauggccucccgggacgucuuccuccugaagaaucaacccugcuaccggaaguugggccuggaagucuaugugacauucuucgagaucuacaaugggaagcuguuugaccugcucaacaagaaggccaagcugcgcgugcuggaggacggcaagcaacaggugcaagugguggggcugcaggagcaucugguuaacucugcugaugaugucaucaagaugaucgacaugggcagcgccugcagaaccucugggcagacauuugccaacuccaauuccucccgcucccacgcgugcuuccaaauuauucuucgagcuaaagggagaaugcauggcaaguucucuuugguagaucuggcagggaaugagcgaggcgcggacacuuccagugcugaccggcagacccgcauggagggcgcagaaaucaacaagagucucuuagcccugaaggagugcaucagggcccugggacagaacaaggcucacaccccguuccgugagagcaagcugacacaggugcugagggacuccuucauuggggagaacucuaggacuugcaugauugccacgaucucaccaggcauaagcuccugugaauauacuuuaaacacccugagauaugcagacagggucaaggagcugagcccccacagugggcccaguggagagcaguugauucaaauggaaacagaagagauggaagccugcucuaacggggcgcugauuccaggcaauuuauccaaggaagaggaggaacugucuucccagauguccagcuuuaacgaagccaugacucagaucagggagcuggaggagaaggcuauggaagagcucaaggagaucauacagcaaggaccagacuggcuugagcucucugagaugaccgagcagccagacuaugaccuggagaccuuugugaacaaagcggaaucugcucuggcccagcaagccaagcauuucucagcccugcgagaugucaucaaggccuugcgccuggccaugcagcuggaagagcaggcuagcagacaaauaagcagcaagaaacggccccaguga

SEQ ID NO: 2136 - RNA, 2178 nt, Artificial Sequence
  derived and/or modified sequence opt1 from KIF2C__Homo_sapiens__AAH14924
auggccauggacagcucccugcaggcccgccucuuccccggccuggcgaucaagauccagcggagcaacgggcugauccacuccgccaacgugcgcaccgucaaccucgagaaguccugcgugagcguggagugggccgagggcggggccaccaagggcaaggagaucgacuucgacgacgucgccgcgaucaacccggagcugcugcagcuccugccccugcaccccaaggacaaccucccccugcaggagaacgugacgauccagaagcagaagcggcgcagcgugaacuccaagaucccggcccccaaggagagccugcggucccgcagcacccggauguccaccgucagcgagcuccgcaucaccgcccaggagaacgacauggagguggagcugcccgccgcggccaacucccggaagcaguucagcgugcccccggcccccacgcgccccuccugccccgccgucgccgagaucccgcugcggauggugagcgaggagauggaggagcagguccacuccauccgcgggagcuccagcgcgaaccccgugaacagcgugcggcgcaaguccugccucgugaaggaggucgagaagaugaagaacaagcgggaggagaagaaggcccagaacagcgagaugcgcaugaagcgggcccaggaguacgacuccagcuuccccaacugggaguucgcccgcaugaucaaggaguuccgggccacccuggagugccacccccugaccaugaccgacccgaucgaggagcaccgcaucugcgugugcgugcggaagcgcccccucaacaagcaggagcuggcgaagaaggagaucgacgucaucuccauccccagcaagugccugcuccuggugcacgagcccaagcugaagguggaccucacgaaguaccuggagaaccaggccuucugcuucgacuucgccuucgacgagaccgccuccaacgaggucguguaccgcuucaccgcccggccgcuggugcagaccaucuucgagggcggcaaggcgacgugcuucgccuacgggcagaccggcagcgggaagacccacaccaugggcggggaccucuccggcaaggcccagaacgccagcaagggcaucuacgccauggcgucccgcgacgucuuccugcugaagaaccagcccugcuaccggaagcucgggcuggagguguacgucacguucuucgagaucuacaacggcaagcuguucgaccuccugaacaagaaggccaagcugcgcgugcucgaggacgggaagcagcagguccagguggugggccugcaggagcaccuggugaacagcgccgacgacgucaucaagaugaucgacaugggcuccgccugccggaccagcgggcagaccuucgcgaacuccaacagcucccgcagccacgccugcuuccagaucauccuccgggccaagggccgcaugcacgggaaguucucccugguggaccuggccggcaacgagcgcggggccgacaccagcagcgcggaccggcagacgcggauggagggcgccgagaucaacaagucccuccuggcccugaaggagugcauccgcgcccucggccagaacaaggcccacacccccuuccgggagagcaagcugacccaggugcugcgcgacuccuucaucggggagaacagccggaccugcaugaucgcgacgaucucccccggcaucagcuccugcgaguacacccucaacacccugcgcuacgccgaccgggucaaggagcugagcccgcacuccgggcccagcggcgagcagcugauccagauggagaccgaggagauggaggccugcuccaacggggcccucauccccggcaaccugagcaaggaggaggaggagcuguccagccagauguccagcuucaacgaggccaugacgcagauccgcgagcucgaggagaaggcgauggaggagcugaaggagaucauccagcagggccccgacuggcuggagcucuccgagaugaccgagcagccggacuacgaccuggagaccuucgugaacaaggccgagagcgcccuggcccagcaggcgaagcacuucagcgcccuccgggacgugaucaaggcccugcgccuggccaugcagcucgaggagcaggccucccgccagaucagcuccaagaagcggccccaguga

SEQ ID NO: 2137 - RNA, 2178 nt, Artificial Sequence
  derived and/or modified sequence opt2 from KIF2C__Homo_sapiens__AAH14924
auggccauggacuccucccuccaggcccgccucuuccccggccucgccaucaagauccagcgcuccaacggccucauccacuccgccaacguccgcaccgucaaccucgagaaguccugcgucuccgucgagugggccgagggcggcgccaccaagggcaaggagaucgacuucgacgacgucgccgccaucaaccccgagcuccuccagcuccucccccuccaccccaaggacaaccucccccuccaggagaacgucaccauccagaagcagaagcgccgcuccgucaacuccaagauccccgcccccaaggagucccuccgcucccgcuccacccgcauguccaccgucuccgagcuccgcaucaccgcccaggagaacgacauggaggucgagcuccccgccgccgccaacucccgcaagcaguucuccgucccccccgcccccacccgccccuccugccccgccgucgccgagaucccccuccgcauggucuccgaggagauggaggagcagguccacuccauccgcggcuccuccuccgccaaccccgucaacuccguccgccgcaaguccugccucgucaaggaggucgagaagaugaagaacaagcgcgaggagaagaaggcccagaacuccgagaugcgcaugaagcgcgcccaggaguacgacuccuccuuccccaacugggaguucgcccgcaugaucaaggaguuccgcgccacccucgagugccacccccucaccaugaccgaccccaucgaggagcaccgcaucugcgucugcguccgcaagcgcccccucaacaagcaggagcucgccaagaaggagaucgacgucaucuccauccccuccaagugccuccuccucguccacgagcccaagcucaaggucgaccucaccaaguaccucgagaaccaggccuucugcuucgacuucgccuucgacgagaccgccuccaacgaggucgucuaccgcuucaccgcccgcccccucguccagaccaucuucgagggcggcaaggccaccugcuucgccuacggccagaccggcuccggcaagacccacaccaugggcggcgaccucuccggcaaggcccagaacgccuccaagggcaucuacgccauggccucccgcgacgucuuccuccucaagaaccagcccugcuaccgcaagcucggccucgaggucuacgucaccuucuucgagaucuacaacggcaagcucuucgaccuccucaacaagaaggccaagcuccgcguccucgaggacggcaagcagcagguccaggucgucggccuccaggagcaccucgucaacuccgccgacgacgucaucaagaugaucgacaugggcuccgccugccgcaccuccggccagaccuucgccaacuccaacuccucccgcucccacgccugcuuccagaucauccuccgcgccaagggccgcaugcacggcaaguucucccucgucgaccucgccggcaacgagcgcggcgccgacaccuccuccgccgaccgccagacccgcauggagggcgccgagaucaacaagucccuccucgcccucaaggagugcauccgcgcccucggccagaacaaggcccacacccccuuccgcgaguccaagcucacccagguccuccgcgacuccuucaucggcgagaacucccgcaccugcaugaucgccaccaucucccccggcaucuccuccugcgaguacacccucaacacccuccgcuacgccgaccgcgucaaggagcucuccccccacuccggccccuccggcgagcagcucauccagauggagaccgaggagauggaggccugcuccaacggcgcccucauccccggcaaccucuccaaggaggaggaggagcucuccucccagauguccuccuucaacgaggccaugacccagauccgcgagcucgaggagaaggccauggaggagcucaaggagaucauccagcagggccccgacuggcucgagcucuccgagaugaccgagcagcccgacuacgaccucgagaccuucgucaacaaggccgaguccgcccucgcccagcaggccaagcacuucuccgcccuccgcgacgucaucaaggcccuccgccucgccaugcagcucgaggagcaggccucccgccagaucuccuccaagaagcgcccccaguga

SEQ ID NO: 2138 - RNA, 2178 nt, Artificial Sequence
  derived and/or modified sequence opt3 from KIF2C__Homo_sapiens__AAH14924
auggccauggacagcucccugcaggcuagacucuuccccggccuugcaaucaagauucaaaggucuaacgggcugauacacucagccaaugugcggaccgucaacuuggagaaaaguugcguuagcguggaaugggcggagggaggugcuacaaagggcaaagaaaucgauuuugacgauguagccgcaauuaauccugaguuacugcagcuacucccacugcauccgaaggacaaccuuccccugcaggaaaaugugacuauccagaaacaaaagcgccgauccgucaacucuaagauuccugccccaaaagagucguugcguucaagaagcacgaggaugaguaccguguccgagcuccggaucacagcucaggaaaaugauauggagguugaacugcccgcagccgcuaacucucgcaagcaguucagcgugccuccagcccccacuagaccuuccuguccagcggucgcagagauaccgcugaggauggugucagaggaaauggaggaacagguacacaguauccgggggucuagcuccgccaaucccguuaacucagugcgccgaaaaagcugccucgucaaggagguggagaaaaugaagaauaagagagaggagaaaaaggcucaaaacagugaaaugaggaugaaacgggcccaggaguacgacucuuccuuuccuaauugggaguucgcacguaugauuaaggaguuucgcgcuaccuuagaaugucauccacugacaaugaccgaucccaucgaggagcacagaauuugcgugugugucaggaaacggccucuuaacaagcaggaauuggccaaaaaggagaucgacguuauaagcauuccaucgaagugccugcuacucgugcaugaacccaaacugaagguagaucuuacuaaauaucuggagaaucaggcguucuguuuugacuucgccuuugaugaaacagcaucuaacgagguggucuaccgauucaccgcucgcccguuggugcaaacgaucuuugagggaggcaaggccacuugcuucgcuuauggucagaccggguccggaaaaacacacacuaugggcggcgaccucucagggaaggcccagaacgcaaguaagggaauuuacgccauggcuagcagagauguuuuucugcugaaaaaucaaccuuguuauaggaaguuaggucucgaaguguacgucaccuucuucgagaucuauaacggcaaacuuuuugaccuguugaauaagaaagcgaagcuacgggugcuggaagacgggaagcagcagguacagguugugggacuccaagagcaccuggucaacuccgcagaugacgugaucaaaaugauugauaugggcucugccugccgcacaagcggucagaccuucgcuaauucaaacaguuccagaagccaugccuguuuucagauaauccuuagggcaaaggggcguaugcacggaaaauucucucuggucgacuuggccggcaaugagcggggcgcugauacgucaagugccgaccgacagacuagaauggaaggggcagagauuaacaagagccuccuggcguuaaaagaaugcaucagggcucugggacaaaauaaggcccauacacccuuucgcgaguccaagcuaacccaggugcuccgggauucuuucauaggugaaaacucgagaacuugcaugauugcaacaaucagcccaggcaucuccucaugugaguacacccugaauacgcuuagguacgccgaccgcguuaaagaguugaguccucacucugggcccagcggagaacagcugauucagauggagaccgaagagauggaggcuugcuccaacggcgcccucaucccagguaaucugucaaaggaagaggaagaacuuagcucucaaauguccaguuuuaacgaagcaaugacacagauucgagagcuggaagagaaagcuauggaggaauugaaggagauaauccagcaggggcccgauuggcucgaacugagcgagaugacugagcaaccugacuaugauuuagaaaccuucgugaauaaagccgagucugcgcuggcccagcaggcuaagcacuuuuccgcacuacgggacguaauuaaagcccuccgucuggcuaugcaacuugaagaacaggccucaagacagaucaguagcaagaagaggccacaguga

SEQ ID NO: 2139 - RNA, 2178 nt, Artificial Sequence
  derived and/or modified sequence opt4 from KIF2C__Homo_sapiens__AAH14924
auggccauggacagcagccugcaggccagacuguuccccggccuggccaucaagauccagagaagcaacggccugauccacagcgccaacgugagaaccgugaaccuggagaagagcugcgugagcguggagugggccgagggcggcgccaccaagggcaaggagaucgacuucgacgacguggccgccaucaaccccgagcugcugcagcugcugccccugcaccccaaggacaaccugccccugcaggagaacgugaccauccagaagcagaagagaagaagcgugaacagcaagauccccgcccccaaggagagccugagaagcagaagcaccagaaugagcaccgugagcgagcugagaaucaccgcccaggagaacgacauggagguggagcugcccgccgccgccaacagcagaaagcaguucagcgugccccccgcccccaccagacccagcugccccgccguggccgagaucccccugagaauggugagcgaggagauggaggagcaggugcacagcaucagaggcagcagcagcgccaaccccgugaacagcgugagaagaaagagcugccuggugaaggagguggagaagaugaagaacaagagagaggagaagaaggcccagaacagcgagaugagaaugaagagagcccaggaguacgacagcagcuuccccaacugggaguucgccagaaugaucaaggaguucagagccacccuggagugccacccccugaccaugaccgaccccaucgaggagcacagaaucugcgugugcgugagaaagagaccccugaacaagcaggagcuggccaagaaggagaucgacgugaucagcauccccagcaagugccugcugcuggugcacgagcccaagcugaagguggaccugaccaaguaccuggagaaccaggccuucugcuucgacuucgccuucgacgagaccgccagcaacgaggugguguacagauucaccgccagaccccuggugcagaccaucuucgagggcggcaaggccaccugcuucgccuacggccagaccggcagcggcaagacccacaccaugggcggcgaccugagcggcaaggcccagaacgccagcaagggcaucuacgccauggccagcagagacguguuccugcugaagaaccagcccugcuacagaaagcugggccuggagguguacgugaccuucuucgagaucuacaacggcaagcuguucgaccugcugaacaagaaggccaagcugagagugcuggaggacggcaagcagcaggugcagguggugggccugcaggagcaccuggugaacagcgccgacgacgugaucaagaugaucgacaugggcagcgccugcagaaccagcggccagaccuucgccaacagcaacagcagcagaagccacgccugcuuccagaucauccugagagccaagggcagaaugcacggcaaguucagccugguggaccuggccggcaacgagagaggcgccgacaccagcagcgccgacagacagaccagaauggagggcgccgagaucaacaagagccugcuggcccugaaggagugcaucagagcccugggccagaacaaggcccacacccccuucagagagagcaagcugacccaggugcugagagacagcuucaucggcgagaacagcagaaccugcaugaucgccaccaucagccccggcaucagcagcugcgaguacacccugaacacccugagauacgccgacagagugaaggagcugagcccccacagcggccccagcggcgagcagcugauccagauggagaccgaggagauggaggccugcagcaacggcgcccugauccccggcaaccugagcaaggaggaggaggagcugagcagccagaugagcagcuucaacgaggccaugacccagaucagagagcuggaggagaaggccauggaggagcugaaggagaucauccagcagggccccgacuggcuggagcugagcgagaugaccgagcagcccgacuacgaccuggagaccuucgugaacaaggccgagagcgcccuggcccagcaggccaagcacuucagcgcccugagagacgugaucaaggcccugagacuggccaugcagcuggaggagcaggccagcagacagaucagcagcaagaagagaccccaguga

SEQ ID NO: 2140 - RNA, 2178 nt, Artificial Sequence
  derived and/or modified sequence opt5 from KIF2C__Homo_sapiens__AAH14924
auggccauggacagcucccugcaggcuagacucuuccccggccuggccaucaagauucaacggucuaacgggcuuauccacagcgcgaaugugcgcaccgucaaccuggagaaauccugcguuucuguggaaugggcugagggaggcgccacaaaggggaaagaaauugauuuugacgauguggccgcuaucaauccugagcuccugcagcuucugccgcuccaucccaaggacaaccugccucugcaggaaaaugucacgauucagaaacaaaagagacggagcgugaacuccaagauccccgccccuaaagagucucuccgcagcagauccacccggaugagcacaguuucugagcugcgcaucaccgcucaggaaaaugauauggagguggaacuucccgccgcggccaacuccagaaagcaguucagcgucccuccggcucccacacggccuucuugucccgccguggcugagauuccucugcgcaugguuuccgaggaaauggaggaacaggugcacagcaucagaggaucuuccagcgccaaucccgucaacuccgugcggcgcaaaucuugccucgugaaggaggucgaaaagaugaagaauaagagagaggagaaaaaggcgcaaaacagcgaaaugcggaugaaacgcgcccaggaguacgacuccagcuuuccgaauugggaguucgcuagaaugauuaaggaguuucgggccacccuggaaugucauccucuuacaaugaccgaucccaucgaggagcacagaauuugcguuugugugcgcaaacggccucugaacaagcaggaacucgcuaaaaaggagaucgacgugauuucuauccccuccaagugccugcugcucguccaugaacccaaacugaagguggaucuuacgaaauaucuggagaaucaggccuucuguuuugacuucgccuuugaugaaaccgcuagcaacgagguuguguacagauucacagcgcgcccucucguccaaaccaucuuugagggcgggaaggccacaugcuucgcuuauggacagaccggcucuggcaaaacgcacacaaugggaggggaccugagcggcaaggcccagaacgccuccaaggggauuuacgcuauggccucucgggauguguuucuucugaaaaaucaaccguguuauagaaagcucggacuggaaguuuacgugaccuucuucgagaucuauaacggcaaacuguuugaccuccugaauaagaaagcgaaacuucgcguccuggaagacgggaagcaacaggugcaggucgugggacuccaggagcaccugguuaacagcgcugaugacgugauuaaaaugaucgauaugggcuccgccugccggacaagcggccagaccuucgccaauucuaacuccagcagaucucaugcuuguuuucagauuauccuucgcgccaaggggcggaugcacggaaaauucucccuggucgaccucgcuggcaaugagagaggggccgauaccagcuccgcggaccgccagacacggauggaaggagccgagaucaacaagucucugcuggcucucaaagaaugcauuagagcccugggccaaaauaaggcucauacgcccuuucgggagagcaaacuuacccaggugcugcgcgauuccuucaucggggaaaacucuagaacaugcaugauugccaccaucagcccuggaauuuccagcugugaguacacacucaauacccugcgguacgcggacagaguuaaggagcugucuccccacuccggcccuagcggcgaacagcuuauccagauggagacggaagagauggaagccugcucuaacggggcucucauccccggaaaucuguccaaggaggaggaagaacugagcucucaaaugagcuccuuuaacgaagccaugacacagauucgcgagcucgaagagaaagcuauggaggaacugaaggagaucauucagcagggcccggauuggcuugaacugagcgagaugaccgagcaaccugacuaugaucucgaaaccuucgugaauaaagccgagucugcccuggcucagcaggcgaagcacuuuuccgcccugcgggacgucaucaaagcucuuagacucgccaugcaacuggaggaacaggccagccgccagauuuccucuaagaagagaccccaguga

SEQ ID NO: 2141 - protein, 113 aa, Artificial Sequence
  KK-LC-1__Homo_sapiens__Q5H943
MNFYLLLASSILCALIVFWKYRRFQRNTGEMSSNSTALALVRPSSSGLINSNTDNNLAVYDLSRDILNNFPHSIARQKRILVNLSMVENKLVELEHTLLSKGFRGASPHRKST

SEQ ID NO: 2142 - RNA, 342 nt, Artificial Sequence
  KK-LC-1__Homo_sapiens__AAH62223
augaacuucuauuuacuccuagcgagcagcauucugugugccuugauugucuucuggaaauaucgccgcuuucagagaaacacuggcgaaaugucaucaaauucaacugcucuugcacuagugagacccucuucuucuggguuaauuaacagcaauacagacaacaaucuugcagucuacgaccucucucgggauauuuuaaauaauuucccacacucaauagccaggcagaagcgaauauugguaaaccucaguaugguggaaaacaagcugguugaacuggaacauacucuacuuagcaaggguuucagaggugcaucaccucaccggaaauccaccuaa

SEQ ID NO: 2143 - RNA, 342 nt, Artificial Sequence
  derived and/or modified sequence opt1 from KK-LC-1__Homo_sapiens__AAH62223
augaacuucuaccugcuccuggccagcuccauccugugcgcccucaucguguucuggaaguaccgccgguuccagcgcaacaccggcgagaugagcuccaacagcaccgcgcuggcccugguccggcccuccagcuccgggcucaucaacagcaacacggacaacaaccuggccguguacgaccugucccgcgacauccucaacaacuucccgcacagcaucgcccggcagaagcgcauccuggugaaccuguccauggucgagaacaagcucguggagcuggagcacacccugcucagcaagggcuuccgcggggccagcccccaccggaaguccaccuga

SEQ ID NO: 2144 - RNA, 342 nt, Artificial Sequence
  derived and/or modified sequence opt2 from KK-LC-1__Homo_sapiens__AAH62223
augaacuucuaccuccuccucgccuccuccauccucugcgcccucaucgucuucuggaaguaccgccgcuuccagcgcaacaccggcgagauguccuccaacuccaccgcccucgcccucguccgccccuccuccuccggccucaucaacuccaacaccgacaacaaccucgccgucuacgaccucucccgcgacauccucaacaacuucccccacuccaucgcccgccagaagcgcauccucgucaaccucuccauggucgagaacaagcucgucgagcucgagcacacccuccucuccaagggcuuccgcggcgccuccccccaccgcaaguccaccuga

SEQ ID NO: 2145 - RNA, 342 nt, Artificial Sequence
  derived and/or modified sequence opt3 from KK-LC-1__Homo_sapiens__AAH62223
augaacuucuaccugcuccuugccagcuccauccugugcgcuuugauuguguuuuggaaguauagaagguuccagcggaauaccggcgagaugucuucaaacaguacagcauuagcccugguccgccccagcuccucugggcuaauaaauucgaacacugacaauaaccucgcgguuuacgaucugucacgagacauccuuaauaacuuuccucacagcauugcucgucaaaaacggauccuggugaauuugaguaugguagaaaacaagcucguggagcuggaacauacgcugcucuccaaaggauucaggggugccucuccacacagaaagagcaccuga

SEQ ID NO: 2146 - RNA, 342 nt, Artificial Sequence
  derived and/or modified sequence opt4 from KK-LC-1__Homo_sapiens__AAH62223
augaacuucuaccugcugcuggccagcagcauccugugcgcccugaucguguucuggaaguacagaagauuccagagaaacaccggcgagaugagcagcaacagcaccgcccuggcccuggugagacccagcagcagcggccugaucaacagcaacaccgacaacaaccuggccguguacgaccugagcagagacauccugaacaacuucccccacagcaucgccagacagaagagaauccuggugaaccugagcaugguggagaacaagcugguggagcuggagcacacccugcugagcaagggcuucagaggcgccagcccccacagaaagagcaccuga

SEQ ID NO: 2147 - RNA, 342 nt, Artificial Sequence
  derived and/or modified sequence opt5 from KK-LC-1__Homo_sapiens__AAH62223
augaacuucuaccugcuccuggccagcuccauccuuugcgcucugauuguguuuuggaaguauagacgguuccagcgcaauaccggcgagaugucuagcaacuccacagcccucgcgcuggucagacccucuagcuccgggcuuaucaauucuaacacggacaauaaccuggcuguuuacgaucucagccgggacauucugaauaacuuuccucacuccaucgcccgccaaaaacggauucuggugaaucucagcaugguggaaaacaagcuggucgagcuugaacauacccugcucucuaaaggauucagaggcgccuccccgcaccgcaagagcacauga

SEQ ID NO: 2148 - protein, 860 aa, Artificial Sequence [sequence omitted]

SEQ ID NO: 2149 - RNA, 2583 nt, Artificial Sequence
  LDLR__Homo_sapiens__AAA56833
auggggcccuggggcuggaaauugcgcuggaccgucgccuugcuccucgccgcggcggggacugcagugggcgacagaugugaaagaaacgaguuccagugccaagacgggaaaugcaucuccuacaagugggucugcgauggcagcgcugagugccaggauggcucugaugagucccaggagacgugcuugucugucaccugcaaauccggggacuucagcugugggggccgugucaaccgcugcauuccucaguucuggaggugcgauggccaaguggacugcgacaacggcucagacgagcaaggcuguccccccaagacgugcucccaggacgaguuucgcugccacgaugggaagugcaucucucggcaguucgucugugacucagaccgggacugcuuggacggcucagacgaggccuccugcccggugcucaccuguggucccgccagcuuccagugcaacagcuccaccugcaucccccagcugugggccugcgacaacgaccccgacugcgaagauggcucggaugaguggccgcagcgcuguaggggucuuuacguguuccaaggggacaguagccccugcucggccuucgaguuccacugccuaaguggcgagugcauccacuccagcuggcgcugugaugguggccccgacugcaaggacaaaucugacgaggaaaacugcgcuguggccaccugucgcccugacgaauuccagugcucugauggaaacugcauccauggcagccggcagugugaccgggaauaugacugcaaggacaugagcgaugaaguuggcugcguuaaugugacacucugcgagggacccaacaaguucaagugucacagcggcgaaugcaucacccuggacaaagucugcaacauggcuagagacugccgggacuggucagaugaacccaucaaagagugcgggaccaacgaaugcuuggacaacaacggcggcuguucccacgucugcaaugaccuuaagaucggcuacgagugccugugccccgacggcuuccagcugguggcccagcgaagaugcgaagauaucgaugagugucaggaucccgacaccugcagccagcucugcgugaaccuggaggguggcuacaagugccagugugaggaaggcuuccagcuggacccccacacgaaggccugcaaggcugugggcuccaucgccuaccucuucuucaccaaccggcacgaggucaggaagaugacgcuggaccggagcgaguacaccagccucauccccaaccugaggaacguggucgcucuggacacggagguggccagcaauagaaucuacuggucugaccugucccagagaaugaucugcagcacccagcuugacagagcccacggcgucucuuccuaugacaccgucaucagcagggacauccaggcccccgacgggcuggcuguggacuggauccacagcaacaucuacuggaccgacucuguccugggcacugucucuguugcggauaccaagggcgugaagaggaaaacguuauucagggagaacggcuccaagccaagggccaucgugguggauccuguucauggcuucauguacuggacugacuggggaacucccgccaagaucaagaaagggggccugaaugguguggacaucuacucgcuggugacugaaaacauucaguggcccaauggcaucacccuagaucuccucaguggccgccucuacuggguugacuccaaacuucacuccaucucaagcaucgaugucaaugggggcaaccggaagaccaucuuggaggaugaaaagaggcuggcccaccccuucuccuuggccgucuuugaggacaaaguauuuuggacagauaucaucaacgaagccauuuucagugccaaccgccucacagguuccgaugucaacuuguuggcugaaaaccuacuguccccagaggauaugguccucuuccacaaccucacccagccaagaggagugaacuggugugagaggaccacccugagcaauggcggcugccaguaucugugccucccugccccgcagaucaacccccacucgcccaaguuuaccugcgccugcccggacggcaugcugcuggccagggacaugaggagcugccucacagaggcugaggcugcaguggccacccaggagacauccaccgucaggcuaaaggucagcuccacagccguaaggacacagcacacaaccacccggccuguucccgacaccucccggcugccuggggccaccccugggcucaccacgguggagauagugacaaugucucaccaagcucugggcgacguugcuggcagaggaaaugagaagaagcccaguagcgugagggcucuguccauuguccuccccaucgugcuccucgucuuccuuugccugggggucuuccuucuauggaagaacuggcggcuuaagaacaucaacagcaucaacuuugacaaccccgucuaucagaagaccacagaggaugagguccacauuugccacaaccaggacggcuacagcuaccccucgagacagauggucagucuggaggaugacguggcguga

SEQ ID NO: 2150 - RNA, 2583 nt, Artificial Sequence
  derived and/or modified sequence opt1 from LDLR__Homo_sapiens__AAA56833
augggccccuggggguggaagcugcgcuggaccguggcccuccugcuggccgcggccggcaccgccgucggggaccggugcgagcgcaacgaguuccagugccaggacggcaagugcaucagcuacaagugggugugcgacggguccgccgagugccaggacggcagcgacgagucccaggagacgugccucagcgugaccugcaaguccggcgacuucagcugcgggggccgggucaaccgcugcaucccgcaguucuggcggugcgacggccagguggacugcgacaacggguccgacgagcaggggugcccgcccaagaccugcagccaggacgaguuccgcugccacgacggcaagugcaucucccggcaguucgugugcgacagcgaccgcgacugccuggacggcuccgacgaggccagcugccccguccugaccugcgggcccgcguccuuccagugcaacagcuccacgugcaucccccagcucugggccugcgacaacgaccccgacugcgaggacggcagcgacgaguggccccagcggugccgcgggcuguacguguuccagggcgacuccagcccgugcuccgccuucgaguuccacugccugagcggcgagugcauccacagcuccuggcggugcgacgggggccccgacugcaaggacaagagcgacgaggagaacugcgccguggcgaccugccgccccgacgaguuccagugcuccgacgggaacugcauccacggcagccggcagugcgaccgcgaguacgacugcaaggacauguccgacgaggucgggugcgugaacgugacccucugcgagggccccaacaaguucaagugccacagcggcgagugcaucacccuggacaaggucugcaacauggcccgggacugccgcgacugguccgacgagccgaucaaggagugcgggacgaacgagugccuggacaacaacggcgggugcagccacgugugcaacgaccucaagaucggcuacgagugccugugccccgacggguuccagcugguggcccagcggcgcugcgaggacaucgacgagugccaggaccccgacacgugcucccagcucugcgucaaccuggagggcggcuacaagugccagugcgaggagggguuccagcuggacccccacaccaaggccugcaaggccgugggcagcaucgcguaccucuucuucaccaaccggcacgaggugcgcaagaugacgcuggaccgguccgaguacaccagccugaucccgaaccuccgcaacgucguggcccuggacaccgagguggccuccaaccgcaucuacuggagcgaccugucccagcggaugaucugcagcacccagcucgaccgcgcccacggggucuccagcuacgacacggugaucucccgggacauccaggcccccgacggccuggcgguggacuggauccacagcaacaucuacuggaccgacagcguccuggggaccguguccgucgccgacaccaagggcgugaagcgcaagacccucuuccgggagaacggcagcaagccccgcgccaucguggucgaccccgugcacggguucauguacuggaccgacuggggcaccccggccaagaucaagaagggcgggcugaacggcguggacaucuacucccuggucaccgagaacauccaguggcccaacgggaucacgcucgaccugcugagcggccggcucuacuggguggacuccaagcugcacagcaucuccagcaucgacgugaacgggggcaaccgcaagaccauccuggaggacgagaagcggcucgcccaccccuucucccuggcggucuucgaggacaagguguucuggaccgacaucaucaacgaggccaucuucagcgccaaccgccugaccggguccgacgugaaccuccuggccgagaaccugcucagccccgaggacaugguccuguuccacaaccugacgcagccgcggggcgugaacuggugcgagcgcaccacccucuccaacggcgggugccaguaccugugccugcccgcgccccagaucaacccccacagcccgaaguucacgugcgccugccccgacggcaugcuccuggcccgggacaugcgcuccugccugaccgaggccgaggccgcgguggccacccaggagaccagcaccguccggcugaagguguccagcacggccgugcgcacccagcacaccaccacccggcccgucccggacacgagccgccuccccggggccacccccggccugaccaccguggagaucgugacgaugucccaccaggcccugggggacgucgcgggccggggcaacgagaagaagcccagcuccgugcgcgcccucagcaucgugcugccgaucguccugcucguguuccugugccuggggguguuccuccuguggaagaacuggcgccugaagaacaucaacuccaucaacuucgacaaccccgucuaccagaagaccaccgaggacgaggugcacaucugccacaaccaggacggcuacagcuaccccucccggcagauggugagccucgaggacgacgucgccuga

SEQ ID NO: 2151 - RNA, 2583 nt, Artificial Sequence
  derived and/or modified sequence opt2 from LDLR__Homo_sapiens__AAA56833
augggccccuggggcuggaagcuccgcuggaccgucgcccuccuccucgccgccgccggcaccgccgucggcgaccgcugcgagcgcaacgaguuccagugccaggacggcaagugcaucuccuacaagugggucugcgacggcuccgccgagugccaggacggcuccgacgagucccaggagaccugccucuccgucaccugcaaguccggcgacuucuccugcggcggccgcgucaaccgcugcaucccccaguucuggcgcugcgacggccaggucgacugcgacaacggcuccgacgagcagggcugcccccccaagaccugcucccaggacgaguuccgcugccacgacggcaagugcaucucccgccaguucgucugcgacuccgaccgcgacugccucgacggcuccgacgaggccuccugccccguccucaccugcggccccgccuccuuccagugcaacuccuccaccugcaucccccagcucugggccugcgacaacgaccccgacugcgaggacggcuccgacgaguggccccagcgcugccgcggccucuacgucuuccagggcgacuccucccccugcuccgccuucgaguuccacugccucuccggcgagugcauccacuccuccuggcgcugcgacggcggccccgacugcaaggacaaguccgacgaggagaacugcgccgucgccaccugccgccccgacgaguuccagugcuccgacggcaacugcauccacggcucccgccagugcgaccgcgaguacgacugcaaggacauguccgacgaggucggcugcgucaacgucacccucugcgagggccccaacaaguucaagugccacuccggcgagugcaucacccucgacaaggucugcaacauggcccgcgacugccgcgacugguccgacgagcccaucaaggagugcggcaccaacgagugccucgacaacaacggcggcugcucccacgucugcaacgaccucaagaucggcuacgagugccucugccccgacggcuuccagcucgucgcccagcgccgcugcgaggacaucgacgagugccaggaccccgacaccugcucccagcucugcgucaaccucgagggcggcuacaagugccagugcgaggagggcuuccagcucgacccccacaccaaggccugcaaggccgucggcuccaucgccuaccucuucuucaccaaccgccacgagguccgcaagaugacccucgaccgcuccgaguacaccucccucauccccaaccuccgcaacgucgucgcccucgacaccgaggucgccuccaaccgcaucuacugguccgaccucucccagcgcaugaucugcuccacccagcucgaccgcgcccacggcgucuccuccuacgacaccgucaucucccgcgacauccaggcccccgacggccucgccgucgacuggauccacuccaacaucuacuggaccgacuccguccucggcaccgucuccgucgccgacaccaagggcgucaagcgcaagacccucuuccgcgagaacggcuccaagccccgcgccaucgucgucgaccccguccacggcuucauguacuggaccgacuggggcacccccgccaagaucaagaagggcggccucaacggcgucgacaucuacucccucgucaccgagaacauccaguggcccaacggcaucacccucgaccuccucuccggccgccucuacugggucgacuccaagcuccacuccaucuccuccaucgacgucaacggcggcaaccgcaagaccauccucgaggacgagaagcgccucgcccaccccuucucccucgccgucuucgaggacaaggucuucuggaccgacaucaucaacgaggccaucuucuccgccaaccgccucaccggcuccgacgucaaccuccucgccgagaaccuccucucccccgaggacaugguccucuuccacaaccucacccagccccgcggcgucaacuggugcgagcgcaccacccucuccaacggcggcugccaguaccucugccuccccgccccccagaucaacccccacucccccaaguucaccugcgccugccccgacggcaugcuccucgcccgcgacaugcgcuccugccucaccgaggccgaggccgccgucgccacccaggagaccuccaccguccgccucaaggucuccuccaccgccguccgcacccagcacaccaccacccgccccguccccgacaccucccgccuccccggcgccacccccggccucaccaccgucgagaucgucaccaugucccaccaggcccucggcgacgucgccggccgcggcaacgagaagaagcccuccuccguccgcgcccucuccaucguccuccccaucguccuccucgucuuccucugccucggcgucuuccuccucuggaagaacuggcgccucaagaacaucaacuccaucaacuucgacaaccccgucuaccagaagaccaccgaggacgagguccacaucugccacaaccaggacggcuacuccuaccccucccgccagauggucucccucgaggacgacgucgccuga

SEQ ID NO: 2152 - RNA, 2583 nt, Artificial Sequence
  derived and/or modified sequence opt3 from LDLR__Homo_sapiens__AAA56833
augggccccuggggguggaagcugagauggaccguggcccuccuucuggcugcagccggaacagcggucggugacaggugcgagcggaacgaauuucagugucaagauggcaaaugcaucagcuacaaguggguuugugacggguccgcugagugccaggauggaucugacgaaucacaggagacuuguuugagugugacgugcaaaagcggcgauuuuuccuguggugggcgcguaaaucgaugcauuccucaguucuggcguugugacggacaaguggauugcgacaacggcucugaugaacagggcuguccaccgaagaccugcucgcaggacgaguuuagaugccacgaugggaaauguauaucaaggcaguucgucugcgacagcgaucgggacuguuuagacggaagugaugaggccuccugccccgugcugacaugugguccugcaucuuuucaaugcaauagcuccacuuguaucccacagcuaugggccugcgacaacgaucccgacugugaagauggcucagacgaguggccucagcgcugcagagggcucuauguuuuccagggagauaguagcccauguucugcuuuugaguuccauugccuguccggcgaaugcauucacucaagcuggaggugugacggugggcccgauugcaaggacaagagugaugaggaaaauugugcaguggcuaccugccggccugacgaguuucaauguucugacggaaacugcauccauggcucccgccagugugaucgagaauacgacugcaaagauaugagcgacgaggucggcugugugaauguaacacuuugcgaagggccaaacaaguucaaaugucacucgggagagugcauuacccuggauaagguuugcaauauggccagagacuguagggauuggucugacgagccgaucaaagaaugcgguacuaacgaguguuuggauaauaacggcgggugcucccauguguguaaugaccucaagauaggauaugaaugccugugucccgauggcuuucagcuggucgcccaacggcguugcgaggacaucgaugaaugucaggacccugacacaugcucacagcucugugugaacuuagaggguggguacaagugccagugcgaggaaggcuuccaacuggauccacacaccaaagcguguaaggcagugggaaguauugccuaucuuuucuucacgaaucgccacgaggucagaaaaaugacuuuggacaggagcgaauacaccucccugauccccaaccuacggaacguuguggcucucgauacagagguagccucuaaucgaauuuauuggagcgaccugucacagcgcaugaucugcaguacucagcuugauagagcacauggcguguccagcuacgacaccgucauaucuagggauauucaggcuccugacgggcuggccguggauuggauccacucaaacauuuacuggacagacaguguuuugggaaccgugagcgucgcggauacgaagggugugaaacggaagacucucuuccgcgaaaauggcuccaaaccaagagccaucguaguugaccccgugcauggguuuauguauuggacagauuggggaaccccggcaaagaucaagaaaggcggucugaacggggucgacauuuacucuuuagugacugagaauauacaauggccuaacggcaucacacuggaccuccuuucgggaaggcuguauugggucgauagcaaguugcacuccauuucaaguaucgacgugaauggcgggaaccguaaaaccauacuagaggaugaaaagcggcuggcucaccccuucucucucgccguuuuugaggacaaaguguucuggacggauauuaucaaugaagcuaucuuuagcgccaaccgacugaccggauccgacguaaaucuucuggcagagaacuugcucucaccagaggauaugguccuguuccauaauuuaacacagccuagaggugugaacuggugugaaaggacuacccugagcaauggcgggugccaguaccuaugucuccccgccccacagauuaacccccacucuccuaaguuuacaugcgcuuguccagacggaaugcugcuugcgcgcgauaugcgguccugcuugacugaggcagaagccgcuguugccacccaagagacaaguaccgugagacugaaggucagcucuacugcagugaggacgcagcauacaaccacucgcccgguacccgacaccucccgacucccuggcgccacaccaggucugaccacuguggaaaucguuacaaugucacaccaggcucuuggggaugucgccggccggggaaacgagaaaaagcccaguagcgugcgugcacugucgauuguguugccuauaguccuccugguuuucuuaugucugggcguguuucuacucuggaaaaauuggagacugaagaacaucaauuccauuaacuucgacaauccaguguaucagaaaacgaccgaggacgaaguacauaucugccacaaccaagauggguacucuuaucccagcaggcagauggucucacuugaggacgauguggcguga

SEQ ID NO: 2153 - RNA, 2583 nt, Artificial Sequence
  derived and/or modified sequence opt4 from LDLR__Homo_sapiens__AAA56833
augggccccuggggcuggaagcugagauggaccguggcccugcugcuggccgccgccggcaccgccgugggcgacagaugcgagagaaacgaguuccagugccaggacggcaagugcaucagcuacaagugggugugcgacggcagcgccgagugccaggacggcagcgacgagagccaggagaccugccugagcgugaccugcaagagcggcgacuucagcugcggcggcagagugaacagaugcaucccccaguucuggagaugcgacggccagguggacugcgacaacggcagcgacgagcagggcugcccccccaagaccugcagccaggacgaguucagaugccacgacggcaagugcaucagcagacaguucgugugcgacagcgacagagacugccuggacggcagcgacgaggccagcugccccgugcugaccugcggccccgccagcuuccagugcaacagcagcaccugcaucccccagcugugggccugcgacaacgaccccgacugcgaggacggcagcgacgaguggccccagagaugcagaggccuguacguguuccagggcgacagcagccccugcagcgccuucgaguuccacugccugagcggcgagugcauccacagcagcuggagaugcgacggcggccccgacugcaaggacaagagcgacgaggagaacugcgccguggccaccugcagacccgacgaguuccagugcagcgacggcaacugcauccacggcagcagacagugcgacagagaguacgacugcaaggacaugagcgacgaggugggcugcgugaacgugacccugugcgagggccccaacaaguucaagugccacagcggcgagugcaucacccuggacaaggugugcaacauggccagagacugcagagacuggagcgacgagcccaucaaggagugcggcaccaacgagugccuggacaacaacggcggcugcagccacgugugcaacgaccugaagaucggcuacgagugccugugccccgacggcuuccagcugguggcccagagaagaugcgaggacaucgacgagugccaggaccccgacaccugcagccagcugugcgugaaccuggagggcggcuacaagugccagugcgaggagggcuuccagcuggacccccacaccaaggccugcaaggccgugggcagcaucgccuaccuguucuucaccaacagacacgaggugagaaagaugacccuggacagaagcgaguacaccagccugauccccaaccugagaaacgugguggcccuggacaccgagguggccagcaacagaaucuacuggagcgaccugagccagagaaugaucugcagcacccagcuggacagagcccacggcgugagcagcuacgacaccgugaucagcagagacauccaggcccccgacggccuggccguggacuggauccacagcaacaucuacuggaccgacagcgugcugggcaccgugagcguggccgacaccaagggcgugaagagaaagacccuguucagagagaacggcagcaagcccagagccaucgugguggaccccgugcacggcuucauguacuggaccgacuggggcacccccgccaagaucaagaagggcggccugaacggcguggacaucuacagccuggugaccgagaacauccaguggcccaacggcaucacccuggaccugcugagcggcagacuguacuggguggacagcaagcugcacagcaucagcagcaucgacgugaacggcggcaacagaaagaccauccuggaggacgagaagagacuggcccaccccuucagccuggccguguucgaggacaagguguucuggaccgacaucaucaacgaggccaucuucagcgccaacagacugaccggcagcgacgugaaccugcuggccgagaaccugcugagccccgaggacauggugcuguuccacaaccugacccagcccagaggcgugaacuggugcgagagaaccacccugagcaacggcggcugccaguaccugugccugcccgccccccagaucaacccccacagccccaaguucaccugcgccugccccgacggcaugcugcuggccagagacaugagaagcugccugaccgaggccgaggccgccguggccacccaggagaccagcaccgugagacugaaggugagcagcaccgccgugagaacccagcacaccaccaccagacccgugcccgacaccagcagacugcccggcgccacccccggccugaccaccguggagaucgugaccaugagccaccaggcccugggcgacguggccggcagaggcaacgagaagaagcccagcagcgugagagcccugagcaucgugcugcccaucgugcugcugguguuccugugccugggcguguuccugcuguggaagaacuggagacugaagaacaucaacagcaucaacuucgacaaccccguguaccagaagaccaccgaggacgaggugcacaucugccacaaccaggacggcuacagcuaccccagcagacagauggugagccuggaggacgacguggccuga

SEQ ID NO: 2154 - RNA, 2583 nt, Artificial Sequence
  derived and/or modified sequence opt5 from LDLR__Homo_sapiens__AAA56833
augggccccuggggguggaagcugagauggaccguggcccuccugcuugcugccgcgggaacagcugucggcgaccggugcgagcgcaacgaguuccagugucaagaugggaaaugcaucagcuacaaguggguuugugacggauccgccgaaugccaggauggcucugacgaaagccaggagacgugucuguccgugaccugcaaaucuggggauuuuagcuguggaggcagagugaaucggugcauuccucaguucuggcgcugugacggccaagucgauugcgacaacggguccgaugaacagggauguccgcccaagacaugcucucaggacgaguuuagaugccacgauggcaaauguaucagccggcaguucgugugcgacuccgaucgcgacugucucgacgggagcgaugaggccucuugcccuguucugaccuguggacccgcuuccuuucaaugcaauagcucuacauguauuccucagcuuugggccugcgacaacgaucccgacugugaagauggcuccgacgaguggccucagagaugccgggggcuguauguguuccagggagauagcucuccguguuccgcuuuugaguuccauugccucagcggcgaaugcauccacuccucuuggcgcugugacggcgggcccgauugcaaggacaagagcgaugaggaaaauugugccgucgcgaccugcagaccugacgaguuucaauguuccgacggaaacugcauucauggcagccggcagugugaucgcgaauacgacugcaaagauaugucugacgaggugggguguguuaaugugacacugugcgaaggacccaacaaguucaaaugucacuccggcgagugcaucacccuggauaaggucugcaauauggccagagacugucgggauuggagcgacgagccuaucaaagaaugcgggacgaacgagugucucgauaauaacggaggcugcucucauguguguaaugaccugaagauuggcuaugaaugccuuugucccgauggguuucagcugguggcucaacgcagaugcgaggacaucgaugaaugucaggacccggauaccugcagccagcucugugucaaccuggagggaggcuacaagugccagugcgaggaaggguuccaacuugacccucacacaaaagccuguaaggcuguuggauccauugccuaucuguuuuucaccaaucggcacgaggugagaaaaaugacacucgaccgcucugaauacaccagccugauccccaaccugcggaacguggucgcgcucgauacggagguggccuccaauagaauuuauuggagcgaccugucucagcgcaugaucugcuccacacagcuugaucgggcucauggcguuagcucuuacgacaccgugauuuccagagauauccaggccccugacgggcuggcugucgauuggauccacagcaacauuuacuggacagacuccgugcucggcaccguuucuguggccgauaccaagggagucaaacgcaagacacuguuccgggaaaauggcagcaaacccagagccaucguggucgaccccgugcauggguuuauguauuggacggauuggggaaccccugcuaagauuaagaaaggcgggcuuaacggaguugacaucuacucccuggugacagagaauauucaauggccgaacggcaucacccucgaccugcugucugggcgccucuauugggucgauagcaagcugcacuccaucagcucuauugacgugaauggcggaaaccggaaaacaauccuugaggaugaaaagagacuggcgcaccccuucucccucgccguuuuugaggacaaaguguucuggaccgauauuaucaaugaagcuauuuuuagcgccaaccgccugacgggcucugacgucaaucuucuggccgagaaccuccuguccccugaggauauggugcuguuccauaaucucacacagcccagaggggugaacuggugugaacggaccacccugagcaauggaggcugccaguaccuuugucugccugcuccccagaucaacccgcacucuccuaaguuuacaugcgccugucccgacgggaugcuccuggcgcgggauaugcgcagcugccugaccgaggcugaagccgccguugcuacacaagagacguccaccgucagacuuaaggugagcucuacagccgugcggacccagcauacaaccacgagaccuguccccgacaccucccgccucccuggagcuacacccggccugaccacaguggaaaucguuaccaugagccaccaggcccugggggauguggcgggccggggaaacgagaaaaagccguccucugucagagcccucagcauugugcugccuaucguucuucugguguuccucugucugggcgucuuucugcuuuggaaaaauuggcgccucaagaacauuaauuccaucaacuucgacaaucccguguaucagaaaacgacagaggacgaaguucauauuugccacaaccaagauggguacucuuaucccagcagacagauggugucccuggaggacgaugucgcuuga

SEQ ID NO: 2155 - protein, 433 aa, Artificial Sequence
  LGMN__Homo_sapiens__Q99538
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 2156 - RNA, 1302 nt, Artificial Sequence
  LGMN__Homo_sapiens__CAA70989
augguuuggaaaguagcuguauuccucaguguggcccugggcauuggugccguuccuauagaugauccugaagauggaggcaagcacuggguggugaucguggcagguucaaauggcugguauaauuauaggcaccaggcagacgcgugccaugccuaccagaucauucaccgcaaugggauuccugacgaacagaucguugugaugauguacgaugacauugcuuacucugaagacaaucccacuccaggaauugugaucaacaggcccaauggcacagaugucuaucagggagucccgaaggacuacacuggagaggauguuaccccacaaaauuuccuugcuguguugagaggcgaugcagaagcagugaagggcauaggauccggcaaaguccugaagaguggcccccaggaucacguguucauuuacuucacugaccauggaucuacuggaauacugguuuuucccaaugaagaucuucauguaaaggaccugaaugagaccauccauuacauguacaaacacaaaauguaccgaaagaugguguucuacauugaagccugugagucuggguccaugaugaaccaccugccggauaacaucaauguuuaugcaacuacugcugccaaccccagagagucguccuacgccuguuacuaugaugagaagagguccacguaccugggggacugguacagcgucaacuggauggaagacucggacguggaagaucugacuaaagagacccugcacaagcaguaccaccugguaaaaucgcacaccaacaccagccacgucaugcaguauggaaacaaaacaaucuccaccaugaaagugaugcaguuucaggguaugaaacgcaaagccaguucucccgucccccuaccuccagucacacaccuugaccucacccccagcccugaugugccucucaccaucaugaaaaggaaacugaugaacaccaaugaucuggaggaguccaggcagcucacggaggagauccagcggcaucuggaugccaggcaccucauugagaagucagugcguaagaucgucuccuugcuggcagcguccgaggcugagguggagcagcuccuguccgagagagccccgcucacggggcacagcugcuacccagaggcccugcugcacuuccggacccacugcuucaacuggcacucccccacguacgaguaugcguugagacauuuguacgugcuggucaaccuuugugagaagccguauccacuucacaggauaaaauuguccauggaccacgugugccuuggucacuacuga

SEQ ID NO: 2157 - RNA, 1302 nt, Artificial Sequence
  derived and/or modified sequence opt1 from LGMN__Homo_sapiens__CAA70989
augguguggaaggucgccguguuccugagcguggcccucggcaucggggcgguccccaucgacgacccggaggacggcgggaagcacuggguggugaucgucgccggcuccaacgggugguacaacuaccgccaccaggccgacgccugccacgccuaccagaucauccaccggaacggcauccccgacgagcagaucguggugaugauguacgacgacaucgcguacagcgaggacaaccccacccccggcaucgucaucaaccgcccgaacgggaccgacguguaccagggcgugcccaaggacuacacgggggaggacgucacgccccagaacuuccuggccgugcugcggggcgacgccgaggccgugaaggggaucggcuccggcaagguccucaagagcgggccccaggaccacguguucaucuacuucaccgaccacggcuccaccgggauccugguguucccgaacgaggaccugcacgucaaggaccucaacgagaccauccacuacauguacaagcacaagauguaccgcaagaugguguucuacaucgaggcgugcgagagcggcuccaugaugaaccaccuccccgacaacaucaacguguacgccaccaccgccgccaacccccgggagagcuccuacgccugcuacuacgacgagaagcgcagcaccuaccugggcgacugguacuccgucaacuggauggaggacagcgacguggaggaccugacgaaggagacccugcacaagcaguaccaccuggugaagucccacaccaacaccagccacgucaugcaguacgggaacaagacgaucuccaccaugaaggugaugcaguuccagggcaugaagcggaaggcgagcucccccgucccgcucccgcccgugacccaccuggaccugacccccagccccgacgugccccucacgaucaugaagcgcaagcugaugaacaccaacgaccuggaggagucccggcagcucaccgaggagauccagcgccaccuggacgcccggcaccugaucgagaaguccguccgcaagaucgugagccuccuggccgccagcgaggccgagguggagcagcugcucagcgagcgggcgccccugaccgggcacuccugcuaccccgaggcccugcuccacuuccgcacgcacugcuucaacuggcacagcccgaccuacgaguacgcccugcggcaccuguacguccucgugaaccugugcgagaagcccuacccccugcaccgcaucaagcucuccauggaccacgugugccugggccacuacuga

SEQ ID NO: 2158 - RNA, 1302 nt, Artificial Sequence
  derived and/or modified sequence opt2 from LGMN__Homo_sapiens__CAA70989
auggucuggaaggucgccgucuuccucuccgucgcccucggcaucggcgccguccccaucgacgaccccgaggacggcggcaagcacugggucgucaucgucgccggcuccaacggcugguacaacuaccgccaccaggccgacgccugccacgccuaccagaucauccaccgcaacggcauccccgacgagcagaucgucgucaugauguacgacgacaucgccuacuccgaggacaaccccacccccggcaucgucaucaaccgccccaacggcaccgacgucuaccagggcguccccaaggacuacaccggcgaggacgucaccccccagaacuuccucgccguccuccgcggcgacgccgaggccgucaagggcaucggcuccggcaagguccucaaguccggcccccaggaccacgucuucaucuacuucaccgaccacggcuccaccggcauccucgucuuccccaacgaggaccuccacgucaaggaccucaacgagaccauccacuacauguacaagcacaagauguaccgcaagauggucuucuacaucgaggccugcgaguccggcuccaugaugaaccaccuccccgacaacaucaacgucuacgccaccaccgccgccaacccccgcgaguccuccuacgccugcuacuacgacgagaagcgcuccaccuaccucggcgacugguacuccgucaacuggauggaggacuccgacgucgaggaccucaccaaggagacccuccacaagcaguaccaccucgucaagucccacaccaacaccucccacgucaugcaguacggcaacaagaccaucuccaccaugaaggucaugcaguuccagggcaugaagcgcaaggccuccucccccgucccccucccccccgucacccaccucgaccucacccccucccccgacgucccccucaccaucaugaagcgcaagcucaugaacaccaacgaccucgaggagucccgccagcucaccgaggagauccagcgccaccucgacgcccgccaccucaucgagaaguccguccgcaagaucgucucccuccucgccgccuccgaggccgaggucgagcagcuccucuccgagcgcgccccccucaccggccacuccugcuaccccgaggcccuccuccacuuccgcacccacugcuucaacuggcacucccccaccuacgaguacgcccuccgccaccucuacguccucgucaaccucugcgagaagcccuacccccuccaccgcaucaagcucuccauggaccacgucugccucggccacuacuga

SEQ ID NO: 2159 - RNA, 1302 nt, Artificial Sequence
  derived and/or modified sequence opt3 from LGMN__Homo_sapiens__CAA70989
augguguggaaggucgccguuuuccugagcguggcucucggcaucggggcaguacccauugacgauccugaggacggagguaaacacuggguggucauaguggccggcuccaacgggugguacaauuauagacaucaggcggaugcuugccacgccuaccaaaucauucauaggaacggaaucccagacgaacagauuguugugaugauguaugaugacaucgcauacucugaggauaauccgacccccggcauagucaucaaccggccuaaugguacagacguguaucaggggguaccaaaggauuacacuggagaagacguuacgccccagaacuuucuugccgugcugcgcggcgaugcugaggcagucaaaggcauugggucaggaaagguguugaaaagugguccucaagaccacguguucaucuauuuuaccgaucauggcagcacagggauuuuagucuucccaaaugaagaccugcacguuaaggaccuaaacgagacuauccacuacauguacaagcauaaaauguaucgaaagaugguguuuuacauagaggccugugaauccggaucuaugaugaaucaccuccccgauaacauuaauguauaugcuaccacagccgcgaacccucgugagucgucauacgcaugcuauuacgacgagaaaagaagcaccuaucugggcgauugguacagugugaauuggauggaagacuccgaugucgaggaccuuacuaaggaaacacugcauaaacaguaccacuuggugaagucucacaccaacacgagccauguuaugcaguaugguaauaagacuaucuccaccaugaaagugaugcaguuccaagggaugaagaggaaagccucaaguccagucccgcugcccccugugacacaccucgaucugacuccaagccccgacguaccucucaccauuaugaagcggaaauuaaugaacacaaacgaucuggaggaaucucgccagcuuaccgaggaaauccagagacauuuggacgcuaggcaccugaucgagaaguccguucggaaaauugugucacuacucgccgcaagcgaggcugaagucgagcagcugcuuagugaacgcgccccacugacgggacauucuuguuaccccgaggcguugcuccacuuucgaacucacugcuucaauuggcauuccccgacauaugaauacgcccugagacacuuauaugugcuggucaaccucugugagaagccuuacccccuucauaggauaaagcugagcauggaucacgugugcuugggccacuauuga

SEQ ID NO: 2160 - RNA, 1302 nt, Artificial Sequence
  derived and/or modified sequence opt4 from LGMN__Homo_sapiens__CAA70989
augguguggaagguggccguguuccugagcguggcccugggcaucggcgccgugcccaucgacgaccccgaggacggcggcaagcacuggguggugaucguggccggcagcaacggcugguacaacuacagacaccaggccgacgccugccacgccuaccagaucauccacagaaacggcauccccgacgagcagaucguggugaugauguacgacgacaucgccuacagcgaggacaaccccacccccggcaucgugaucaacagacccaacggcaccgacguguaccagggcgugcccaaggacuacaccggcgaggacgugaccccccagaacuuccuggccgugcugagaggcgacgccgaggccgugaagggcaucggcagcggcaaggugcugaagagcggcccccaggaccacguguucaucuacuucaccgaccacggcagcaccggcauccugguguuccccaacgaggaccugcacgugaaggaccugaacgagaccauccacuacauguacaagcacaagauguacagaaagaugguguucuacaucgaggccugcgagagcggcagcaugaugaaccaccugcccgacaacaucaacguguacgccaccaccgccgccaaccccagagagagcagcuacgccugcuacuacgacgagaagagaagcaccuaccugggcgacugguacagcgugaacuggauggaggacagcgacguggaggaccugaccaaggagacccugcacaagcaguaccaccuggugaagagccacaccaacaccagccacgugaugcaguacggcaacaagaccaucagcaccaugaaggugaugcaguuccagggcaugaagagaaaggccagcagccccgugccccugccccccgugacccaccuggaccugacccccagccccgacgugccccugaccaucaugaagagaaagcugaugaacaccaacgaccuggaggagagcagacagcugaccgaggagauccagagacaccuggacgccagacaccugaucgagaagagcgugagaaagaucgugagccugcuggccgccagcgaggccgagguggagcagcugcugagcgagagagccccccugaccggccacagcugcuaccccgaggcccugcugcacuucagaacccacugcuucaacuggcacagccccaccuacgaguacgcccugagacaccuguacgugcuggugaaccugugcgagaagcccuacccccugcacagaaucaagcugagcauggaccacgugugccugggccacuacuga

SEQ ID NO: 2161 - RNA, 1302 nt, Artificial Sequence
  derived and/or modified sequence opt5 from LGMN__Homo_sapiens__CAA70989
augguguggaaggucgccguuuuccugagcguggcucucggcaucggggccgugcccauugacgauccugaggacggaggcaaacacugggucgugaucguugcgggguccaacggaugguacaauuauagacaucaggcugaugccugccacgccuaccaaauuauccaucggaacggcauuccggacgaacagaucguggucaugauguaugaugacaucgcuuacucugaggauaaucccaccccugggauugugaucaaccgccccaauggaacagacguuuaucagggcgugccuaaggauuacacgggcgaagacgucacaccccagaacuuucuggccgugcuuagaggggaugcugaggccgugaaaggaauuggcagcgggaagguccugaaauccggaccucaagaccacguuuucaucuauuuuaccgaucauggcucuaccgggauucucguguucccgaaugaagaccugcacgugaaggaccuuaacgagacaauccacuacauguacaagcauaaaauguaucggaagauggucuuuuacauugaggcgugugaaagcggauccaugaugaaucaucugcccgauaacaucaauguguaugccaccacagcugccaacccucgcgagucuagcuacgcuugcuauuacgacgagaaaagauccaccuaucucggcgauugguacagcguuaauuggauggaggacucugauguggaggaccugacgaaggaaacccugcacaaacaguaccaccucgucaagucccacacaaacaccagccaugugaugcaguauggcaauaagacaaucucuaccaugaaaguuaugcaguuccaagggaugaagcggaaagccuccagccccgugccucugcccccggucacgcaccuugaucugacaccuucucccgacgugccucucaccauuaugaagcgcaaacugaugaacacaaacgaucuugaggaauccagacagcugaccgaggaaauccagcggcaucucgacgcgcgccaccugauugaaaagagcgucagaaaaaucgugucccugcucgccgcuucugaggccgaaguugagcagcugcuuagcgaacgggcuccccugaccggacauuccuguuaccccgaggcccuccugcacuuucgcacacacugcuucaauuggcauagcccuacguaugaauacgcccuuagacaccuguaugugcucgucaaccugugugagaagccguacccccugcaucggauuaagcucucuauggaucacgugugccugggccacuauuga

SEQ ID NO: 2162 - protein, 598 aa, Artificial Sequence
  LIRB2__Homo_sapiens__Q8N423
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 2163 - RNA, 1797 nt, Artificial Sequence
  LIRB2__Homo_sapiens__AAL36991
augacccccaucgucacaguccugaucugucucgggcugagucugggccccaggacccacgugcagacagggaccauucccaagcccacccugugggcugagccagacucugugaucacccaggggagucccgucacccucaguugucaggggagccuugaagcccaggaguaccgucuauauagggagaaaaaaucagcaucuuggauuacacggauacgaccagagcuugugaagaacggccaguuccacaucccauccaucaccugggaacacacagggcgauauggcugucaguauuacagccgcgcucgguggucugagcucagugacccccuggugcuggugaugacaggagccuacccaaaacccacccucucagcccagcccagcccuguggugaccucaggaggaagggugacccuccagugugagucacagguggcauuuggcggcuucauucuguguaaggaaggagaagaagaacacccacaaugccugaacucccagccccaugcccgugggucgucccgcgccaucuucuccgugggccccgugagcccgaaucgcagguggucgcacaggugcuaugguuaugacuugaacucucccuauguguggucuucacccagugaucuccuggagcuccuggucccagguguuucuaagaagccaucacucucagugcagccggguccugucguggccccuggggaaagccugacccuccagugugucucugaugucggcuaugacagauuuguucuguacaaggagggggaacgugaccuucgccagcucccuggccggcagccccaggcugggcucucccaggccaacuucacccugggcccugugagccgcuccuacgggggccaguacagaugcuacggugcacacaaccucuccucugagugcucggcccccagcgacccccuggacauccugaucacaggacagauccguggcacacccuucaucucagugcagccaggccccacaguggccucaggagagaacgugacccugcugugucagucauggcggcaguuccacacuuuccuucugaccaaggcgggagcagcugaugccccacuccgucuaagaucaauacacgaauauccuaaguaccaggcugaauuccccaugaguccugugaccucagcccacgcggggaccuacaggugcuacggcucacucaacuccgaccccuaccugcugucucaccccagugagccccuggagcucguggucucaggacccuccauggguuccagccccccacccaccggucccaucuccacaccugcaggcccugaggaccagccccucacccccacugggucggauccccaaaguggucugggaaggcaccuggggguugugaucggcaucuugguggccgucguccuacugcuccuccuccuccuccuccucuuccucauccuccgacaucgacgucagggcaaacacuggacaucgacccagagaaaggcugauuuccaacauccugcaggggcuguggggccagagcccacagacagaggccugcaguggagguccagcccagcugccgacgcccaggaagaaaaccucuaugcugccgugaaggacacacagccugaagaugggguggagauggacacucgggcugcugcaucugaagccccccaggaugugaccuacgcccagcugcacagcuugacccucagacggaaggcaacugagccuccuccaucccaggaaagggaaccuccagcugagcccagcaucuacgccacccuggccauccacuag

SEQ ID NO: 2164 - RNA, 1797 nt, Artificial Sequence
  derived and/or modified sequence opt1 from LIRB2__Homo_sapiens__AAL36991
augacccccaucgugaccguccugaucugccucggccugagccuggggccgcgcacgcacgugcagaccggcaccauccccaagcccacccucugggccgagcccgacuccgugaucacgcaggggagcccggucacccuguccugccagggcagccuggaggcccaggaguaccggcucuaccgcgagaagaaguccgcgagcuggaucacccggauccgccccgagcuggugaagaacgggcaguuccacauccccuccaucaccugggagcacacgggccgguacggcugccaguacuacagccgcgcccggugguccgagcugagcgacccccucgugcuggucaugaccggggccuacccgaagcccacccuguccgcccagcccagccccguggugaccuccggcgggcgcgucacgcuccagugcgagagccagguggccuucggcggguucauccugugcaaggagggcgaggaggagcacccgcagugccugaacucccagccccacgcgcggggcagcucccgcgccaucuucagcguggggcccgucucccccaaccggcgcuggagccaccggugcuacggcuacgaccucaacagcccguacgugugguccagccccuccgaccugcuggagcuccuggugcccggggucagcaagaagcccucccugagcgugcagccgggccccguggucgcccccggcgagucccucacccugcagugcgugagcgacgugggguacgaccgcuucguccuguacaaggagggcgagcgggaccuccgccagcugcccgggcggcagccgcaggccggccugucccaggcgaacuucacccucgggcccgugagccgcuccuacggcggccaguaccggugcuacggggcccacaaccugagcuccgagugcagcgcccccuccgacccccuggacauccucaucaccggccagauccgcgggacgccguucaucagcgugcagcccggccccaccgucgccuccggggagaacgugacccugcugugccagagcuggcggcaguuccacaccuuccuccugacgaaggccggcgcggccgacgccccgcugcgccuccgcuccauccacgaguaccccaaguaccaggccgaguuccccaugagccccgucaccagcgcccacgcgggcaccuaccggugcuacgggucccugaacagcgacccguaccugcucucccaccccagcgagccccuggagcuggugguguccggccccagcaugggguccagcccgccgcccaccggccccaucuccacgcccgccgggcccgaggaccagccccucacccccaccggcagcgacccgcaguccggccuggggcgccaccugggcgucgugaucgggauccucguggccgucgugcugcugcuccugcugcugcuccugcuguuccucauccugcggcaccgccggcagggcaagcacuggaccagcacgcagcgcaaggccgacuuccagcaccccgccggcgcgguggggcccgagcccaccgaccggggccugcaguggcgcuccagcccggccgccgacgcccaggaggagaaccucuacgccgcggucaaggacacccagcccgaggacgggguggagauggacacccgggccgccgccuccgaggcgccccaggacgugacguacgcccagcugcacagccugacccuccgccggaaggccaccgagcccccgcccucccaggagcgcgagcccccggccgagcccagcaucuacgccacccuggcgauccacuga

SEQ ID NO: 2165 - RNA, 1797 nt, Artificial Sequence
  derived and/or modified sequence opt2 from LIRB2__Homo_sapiens__AAL36991
augacccccaucgucaccguccucaucugccucggccucucccucggcccccgcacccacguccagaccggcaccauccccaagcccacccucugggccgagcccgacuccgucaucacccagggcucccccgucacccucuccugccagggcucccucgaggcccaggaguaccgccucuaccgcgagaagaaguccgccuccuggaucacccgcauccgccccgagcucgucaagaacggccaguuccacauccccuccaucaccugggagcacaccggccgcuacggcugccaguacuacucccgcgcccgcugguccgagcucuccgacccccucguccucgucaugaccggcgccuaccccaagcccacccucuccgcccagcccucccccgucgucaccuccggcggccgcgucacccuccagugcgagucccaggucgccuucggcggcuucauccucugcaaggagggcgaggaggagcacccccagugccucaacucccagccccacgcccgcggcuccucccgcgccaucuucuccgucggccccgucucccccaaccgccgcuggucccaccgcugcuacggcuacgaccucaacucccccuacgucugguccucccccuccgaccuccucgagcuccucguccccggcgucuccaagaagcccucccucuccguccagcccggccccgucgucgcccccggcgagucccucacccuccagugcgucuccgacgucggcuacgaccgcuucguccucuacaaggagggcgagcgcgaccuccgccagcuccccggccgccagccccaggccggccucucccaggccaacuucacccucggccccgucucccgcuccuacggcggccaguaccgcugcuacggcgcccacaaccucuccuccgagugcuccgcccccuccgacccccucgacauccucaucaccggccagauccgcggcacccccuucaucuccguccagcccggccccaccgucgccuccggcgagaacgucacccuccucugccaguccuggcgccaguuccacaccuuccuccucaccaaggccggcgccgccgacgccccccuccgccuccgcuccauccacgaguaccccaaguaccaggccgaguuccccaugucccccgucaccuccgcccacgccggcaccuaccgcugcuacggcucccucaacuccgaccccuaccuccucucccaccccuccgagccccucgagcucgucgucuccggccccuccaugggcuccucccccccccccaccggccccaucuccacccccgccggccccgaggaccagccccucacccccaccggcuccgacccccaguccggccucggccgccaccucggcgucgucaucggcauccucgucgccgucguccuccuccuccuccuccuccuccuccucuuccucauccuccgccaccgccgccagggcaagcacuggaccuccacccagcgcaaggccgacuuccagcaccccgccggcgccgucggccccgagcccaccgaccgcggccuccaguggcgcuccucccccgccgccgacgcccaggaggagaaccucuacgccgccgucaaggacacccagcccgaggacggcgucgagauggacacccgcgccgccgccuccgaggccccccaggacgucaccuacgcccagcuccacucccucacccuccgccgcaaggccaccgagcccccccccucccaggagcgcgagccccccgccgagcccuccaucuacgccacccucgccauccacuga

SEQ ID NO: 2166 - RNA, 1797 nt, Artificial Sequence
  derived and/or modified sequence opt3 from LIRB2__Homo_sapiens__AAL36991
augacccccaucgugacaguccugauuugccucggccuuagccuggggccuagaacucacguucagacgggaaccauaccaaagccgacauugugggccgagcccgacuccgugaucacucaagguucuccuguaaccuuaucaugucagggcagucuggaagcucaggaguacaggcuauaucgggagaaaaagagcgcauccuggauuacacgcauccgaccagagcucgugaaaaacgggcaguuccauauucccucuaucaccugggaacacacuggacguuacggcugccaauauuacucgagagccagguggucagagcugagcgauccucuuguccuggugaugacaggugcguauccaaagcccaccuugagugcucagccuuccccaguugugacgucugggggacgggucacucuccagugugagagccagguggccuuuggcggcuucauacugugcaaagaaggggaggaagaacauccgcaaugucugaacucccagccccacgcacgcggaucaaguagagccaucuuuagcguagguccuguuucuccaaauaggcgguggucccaucgcugcuacggcuaugaccucaauucacccuacguguggagcaguccuucugauuuacuggagcuuuuggucccagggguguccaagaagcccagccugucggugcagccgggaccugucguugcucccggcgaaucucuaacccuccaguguguguccgacguagguuacgaucgauucgugcuguauaaagagggggaaagagaccuuaggcaacugccaggacggcagccucaggcaggcuugucacaagccaacuuuacacucggccccgucagucguagcuacgggggacaguaucgcugcuacggugcucacaaucuguccucugaguguagcgccccaucagaucccuuagacauucugaucacuggccagauuagagggaccccuuucaucagugugcagccaggaccgacaguugcguccggcgaaaacgugacccuccuuugccaaagcuggaggcaguuucacacguuccuguugacuaaggccggugccgcugaugcaccccuacggcugcgaucuauacaugaguauccuaaauaccaggcagaguuuccaaugucacccgucacaagugcucacgccgggaccuaucgcuguuacggcagccucaauuccgacccuuaccugcuuucucauccaucggaaccccuggaguuggugguaagcggaccguccaugggcucaaguccuccacccacugggccuauuucuacacccgcgggaccagaagaucagccucucacccccacggguagcgacccacaauccggccuggggagacacuuaggaguugugaucggcauucuggucgccgugguccuacuccugcuuuugcugcuccugcuuuuccugaucuugaggcaccggcgccaggguaagcauuggaccucaacacagagaaaagcagauuuucagcacccggcuggggccgugggcccugagcccacugacaggggacuccaauggcguagcucuccagcugccgacgcacaggaagagaaccuguaugccgcuguuaaggauacccagcccgaggacggcguggaaauggauacacgggcggcagccuccgaggcuccucaggacguaacuuacgcccaauuacauagucugacccuacgaagaaaggcaacagaaccacccccuagccaggagagggaaccgccagccgagcccucuaucuaugcuacccucgccauucacuga

SEQ ID NO: 2167 - RNA, 1797 nt, Artificial Sequence
  derived and/or modified sequence opt4 from LIRB2__Homo_sapiens__AAL36991
augacccccaucgugaccgugcugaucugccugggccugagccugggccccagaacccacgugcagaccggcaccauccccaagcccacccugugggccgagcccgacagcgugaucacccagggcagccccgugacccugagcugccagggcagccuggaggcccaggaguacagacuguacagagagaagaagagcgccagcuggaucaccagaaucagacccgagcuggugaagaacggccaguuccacauccccagcaucaccugggagcacaccggcagauacggcugccaguacuacagcagagccagauggagcgagcugagcgacccccuggugcuggugaugaccggcgccuaccccaagcccacccugagcgcccagcccagccccguggugaccagcggcggcagagugacccugcagugcgagagccagguggccuucggcggcuucauccugugcaaggagggcgaggaggagcacccccagugccugaacagccagccccacgccagaggcagcagcagagccaucuucagcgugggccccgugagccccaacagaagauggagccacagaugcuacggcuacgaccugaacagccccuacguguggagcagccccagcgaccugcuggagcugcuggugcccggcgugagcaagaagcccagccugagcgugcagcccggccccgugguggcccccggcgagagccugacccugcagugcgugagcgacgugggcuacgacagauucgugcuguacaaggagggcgagagagaccugagacagcugcccggcagacagccccaggccggccugagccaggccaacuucacccugggccccgugagcagaagcuacggcggccaguacagaugcuacggcgcccacaaccugagcagcgagugcagcgcccccagcgacccccuggacauccugaucaccggccagaucagaggcacccccuucaucagcgugcagcccggccccaccguggccagcggcgagaacgugacccugcugugccagagcuggagacaguuccacaccuuccugcugaccaaggccggcgccgccgacgccccccugagacugagaagcauccacgaguaccccaaguaccaggccgaguuccccaugagccccgugaccagcgcccacgccggcaccuacagaugcuacggcagccugaacagcgaccccuaccugcugagccaccccagcgagccccuggagcugguggugagcggccccagcaugggcagcagccccccccccaccggccccaucagcacccccgccggccccgaggaccagccccugacccccaccggcagcgacccccagagcggccugggcagacaccugggcguggugaucggcauccugguggccguggugcugcugcugcugcugcugcugcugcuguuccugauccugagacacagaagacagggcaagcacuggaccagcacccagagaaaggccgacuuccagcaccccgccggcgccgugggccccgagcccaccgacagaggccugcaguggagaagcagccccgccgccgacgcccaggaggagaaccuguacgccgccgugaaggacacccagcccgaggacggcguggagauggacaccagagccgccgccagcgaggccccccaggacgugaccuacgcccagcugcacagccugacccugagaagaaaggccaccgagcccccccccagccaggagagagagccccccgccgagcccagcaucuacgccacccuggccauccacuga

SEQ ID NO: 2168 - RNA, 1797 nt, Artificial Sequence
  derived and/or modified sequence opt5 from LIRB2__Homo_sapiens__AAL36991
augacccccaucgugacaguccugauuugccucggccugagccuugggccuagaacgcacguucagaccggaacaaucccgaagcccacccugugggccgagccugacuccgugauuacacaaggcucucccgugacccucagcugucaggggucccuggaagcucaggaguaccggcuuuaucgcgagaaaaagucugccagcuggaucacacggauuagaccugagcuggucaaaaacggacaguuccauauccccuccaucaccugggaacacacgggccgcuacgggugccaauauuacucuagagcgcgguggagcgagcucuccgauccucuggugcugguuaugaccggagcuuauccgaagcccacacucagcgcccagccuucucccguggucaccuccggcggccgcgugacacugcagugugagagccagguugccuuugggggauucauucuuugcaaagaaggcgaggaagaacauccucaaugucugaacucucagccccacgcuagaggguccagccgggccaucuuuucugugggaccggucuccccuaaucgcagauggagccaucggugcuacggcuaugaccucaauucccccuacguguggucuagcccuuccgaucugcuugagcugcucgugcccggggucagcaagaagcccucucuguccguucagccuggaccggugguggcucccggcgaaagccugacccuccagugugucucugacgugggcuacgaucgcuucguucuguauaaagagggggaaagagaccuucggcaacugccuggacgccagccccaggccggccucagccaagcgaacuuuacgcuggggccuguguccagaucuuacggaggccaguaucggugcuacggggcccacaaucuuagcuccgaguguagcgcucccucugauccgcuggacauucucaucacaggacagauuagaggcaccccuuucaucuccguccagcccggcccuacaguggccagcggggaaaacguuacccugcugugccaaucuuggcgccaguuucacaccuuccuccugacaaaggcuggagccgcggaugcuccccuucggcugagauccauucaugaguauccuaaauaccaggccgaguuucccaugagcccggugacguccgcccacgcuggcaccuaucgcuguuacgggucucucaauagcgacccuuaccugcuuucccaucccucugaaccccuggagcucgucgugagcggaccuuccaugggcagcucuccgcccccuacagggcccaucuccaccccugccggccccgaagaucagccucugacacccaccggaagcgacccgcaaucuggccuggggcggcaccucggagucgugaucggcauucugguugccgugguccuucugcuccugcugcuucuccugcuguuccucauccugagacaccgccggcaggggaagcauuggacguccacacagagaaaagcugauuuucagcacccugcgggagccgugggccccgagccuaccgaccgcgggcuucaauggcggagcucucccgcugccgacgcccaggaagagaaccuguaugcugccguuaaggauacccagccggaggacggcguggaaauggauacaagagcggcugccagcgaggccccucaggacgucaccuacgcucaacuccauucccugacacugcgccggaaggccacggaacccccucccagccaggagagagaacccccugcugagccgucuauuuaugccacccuugcgauccacuga

SEQ ID NO: 2169 - protein, 165 aa, Artificial Sequence
  LY6K__Homo_sapiens__Q17RY6
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 2170 - RNA, 498 nt, Artificial Sequence
  LY6K__Homo_sapiens__CCDS6385.2
auggcgcugcucgccuugcugcuggucguggcccuaccgcggguguggacagacgccaaccugacugcgagacaacgagauccagaggacucccagcgaacggacgagggugacaauagaguguggugucauguuugugagagagaaaacacuuucgagugccagaacccaaggaggugcaaauggacagagccauacugcguuauagcggccgugaaaauauuuccacguuuuuucaugguugcgaagcagugcuccgcugguugugcagcgauggagagacccaagccagaggagaagcgguuucuccuggaagagcccaugcccuucuuuuaccucaaguguuguaaaauucgcuacugcaauuuagaggggccaccuaucaacucaucaguguucaaagaauaugcugggagcaugggugagagcuguggugggcuguggcuggccauccuccugcugcuggccuccauugcagccggccucagccugucuuga

SEQ ID NO: 2171 - RNA, 498 nt, Artificial Sequence
  derived and/or modified sequence opt1 from LY6K__Homo_sapiens__CCDS6385.2
auggcccugcucgcccugcugcucguggucgcgcugccccgcguguggaccgacgccaaccugaccgcccggcagcgcgacccggaggacagccagcggacggacgagggcgacaaccgcguguggugccacgucugcgagcgggagaacaccuucgagugccagaacccccgccggugcaaguggaccgagcccuacugcgugaucgccgccgugaagaucuucccccgcuucuucauggucgcgaagcagugcuccgccgggugcgccgccauggagcggccgaagcccgaggagaagcgcuuccuccuggaggagcccaugcccuucuucuaccugaagugcugcaagauccgguacugcaaccucgagggcccgcccaucaacagcuccguguucaaggaguacgcggggagcaugggcgaguccugcgggggccuguggcuggccauccuccugcugcucgccagcaucgccgccggccugucccugagcuga

SEQ ID NO: 2172 - RNA, 498 nt, Artificial Sequence
  derived and/or modified sequence opt2 from LY6K__Homo_sapiens__CCDS6385.2
auggcccuccucgcccuccuccucgucgucgcccucccccgcgucuggaccgacgccaaccucaccgcccgccagcgcgaccccgaggacucccagcgcaccgacgagggcgacaaccgcgucuggugccacgucugcgagcgcgagaacaccuucgagugccagaacccccgccgcugcaaguggaccgagcccuacugcgucaucgccgccgucaagaucuucccccgcuucuucauggucgccaagcagugcuccgccggcugcgccgccauggagcgccccaagcccgaggagaagcgcuuccuccucgaggagcccaugcccuucuucuaccucaagugcugcaagauccgcuacugcaaccucgagggcccccccaucaacuccuccgucuucaaggaguacgccggcuccaugggcgaguccugcggcggccucuggcucgccauccuccuccuccucgccuccaucgccgccggccucucccucuccuga

SEQ ID NO: 2173 - RNA, 498 nt, Artificial Sequence
  derived and/or modified sequence opt3 from LY6K__Homo_sapiens__CCDS6385.2
auggcccugcucgcacuucuguugguggucgcuuuacccagaguuuggaccgacgccaaccugacagcgaggcagcgggauccugaggacagccaacgcacugaugaaggcgacaaucgaguguggugccacguaugugagcgugaaaacacguucgagugccagaauccaagaagguguaaguggaccgaaccguacugcgugaucgcugccgucaaaauuuuuccccgguucuuuaugguggcaaagcaguguuccgccgggugcgcugcaauggagcgcccuaaaccagaggaaaagagauuccuacucgaggaacccaugccauuuuucuaucugaaauguugcaagauaagguacuguaaccuugagggaccucccaucaauucuucaguuuuuaaggaguaugccgguaguaugggcgaaagcugcgggggacugugguuggcuauucuccugcugcucgccuccaucgcggcaggcuuaucucugucguga

SEQ ID NO: 2174 - RNA, 498 nt, Artificial Sequence
  derived and/or modified sequence opt4 from LY6K__Homo_sapiens__CCDS6385.2
auggcccugcuggcccugcugcuggugguggcccugcccagaguguggaccgacgccaaccugaccgccagacagagagaccccgaggacagccagagaaccgacgagggcgacaacagaguguggugccacgugugcgagagagagaacaccuucgagugccagaaccccagaagaugcaaguggaccgagcccuacugcgugaucgccgccgugaagaucuuccccagauucuucaugguggccaagcagugcagcgccggcugcgccgccauggagagacccaagcccgaggagaagagauuccugcuggaggagcccaugcccuucuucuaccugaagugcugcaagaucagauacugcaaccuggagggcccccccaucaacagcagcguguucaaggaguacgccggcagcaugggcgagagcugcggcggccuguggcuggccauccugcugcugcuggccagcaucgccgccggccugagccugagcuga

SEQ ID NO: 2175 - RNA, 498 nt, Artificial Sequence
  derived and/or modified sequence opt5 from LY6K__Homo_sapiens__CCDS6385.2
auggcccugcucgcucugcuucugguggucgcccuccccagaguuuggaccgacgcgaaccugacagcucggcagcgcgauccugaggacagccaaagaacggaugaaggcgacaaucggguguggugccacgugugugagcgcgaaaacaccuucgagugccagaauccgagacgguguaaguggacagaacccuacugcgucaucgccgccgugaaaauuuuuccucgcuucuuuaugguugcuaagcaguguuccgccgggugcgcugccauggagagacccaaaccugaggaaaagcgguuccuucuggaggaacccaugccguuuuucuaucucaaauguugcaagauccgcuacuguaaccuggagggaccucccauuaauucuagcguguuuaaggaguaugcgggcuccaugggggaaucuugcggaggccuguggcucgccauccugcuucugcucgcuagcauugccgcugggcugucccuuucuuga

SEQ ID NO: 2176 - protein, 124 aa, Artificial Sequence
  MAGA5__Homo_sapiens__P43359
MSLEQKSQHCKPEEGLDTQEEALGLVGVQAATTEEQEAVSSSSPLVPGTLGEVPAAGSPGPLKSPQGASAIPTAIDFTLWRQSIKGSSNQEEEGPSTSPDPESVFRAALSKKVADLIHFLLLKY

SEQ ID NO: 2177 - RNA, 375 nt, Artificial Sequence
  MAGA5__Homo_sapiens__AAA68873
augucucuugagcagaagagucagcacugcaagccugaggaaggccuugacacccaagaagaggcccugggccuggugggugugcaggcugccacuacugaggagcaggaggcuguguccuccuccucuccucuggucccaggcacccugggggaggugccugcugcugggucaccagguccucucaagaguccucagggagccuccgccauccccacugccaucgauuucacucuauggaggcaauccauuaagggcuccagcaaccaagaagaggaggggccaagcaccuccccugacccagagucuguguuccgagcagcacucaguaagaagguggcugacuugauucauuuucugcuccucaaguauuaa

SEQ ID NO: 2178 - RNA, 375 nt, Artificial Sequence
  derived and/or modified sequence opt1 from MAGA5__Homo_sapiens__AAA68873
augagccuggagcagaagucccagcacugcaagcccgaggagggccucgacacccaggaggaggcccuggggcuggugggcguccaggccgcgaccacggaggagcaggaggccgugagcuccagcuccccgcucgugcccgggacccugggcgagguccccgccgccgggagccccggcccgcugaaguccccgcagggcgccagcgcgauccccaccgccaucgacuucacccucuggcgccaguccaucaaggggagcuccaaccaggaggaggagggccccagcacgucccccgaccccgagagcguguuccgggccgcccuguccaagaagguggcggaccugauccacuuccuccugcugaaguacuga

SEQ ID NO: 2179 - RNA, 375 nt, Artificial Sequence
  derived and/or modified sequence opt2 from MAGA5__Homo_sapiens__AAA68873
augucccucgagcagaagucccagcacugcaagcccgaggagggccucgacacccaggaggaggcccucggccucgucggcguccaggccgccaccaccgaggagcaggaggccgucuccuccuccuccccccucguccccggcacccucggcgagguccccgccgccggcucccccggcccccucaaguccccccagggcgccuccgccauccccaccgccaucgacuucacccucuggcgccaguccaucaagggcuccuccaaccaggaggaggagggccccuccaccucccccgaccccgaguccgucuuccgcgccgcccucuccaagaaggucgccgaccucauccacuuccuccuccucaaguacuga

SEQ ID NO: 2180 - RNA, 375 nt, Artificial Sequence
  derived and/or modified sequence opt3 from MAGA5__Homo_sapiens__AAA68873
augagccuggagcagaagucccaacacugcaaacccgaagagggccucgacacccaggaagaggcccuugggcuggugggaguccaggcugcaacaacugaggaacaggaggccguuucuucaaguagcccuuuggugccagguacguuaggcgaaguaccggcggcugggucccccggaccucugaagucuccacaaggcgccucggcaauccccaccgccauugauuucacacuauggagacagucaauaaaagguagcaguaaccaggaggaagaggggccuuccacuucuccagaccccgagagcguguuuagggcugcacucuccaagaaagucgccgaucugauccauuuccuucuguugaaguacuga

SEQ ID NO: 2181 - RNA, 375 nt, Artificial Sequence
  derived and/or modified sequence opt4 from MAGA5__Homo_sapiens__AAA68873
augagccuggagcagaagagccagcacugcaagcccgaggagggccuggacacccaggaggaggcccugggccuggugggcgugcaggccgccaccaccgaggagcaggaggccgugagcagcagcagcccccuggugcccggcacccugggcgaggugcccgccgccggcagccccggcccccugaagagcccccagggcgccagcgccauccccaccgccaucgacuucacccuguggagacagagcaucaagggcagcagcaaccaggaggaggagggccccagcaccagccccgaccccgagagcguguucagagccgcccugagcaagaagguggccgaccugauccacuuccugcugcugaaguacuga

SEQ ID NO: 2182 - RNA, 375 nt, Artificial Sequence
  derived and/or modified sequence opt5 from MAGA5__Homo_sapiens__AAA68873
augagccuggagcagaagucccaacacugcaaacccgaagagggccucgacacccaggaagaggcccuggggcuugugggaguccaggcugccacaacggaggaacaggaggcgguuucuagcuccucuccucuggugccgggcacccucggggaagugcccgcugccggaagcccuggcccccugaaguccccucaaggggccucugcuauccccacagccauugauuucacccuuuggagacagagcaucaaaggauccagcaaccaggaggaagagggcccuucuacauccccggaccccgagagcgucuuucgggcugcccugucuaagaaaguggcggaucucauucauuuccugcugcucaaguacuga

SEQ ID NO: 2183 - protein, 318 aa, Artificial Sequence
  MAGA8__Homo_sapiens__P43361
MLLGQKSQRYKAEEGLQAQGEAPGLMDVQIPTAEEQKAASSSSTLIMGTLEEVTDSGSPSPPQSPEGASSSLTVTDSTLWSQSDEGSSSNEEEGPSTSPDPAHLESLFREALDEKVAELVRFLLRKYQIKEPVTKAEMLESVIKNYKNHFPDIFSKASECMQVIFGIDVKEVDPAGHSYILVTCLGLSYDGLLGDDQSTPKTGLLIIVLGMILMEGSRAPEEAIWEALSVMGLYDGREHSVYWKLRKLLTQEWVQENYLEYRQAPGSDPVRYEFLWGPRALAETSYVKVLEHVVRVNARVRISYPSLHEEALGEEKGV

SEQ ID NO: 2184 - RNA, 957 nt, Artificial Sequence
  MAGA8__Homo_sapiens__AAH02455
augcuucuugggcagaagagucagcgcuacaaggcugaggaaggccuucaggcccaaggagaggcaccagggcuuauggaugugcagauucccacagcugaggagcagaaggcugcauccuccuccucuacucugaucaugggaacccuugaggaggugacugauucugggucaccaaguccuccccagaguccugagggugccuccucuucccugacugucaccgacagcacucuguggagccaauccgaugaggguuccagcagcaaugaagaggaggggccaagcaccuccccggacccagcucaccuggagucccuguuccgggaagcacuugaugagaaaguggcugaguuaguucguuuccugcuccgcaaauaucaaauuaaggagccggucacaaaggcagaaaugcuugagagugucaucaaaaauuacaagaaccacuuuccugauaucuucagcaaagccucugagugcaugcaggugaucuuuggcauugaugugaaggaaguggacccugccggccacuccuacauccuugucaccugccugggccucuccuaugauggccugcugggugaugaucagaguacgcccaagaccggccuccugauaaucguccugggcaugaucuuaauggagggcagccgcgccccggaggaggcaaucugggaagcguugagugugauggggcuguaugaugggagggagcacagugucuauuggaagcucaggaagcugcucacccaagagugggugcaggagaacuaccuggaguaccgccaggcgcccggcagugauccugugcgcuacgaguuccugugggguccaagggcccuugcugaaaccagcuaugugaaaguccuggagcauguggucagggucaaugcaagaguucgcauuuccuacccaucccugcaugaagaggcuuugggagaggagaaaggaguuuga

SEQ ID NO: 2185 - RNA, 957 nt, Artificial Sequence
  derived and/or modified sequence opt1 from MAGA8__Homo_sapiens__AAH02455
augcugcucggccagaagucccagcgcuacaaggccgaggaggggcugcaggcccagggcgaggcgcccgggcugauggacgugcagaucccgaccgccgaggagcagaaggccgccagcagcuccagcacccucaucaugggcacgcuggaggaggucaccgacuccgggagccccuccccgccccagagccccgagggcgccuccagcucccugaccgugaccgacagcacgcucuggucccagagcgacgagggcuccagcuccaacgaggaggaggggcccagcaccucccccgaccccgcgcaccuggagagccuguuccgggaggcccucgacgagaagguggccgagcugguccgcuuccugcuccggaaguaccagaucaaggagccggugaccaaggccgagaugcuggagagcgugaucaagaacuacaagaaccacuuccccgacaucuucuccaaggcgagcgagugcaugcaggucaucuucggcaucgacgugaaggagguggaccccgccgggcacuccuacauccuggugaccugccucggccugagcuacgacgggcugcucggcgacgaccaguccacgcccaagaccggccugcugaucaucguccucgggaugauccugauggagggcagccgcgccccggaggaggccaucugggaggcccuguccgugauggggcucuacgacggccgggagcacagcgucuacuggaagcugcgcaagcugcucacccaggagugggugcaggagaacuaccuggaguaccggcaggcgcccggcuccgaccccgugcgcuacgaguuccugugggggccccgggcccucgccgagaccagcuacgucaaggugcuggagcacgugguccgcgugaacgcccgggugcgcaucuccuacccgagccugcacgaggaggcccucggcgaggagaagggggucuga

SEQ ID NO: 2186 - RNA, 957 nt, Artificial Sequence
  derived and/or modified sequence opt2 from MAGA8__Homo_sapiens__AAH02455
augcuccucggccagaagucccagcgcuacaaggccgaggagggccuccaggcccagggcgaggcccccggccucauggacguccagauccccaccgccgaggagcagaaggccgccuccuccuccuccacccucaucaugggcacccucgaggaggucaccgacuccggcucccccucccccccccagucccccgagggcgccuccuccucccucaccgucaccgacuccacccucuggucccaguccgacgagggcuccuccuccaacgaggaggagggccccuccaccucccccgaccccgcccaccucgagucccucuuccgcgaggcccucgacgagaaggucgccgagcucguccgcuuccuccuccgcaaguaccagaucaaggagcccgucaccaaggccgagaugcucgaguccgucaucaagaacuacaagaaccacuuccccgacaucuucuccaaggccuccgagugcaugcaggucaucuucggcaucgacgucaaggaggucgaccccgccggccacuccuacauccucgucaccugccucggccucuccuacgacggccuccucggcgacgaccaguccacccccaagaccggccuccucaucaucguccucggcaugauccucauggagggcucccgcgcccccgaggaggccaucugggaggcccucuccgucaugggccucuacgacggccgcgagcacuccgucuacuggaagcuccgcaagcuccucacccaggaguggguccaggagaacuaccucgaguaccgccaggcccccggcuccgaccccguccgcuacgaguuccucuggggcccccgcgcccucgccgagaccuccuacgucaagguccucgagcacgucguccgcgucaacgcccgcguccgcaucuccuaccccucccuccacgaggaggcccucggcgaggagaagggcgucuga

SEQ ID NO: 2187 - RNA, 957 nt, Artificial Sequence
  derived and/or modified sequence opt3 from MAGA8__Homo_sapiens__AAH02455
augcugcucggccaaaagagccagagauacaaagccgaggaagggcuucaggcucagggagaggcacccggucugauggacgugcagaucccuaccgccgaggaacaaaaggcggcuuccucuucaaguacauugauuaugggcacuuuagaagaggucacggauagcggguccccaucuccgccccagucgccugagggagccucaagcagucugaccguuacagacuccacucuauggucucagagcgaugaaggcuccucaaguaacgaggaagaggguccaagcaccucucccgacccugcacaccucgagucccuguucagggaagcccuugaugagaaaguggcugaacugguacgguuuuugcuccgcaaguaucagauaaaagagccagugacaaaggcagaaaugcuggagucagucaucaagaauuacaaaaaccauuuccccgacauuuuuagcaaggccagugagugcaugcaagugaucuucgggauugauguuaaagaaguggacccugcuggacacucuuauauccuggucaccugucucggcuuauccuacgauggccugcuuggggacgaucagagcacuccaaagacaggauugcugauaaucgugcuagguaugauucucauggagggcucgcgagccccggaagaggcgaucugggaagcacugucuguaauggggcuuuaugacggacgugagcauuccguuuacuggaaacugagaaaguugcucacccaggagugggugcaggaaaauuaucuggaguacaggcaagcccccggcucagauccuguccgguacgaauuuuuaugggguccacgcgcucuggccgagacgaguuaugugaaggugcucgaacacgucguuagagugaacgcaaggguacggauuagcuaccccucccuucaugaggaggcucugggggaagagaaaggaguguga

SEQ ID NO: 2188 - RNA, 957 nt, Artificial Sequence
  derived and/or modified sequence opt4 from MAGA8__Homo_sapiens__AAH02455
augcugcugggccagaagagccagagauacaaggccgaggagggccugcaggcccagggcgaggcccccggccugauggacgugcagauccccaccgccgaggagcagaaggccgccagcagcagcagcacccugaucaugggcacccuggaggaggugaccgacagcggcagccccagccccccccagagccccgagggcgccagcagcagccugaccgugaccgacagcacccuguggagccagagcgacgagggcagcagcagcaacgaggaggagggccccagcaccagccccgaccccgcccaccuggagagccuguucagagaggcccuggacgagaagguggccgagcuggugagauuccugcugagaaaguaccagaucaaggagcccgugaccaaggccgagaugcuggagagcgugaucaagaacuacaagaaccacuuccccgacaucuucagcaaggccagcgagugcaugcaggugaucuucggcaucgacgugaaggagguggaccccgccggccacagcuacauccuggugaccugccugggccugagcuacgacggccugcugggcgacgaccagagcacccccaagaccggccugcugaucaucgugcugggcaugauccugauggagggcagcagagcccccgaggaggccaucugggaggcccugagcgugaugggccuguacgacggcagagagcacagcguguacuggaagcugagaaagcugcugacccaggagugggugcaggagaacuaccuggaguacagacaggcccccggcagcgaccccgugagauacgaguuccuguggggccccagagcccuggccgagaccagcuacgugaaggugcuggagcacguggugagagugaacgccagagugagaaucagcuaccccagccugcacgaggaggcccugggcgaggagaagggcguguga

SEQ ID NO: 2189 - RNA, 957 nt, Artificial Sequence
  derived and/or modified sequence opt5 from MAGA8__Homo_sapiens__AAH02455
augcugcucggccaaaagagccagagauacaaagccgaggaagggcugcaggcucagggagaggcccccggccuuauggacgugcagaucccuaccgcggaggaacaaaaggcugccuccucuagcuccacacugauuauggggacgcucgaagaggucaccgauucuggaagcccgucucccccucagucccccgagggcgccagcuccagccugacaguuaccgacucuacacuuuggucccagagcgaugaagggucuuccagcaacgaggaagagggaccuucuaccucccccgacccugcucaccuggagagccucuuccgggaagcccuggaugagaaaguggcugaacuggugcgcuuucuccugagaaaguaucagaucaaagagccggucacaaaggccgaaaugcuugaguccgugauuaagaauuacaaaaaccauuuccccgacaucuuuucuaaggcgagcgagugcaugcaaguuauuuucggcaucgaugugaaagaagucgacccugccggccacuccuauauccuggugaccugucucgggcugagcuacgauggacuucugggcgacgaucagucuacgcccaagaccgggcuccugauuaucguucugggaaugauucucauggagggcucccgggcuccugaagaggccaucugggaagcucugagcgugauggggcuuuaugacggacgcgagcauucugucuacuggaaacugagaaagcuccugacacaggagugggugcaggaaaauuaucuugaguaccggcaagcccccggcagcgauccggugcgcuacgaauuucuguggggcccuagagcgcucgccgagaccuccuaugucaagguucuggaacacguggugcgggucaacgcucgcgugagaauuucuuaccccagccugcaugaggaggcccucggggaagagaaaggaguuuga

SEQ ID NO: 2190 - protein, 429 aa, Artificial Sequence
  MAGAB__Homo_sapiens__P43364
METQFRRGGLGCSPASIKRKKKREDSGDFGLQVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 2191 - RNA, 1290 nt, Artificial Sequence
  MAGAB__Homo_sapiens__AAH04479
auggagacucaguuccgcagagggggucuggggugcagcccugccagcaucaagaggaagaagaagagggaggacucaggagacuuuggacuccaggugagcacuauguucucagaggacgacuuccagucaacagaaagagccccauaugguccacaacuacaguggucccaggaucugccaagaguccagguuuuuagagaacaggccaaccuggaggacaggagucccaggagaacccagaggaucacuggaggagaacaagugcuguggggccccaucacccagauauuucccacaguucggccugcugaccuaaccagagucaucaugccucuugagcaaagaagucagcacugcaagccugaggaaggccuucaggcccaagaagaagaccugggccuggugggugcacaggcucuccaagcugaggagcaggaggcugccuucuucuccucuacucugaaugugggcacucuagaggaguugccugcugcugagucaccaaguccuccccagaguccucaggaagaguccuucucucccacugccauggaugccaucuuugggagccuaucugaugagggcucuggcagccaagaaaaggaggggccaaguaccucgccugaccugauagacccugaguccuuuucccaagauauacuacaugacaagauaauugauuugguucauuuauugcuccgcaaguaucgagucaaggggcugaucacaaaggcagaaaugcuggggagugucaucaaaaauuaugaggacuacuuuccugagauauuuagggaagccucuguaugcaugcaacugcucuuuggcauugaugugaaggaaguggaccccacuagccacuccuauguccuugucaccucccucaaccucucuuaugauggcauacaguguaaugagcagagcaugcccaagucuggccuccugauaauaguccuggguguaaucuucauggaggggaacugcaucccugaagagguuaugugggaaguccugagcauuauggggguguaugcuggaagggagcacuuccucuuuggggagcccaagaggcuccuuacccaaaauugggugcaggaaaaguaccugguguaccggcaggugcccggcacugauccugcaugcuaugaguuccugugggguccaagggcccacgcugagaccagcaagaugaaaguucuugaguacauagccaaugccaaugggagggaucccacuucuuacccaucccuguaugaagaugcuuugagagaggagggagagggagucuga

SEQ ID NO: 2192 - RNA, 1290 nt, Artificial Sequence
  derived and/or modified sequence opt1 from MAGAB__Homo_sapiens__AAH04479
auggagacccaguuccgccggggcgggcugggcugcagccccgccuccaucaagcgcaagaagaagcgggaggacagcggggacuucggccuccagguguccaccauguucagcgaggacgacuuccaguccacggagcgcgccccguacgggccccagcugcaguggagccaggaccugccccggguccagguguuccgcgagcaggcgaaccucgaggaccggagcccccgccggacccagcgcaucaccggcggcgagcagguccugugggggccgaucacccagaucuuccccacggugcggcccgccgaccugacccgcgugaucaugccccucgagcagcggucccagcacugcaagccggaggagggccugcaggcccaggaggaggaccuggggcucgugggcgcccaggcccugcaggcggaggagcaggaggccgccuucuucuccagcacccugaacgucgggacccucgaggagcugcccgccgcggagucccccagcccgccgcagagcccccaggaggaguccuucucccccacggccauggacgccaucuucggcagccuguccgacgagggcagcgggucccaggagaaggagggccccagcaccagcccggaccucaucgaccccgaguccuucagccaggacauccugcacgacaagaucaucgaccuggugcaccuccugcugcgcaaguaccgggugaaggggcucaucaccaaggccgagaugcugggcuccgucaucaagaacuacgaggacuacuuccccgagaucuuccgcgaggccagcgugugcaugcagcuccuguucggcaucgacgugaaggaggucgaccccaccucccacagcuacgugcuggugacgucccugaaccucagcuacgacgggauccagugcaacgagcaguccaugcccaagagcggccugcugaucaucguccucggggugaucuucauggagggcaacugcauccccgaggaggugaugugggagguccuguccaucauggggguguacgcgggccgggagcacuuccuguucggcgagcccaagcgccuccugacccagaacugggugcaggagaaguaccuggucuaccgccaggugcccgggaccgacccggccugcuacgaguuccucuggggcccccgggcccacgccgagaccagcaagaugaaggugcuggaguacaucgccaacgcgaacgggcgggaccccacguccuaccccagccuguacgaggacgcccuccgcgaggagggcgagggggucuga

SEQ ID NO: 2193 - RNA, 1290 nt, Artificial Sequence
  derived and/or modified sequence opt2 from MAGAB__Homo_sapiens__AAH04479
auggagacccaguuccgccgcggcggccucggcugcucccccgccuccaucaagcgcaagaagaagcgcgaggacuccggcgacuucggccuccaggucuccaccauguucuccgaggacgacuuccaguccaccgagcgcgcccccuacggcccccagcuccaguggucccaggaccucccccgcguccaggucuuccgcgagcaggccaaccucgaggaccgcuccccccgccgcacccagcgcaucaccggcggcgagcagguccucuggggccccaucacccagaucuuccccaccguccgccccgccgaccucacccgcgucaucaugccccucgagcagcgcucccagcacugcaagcccgaggagggccuccaggcccaggaggaggaccucggccucgucggcgcccaggcccuccaggccgaggagcaggaggccgccuucuucuccuccacccucaacgucggcacccucgaggagcuccccgccgccgagucccccucccccccccaguccccccaggaggaguccuucucccccaccgccauggacgccaucuucggcucccucuccgacgagggcuccggcucccaggagaaggagggccccuccaccucccccgaccucaucgaccccgaguccuucucccaggacauccuccacgacaagaucaucgaccucguccaccuccuccuccgcaaguaccgcgucaagggccucaucaccaaggccgagaugcucggcuccgucaucaagaacuacgaggacuacuuccccgagaucuuccgcgaggccuccgucugcaugcagcuccucuucggcaucgacgucaaggaggucgaccccaccucccacuccuacguccucgucaccucccucaaccucuccuacgacggcauccagugcaacgagcaguccaugcccaaguccggccuccucaucaucguccucggcgucaucuucauggagggcaacugcauccccgaggaggucaugugggagguccucuccaucaugggcgucuacgccggccgcgagcacuuccucuucggcgagcccaagcgccuccucacccagaacuggguccaggagaaguaccucgucuaccgccagguccccggcaccgaccccgccugcuacgaguuccucuggggcccccgcgcccacgccgagaccuccaagaugaagguccucgaguacaucgccaacgccaacggccgcgaccccaccuccuaccccucccucuacgaggacgcccuccgcgaggagggcgagggcgucuga

SEQ ID NO: 2194 - RNA, 1290 nt, Artificial Sequence
  derived and/or modified sequence opt3 from MAGAB__Homo_sapiens__AAH04479
auggagacccaguucagaaggggcgggcugggaugcagccccgccuccaucaagcggaaaaagaaacgcgaagacucuggugauuuuggccuccaagugucaacaauguucagugaggacgauuuucagagcacugaacgagcuccuuacgggccacagcuucaguggucccaagaccugccgcguguccagguuuucagagagcaggcaaacuuggaagauaggucuccccggcgcacgcagagaauuaccggaggcgagcaaguguuaugggguccuauaacacagaucuuuccaacuguaaggcccgccgaccugacccgggugauuaugccucuagagcagcgcucgcagcacuguaagccagaagaggggcuccaagcgcaggaagaggaucugggacuugucggcgcucaggcccugcaagcagaggaacaggaggccgcuuucuuuucaagcacauugaaugugggcacccucgaggaacugcccgcagccgaaaguccuuccccaccgcagucuccccaggaggagagcuucuccccuacugcuauggacgccaucuuugggucacugagugaugaaggaagcgguucucaagagaaagaaggcccauccacaucacccgaccucauugauccugagagcuucagucaggacaucuuacaugauaagauaaucgaccugguucaccuuuugcugcgaaaguauagagugaaagggcuaauuaccaaggcggaaaugcucggaucugucaucaaaaacuacgaggacuauuuuccagagauuuucagggaagcauccgugugcaugcagcugcuuuuuggcaucgauguaaaggagguugaccccacgagccauucguacgugcuggucacuucuuugaaucucuccuaugaugguauacaguguaacgaacaaucaaugccgaaaagugggcuguuaauuaucgugcugggagugauuuucauggagggcaauugcaucccugaagaggucaugugggagguucucagcaucaugggcguguacgccgggcgggaacacuuccuuuuuggagagcccaagcgucuguugacccagaacuggguacaggaaaaguaucuaguguaccgccaggucccagguacagacccugcuuguuacgaguuccuguggggccccagagcccaugcagagacuuccaaaaugaaggugcucgaauauauugcuaaugccaacgggagggauccaaccucuuaccccagccuguaugaggacgcgcuucgggaagagggagaaggcguuuga

SEQ ID NO: 2195 - RNA, 1290 nt, Artificial Sequence
  derived and/or modified sequence opt4 from MAGAB__Homo_sapiens__AAH04479
auggagacccaguucagaagaggcggccugggcugcagccccgccagcaucaagagaaagaagaagagagaggacagcggcgacuucggccugcaggugagcaccauguucagcgaggacgacuuccagagcaccgagagagcccccuacggcccccagcugcaguggagccaggaccugcccagagugcagguguucagagagcaggccaaccuggaggacagaagccccagaagaacccagagaaucaccggcggcgagcaggugcuguggggccccaucacccagaucuuccccaccgugagacccgccgaccugaccagagugaucaugccccuggagcagagaagccagcacugcaagcccgaggagggccugcaggcccaggaggaggaccugggccuggugggcgcccaggcccugcaggccgaggagcaggaggccgccuucuucagcagcacccugaacgugggcacccuggaggagcugcccgccgccgagagccccagccccccccagagcccccaggaggagagcuucagccccaccgccauggacgccaucuucggcagccugagcgacgagggcagcggcagccaggagaaggagggccccagcaccagccccgaccugaucgaccccgagagcuucagccaggacauccugcacgacaagaucaucgaccuggugcaccugcugcugagaaaguacagagugaagggccugaucaccaaggccgagaugcugggcagcgugaucaagaacuacgaggacuacuuccccgagaucuucagagaggccagcgugugcaugcagcugcuguucggcaucgacgugaaggagguggaccccaccagccacagcuacgugcuggugaccagccugaaccugagcuacgacggcauccagugcaacgagcagagcaugcccaagagcggccugcugaucaucgugcugggcgugaucuucauggagggcaacugcauccccgaggaggugaugugggaggugcugagcaucaugggcguguacgccggcagagagcacuuccuguucggcgagcccaagagacugcugacccagaacugggugcaggagaaguaccugguguacagacaggugcccggcaccgaccccgccugcuacgaguuccuguggggccccagagcccacgccgagaccagcaagaugaaggugcuggaguacaucgccaacgccaacggcagagaccccaccagcuaccccagccuguacgaggacgcccugagagaggagggcgagggcguguga

SEQ ID NO: 2196 - RNA, 1290 nt, Artificial Sequence
  derived and/or modified sequence opt5 from MAGAB__Homo_sapiens__AAH04479
auggagacccaguucagacggggcgggcugggaugcagccccgccuccaucaagcgcaaaaagaaaagagaagacucuggcgauuuugggcuccaagugagcacaauguucuccgaggacgauuuucagucuacggaacgggcuccuuacggaccgcagcugcaguggagccaagaccuuccccgcguccagguuuucagagagcaggccaaccuggaagaucgguccccucgcagaacccagcggauuacaggcggggagcaagugcucuggggacccaucacccagauuuuuccuacagugcgccccgcggaccugaccagagucaucaugccucuugagcagcggucucagcacuguaagccggaagagggccugcaagcucaggaagaggaucucggccuggugggggcccaggcccugcaagcugaggaacaggaggccgcuuucuuuagcuccacacucaauguuggaacccuggaggaacuucccgccgcggaaagcccuucucccccucagagcccccaggaggaguccuucucuccgacggccauggacgcuauuuuuggcucccugagcgaugaagggucuggaucccaagagaaagaaggcccuagcaccucccccgaccucaucgauccugagucuuucagccaggacauccugcaugauaagauuaucgaccuugugcaucugcuccugcgcaaguauagagucaaagggcugauuacaaaggccgaaaugcucggauccgugaucaaaaacuacgaggacuauuuucccgagauuuuccgggaagcuagcguuugcaugcagcugcuuuuuggcaucgaugugaaggaggucgaccccaccucucacuccuacgugcuggugacaagccucaaucugucuuaugauggcauucaguguaacgaacaaagcaugccuaaauccgggcuucugaucaucguccucggaguuauuuucauggagggcaauugcaucccggaagaggugaugugggaggugcugucuauuaugggggucuacgccggacgcgaacacuuccuguuuggcgagcccaagagacuccugacccagaacugggugcaggaaaaguaucuuguuuacagacaggugccugggacggaccccgcguguuacgaguuccuguggggaccucgggcccaugcugagacaagcaaaaugaagguccucgaauauaucgccaaugcuaacggccgcgaucccaccuccuacccgagccuguaugaggacgcccuucgggaagagggcgaagggguguga

SEQ ID NO: 2197 - protein, 369 aa, Artificial Sequence
  MAGE-A10__Homo_sapiens__A0A024RC14
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIKNYEDHFPLLFSEASECMLLVFGIDVKEVDPTGHSFVLVTSLGLTYDGMLSDVQSMPKTGILILILSIIFIEGYCTPEEVIWEALNMMGLYDGMEHLIYGEPRKLLTQDWVQENYLEYRQVPGSDPARYEFLWGPRAHAEIRKMSLLKFLAKVNGSDPRSFPLWYEEALKDEEERAQDRIATTDDTTAMASASSSATGSFSYPE

SEQ ID NO: 2198 - RNA, 1110 nt, Artificial Sequence
  MAGE-A10__Homo_sapiens__EAW99421
augccucgagcuccaaagcgucagcgcugcaugccugaagaagaucuucaaucccaaagugagacacagggccucgagggugcacaggcuccccuggcuguggaggaggaugcuucaucauccacuuccaccagcuccucuuuuccauccucuuuucccuccuccuccucuuccuccuccuccuccugcuauccucuaauaccaagcaccccagaggagguuucugcugaugaugagacaccaaauccuccccagagugcucagauagccugcuccucccccucggucguugcuucccuuccauuagaucaaucugaugagggcuccagcagccaaaaggaggagaguccaagcacccuacagguccugccagacagugagucuuuacccagaagugagauagaugaaaaggugacugauuuggugcaguuucugcucuucaaguaucaaaugaaggagccgaucacaaaggcagaaauacuggagagugucauaaaaaauuaugaagaccacuucccuuuguuguuuagugaagccuccgagugcaugcugcuggucuuuggcauugauguaaaggaaguggaucccacuggccacuccuuuguccuugucaccucccugggccucaccuaugaugggaugcugagugauguccagagcaugcccaagacuggcauucucauacuuauccuaagcauaaucuucauagagggcuacugcaccccugaggaggucaucugggaagcacugaauaugauggggcuguaugaugggauggagcaccucauuuauggggagcccaggaagcugcucacccaagauugggugcaggaaaacuaccuggaguaccggcaggugccuggcagugauccugcacgguaugaguuucugugggguccaagggcucaugcugaaauuaggaagaugagucuccugaaauuuuuggccaagguaaaugggagugauccaagauccuucccacugugguaugaggaggcuuugaaagaugaggaagagagagcccaggacagaauugccaccacagaugauacuacugccauggccagugcaaguucuagcgcuacagguagcuucuccuacccugaauaa

SEQ ID NO: 2199 - RNA, 1110 nt, Artificial Sequence
  derived and/or modified sequence opt1 from MAGE-A10__Homo_sapiens__EAW99421
augccccgcgccccgaagcggcagcgcugcaugcccgaggaggaccugcagagccaguccgagacccagggccucgagggggcccaggcgccccuggccguggaggaggacgccagcuccagcaccuccacgagcuccagcuuccccuccagcuucccguccagcuccagcuccagcuccagcuccugcuacccccugauccccagcacccccgaggaggucagcgccgacgacgagaccccgaacccgccccaguccgcccagaucgcgugcagcucccccagcgugguggccucccucccccuggaccagagcgacgagggcuccagcucccagaaggaggagagccccuccacccugcagguccuccccgacagcgagucccugccccggagcgagaucgacgagaaggugacggaccuggugcaguuccuccuguucaaguaccagaugaaggagccgaucaccaaggccgagauccuggaguccgucaucaagaacuacgaggaccacuucccccuccuguucagcgaggccuccgagugcaugcugcucguguucgggaucgacgugaaggaggucgaccccaccggccacagcuucgugcuggugaccucccuggggcucacguacgacggcaugcugagcgacguccagagcaugcccaagaccggcauccugauccucauccuguccaucaucuucaucgagggguacugcaccccggaggaggugaucugggaggcgcugaacaugaugggccucuacgacgggauggagcaccugaucuacggcgagccccgcaagcugcucacccaggacugggugcaggagaacuaccuggaguaccggcagguccccgggagcgaccccgcccgcuacgaguuccuguggggcccgcgggcccacgccgagauccgcaagaugucccuccugaaguuccuggccaaggugaacggcagcgacccccgguccuucccccucugguacgaggaggcgcugaaggacgaggaggagcgcgcccaggaccggaucgccacgaccgacgacaccaccgccauggccagcgcguccagcuccgccacggggagcuucuccuaccccgaguga

SEQ ID NO: 2200 - RNA, 1110 nt, Artificial Sequence
  derived and/or modified sequence opt2 from MAGE-A10__Homo_sapiens__EAW99421
augccccgcgcccccaagcgccagcgcugcaugcccgaggaggaccuccagucccaguccgagacccagggccucgagggcgcccaggccccccucgccgucgaggaggacgccuccuccuccaccuccaccuccuccuccuuccccuccuccuuccccuccuccuccuccuccuccuccuccuccugcuacccccucauccccuccacccccgaggaggucuccgccgacgacgagacccccaaccccccccaguccgcccagaucgccugcuccucccccuccgucgucgccucccucccccucgaccaguccgacgagggcuccuccucccagaaggaggagucccccuccacccuccagguccuccccgacuccgagucccucccccgcuccgagaucgacgagaaggucaccgaccucguccaguuccuccucuucaaguaccagaugaaggagcccaucaccaaggccgagauccucgaguccgucaucaagaacuacgaggaccacuucccccuccucuucuccgaggccuccgagugcaugcuccucgucuucggcaucgacgucaaggaggucgaccccaccggccacuccuucguccucgucaccucccucggccucaccuacgacggcaugcucuccgacguccaguccaugcccaagaccggcauccucauccucauccucuccaucaucuucaucgagggcuacugcacccccgaggaggucaucugggaggcccucaacaugaugggccucuacgacggcauggagcaccucaucuacggcgagccccgcaagcuccucacccaggacuggguccaggagaacuaccucgaguaccgccagguccccggcuccgaccccgcccgcuacgaguuccucuggggcccccgcgcccacgccgagauccgcaagaugucccuccucaaguuccucgccaaggucaacggcuccgacccccgcuccuucccccucugguacgaggaggcccucaaggacgaggaggagcgcgcccaggaccgcaucgccaccaccgacgacaccaccgccauggccuccgccuccuccuccgccaccggcuccuucuccuaccccgaguga

SEQ ID NO: 2201 - RNA, 1110 nt, Artificial Sequence
  derived and/or modified sequence opt3 from MAGE-A10__Homo_sapiens__EAW99421
augcccagagccccuaagaggcagcggugcaugccagaggaagaccugcaaagccaguccgagacccagggccucgaaggggcucaggcaccgcuugccguggaggaagaugcgucuucaaguacaagcacuuccucuucguuccccagcucauuuccuaguuccucuagcuccucaaguagcucuuguuacccacugauccccuccacgccugaggaggucucagcugacgaugaaaccccaaaucccccucaaagcgcccagauugcaugcaguucuccauccguuguggccagcuugccguuagaccagucggaugagggaucuuccucacagaaagaagagagucccagcacacugcaaguacuaccugacuccgagucucucccacgcagcgaaauagaugagaaggugacugaccugguccaguuccuucuguuuaaauaucagaugaaggaacccaucaccaaagcugagauuuuggaaucagugaucaagaacuacgaggaucacuucccucuccuguuuagugaggcauccgaauguaugcugcucguuuucgguauugacgugaaggaggucgauccaacaggccauagcuuuguguuaguaaccucucuggggcuuacuuaugacggaauguugucagauguucagaguaugcccaaaacaggcauccugauacuaauccucagcauuaucuucauugaagguuacugcaccccggaggaagugaucugggaggcccugaacaugauggggcuuuaugacggaauggagcaccugauauacggcgaaccucgaaaguugcucacgcaagacuggguccaggagaauuaucuggaauaccgucaggugcccggcuccgauccagcuagauacgaguuuuuaugggggccuagggcccaugcggaaauucggaaaaugucucugcucaaguuccuugcaaaagugaacggaucggacccccgcagcuuuccacugugguaugaggaggccuugaaggaugaagaggaaagagcucaagacaggaucgccacuaccgaugacacaacugcaauggcuuccgccucaaguucugcgaccgguagcuucuccuaccccgaguga

SEQ ID NO: 2202 - RNA, 1110 nt, Artificial Sequence
  derived and/or modified sequence opt4 from MAGE-A10__Homo_sapiens__EAW99421
augcccagagcccccaagagacagagaugcaugcccgaggaggaccugcagagccagagcgagacccagggccuggagggcgcccaggccccccuggccguggaggaggacgccagcagcagcaccagcaccagcagcagcuuccccagcagcuuccccagcagcagcagcagcagcagcagcagcugcuacccccugauccccagcacccccgaggaggugagcgccgacgacgagacccccaaccccccccagagcgcccagaucgccugcagcagccccagcgugguggccagccugccccuggaccagagcgacgagggcagcagcagccagaaggaggagagccccagcacccugcaggugcugcccgacagcgagagccugcccagaagcgagaucgacgagaaggugaccgaccuggugcaguuccugcuguucaaguaccagaugaaggagcccaucaccaaggccgagauccuggagagcgugaucaagaacuacgaggaccacuucccccugcuguucagcgaggccagcgagugcaugcugcugguguucggcaucgacgugaaggagguggaccccaccggccacagcuucgugcuggugaccagccugggccugaccuacgacggcaugcugagcgacgugcagagcaugcccaagaccggcauccugauccugauccugagcaucaucuucaucgagggcuacugcacccccgaggaggugaucugggaggcccugaacaugaugggccuguacgacggcauggagcaccugaucuacggcgagcccagaaagcugcugacccaggacugggugcaggagaacuaccuggaguacagacaggugcccggcagcgaccccgccagauacgaguuccuguggggccccagagcccacgccgagaucagaaagaugagccugcugaaguuccuggccaaggugaacggcagcgaccccagaagcuucccccugugguacgaggaggcccugaaggacgaggaggagagagcccaggacagaaucgccaccaccgacgacaccaccgccauggccagcgccagcagcagcgccaccggcagcuucagcuaccccgaguga

SEQ ID NO: 2203 - RNA, 1110 nt, Artificial Sequence
  derived and/or modified sequence opt5 from MAGE-A10__Homo_sapiens__EAW99421
augcccagagccccuaagcggcagcgcugcaugccggaggaagaccugcaaagccaguccgagacccagggacucgaaggggcucaggcgccccuggccguggaggaagaugcuucuagcuccacaucuacgagcuccucuuucccuagcuccuuucccagcagcuccucuucuuccuccucuuccuguuacccucuuauccccagcaccccugaggaggucuccgccgacgaugaaacaccgaaucccccucaaucugcccagauugcuugcagcucccccagcguuguggccucucugccucucgaccaguccgaugagggaagcucuagccagaaagaagagucccccucuacccugcaagugcuuccggacagcgagucccugccuagaagcgaaaucgaugagaaggucacagaccucgugcaguuccugcuguuuaaauaucagaugaaggaacccauuaccaaagcugagauccucgaaucuguuauuaagaacuacgaggaucacuucccucugcuuuuuagcgaggccagcgaauguaugcugcucguguucggcaucgacgucaaggagguggaucccacagggcauucuuuuguucuggugaccucccuuggacugacguaugacggcaugcucagcgauguccaguccaugcccaaaaccgggauccugauucugauccucucuauuaucuucauugaaggauacugcacaccugaggaagugaucugggaggcgcugaacaugaugggccuuuaugacggcauggagcaccugauuuacggggaaccgcggaagcuccugacccaagacugggugcaggagaauuaucuugaauaccgccagguccccggaagcgauccugccagauacgaguuucuguggggcccccgggcucaugccgaaauccgcaaaaugucccuccugaaguuccuggcuaaaguuaacgggucugacccucggagcuuuccccucugguaugaggaggcccugaaggaugaagaggaaagagcgcaagaccgcaucgccacaaccgaugacacgacagcuauggccuccgcuucuagcuccgccaccggcagcuucucuuacccggaguga

SEQ ID NO: 2204 - protein, 314 aa, Artificial Sequence
  MAGE-A12__Homo_sapiens__P43365
MPLEQRSQHCKPEEGLEAQGEALGLVGAQAPATEEQETASSSSTLVEVTLREVPAAESPSPPHSPQGASTLPTTINYTLWSQSDEGSSNEEQEGPSTFPDLETSFQVALSRKMAELVHFLLLKYRAREPFTKAEMLGSVIRNFQDFFPVIFSKASEYLQLVFGIEVVEVVRIGHLYILVTCLGLSYDGLLGDNQIVPKTGLLIIVLAIIAKEGDCAPEEKIWEELSVLEASDGREDSVFAHPRKLLTQDLVQENYLEYRQVPGSDPACYEFLWGPRALVETSYVKVLHHLLKISGGPHISYPPLHEWAFREGEE

SEQ ID NO: 2205 - RNA, 945 nt, Artificial Sequence
  MAGE-A12__Homo_sapiens__AAH03408
augccacuugagcagaggagucagcacugcaagccugaggaaggccuugaggcccaaggagaggcccugggcuuggugggugcgcaggcuccugcuacugaggagcaggagacugccuccuccuccucuacucuaguggaagucacccugcgggaggugccugcugccgagucaccaaguccuccccacaguccucagggagccuccacccuccccacuaccaucaacuauacucucuggagucaauccgaugagggcuccagcaacgaagaacaggaagggccaagcaccuuuccugaccuggagacgagcuuccaaguagcacucaguaggaagauggcugaguugguucauuuucugcuccucaaguaucgagccagggagccauucacaaaggcagaaaugcuggggagugucaucagaaauuuccaggacuucuuuccugugaucuucagcaaagccuccgaguacuugcagcuggucuuuggcaucgaggugguggaagugguccgcaucggccacuuguacauccuugucaccugccugggccucuccuacgauggccugcugggcgacaaucagaucgugcccaagacaggccuccugauaaucguccuggccauaaucgcaaaagagggcgacugugccccugaggagaaaaucugggaggagcugaguguguuggaggcaucugaugggagggaggacagugucuuugcgcaucccaggaagcugcucacccaagauuuggugcaggaaaacuaccuggaguaccggcagguccccggcagugauccugcaugcuacgaguuccugugggguccaagggcccucguugaaaccagcuaugugaaaguccugcaccauuugcuaaagaucaguggaggaccucacauuuccuacccaccccugcaugaaugggcuuuuagagagggggaagaguga

SEQ ID NO: 2206 - RNA, 945 nt, Artificial Sequence
  derived and/or modified sequence opt1 from MAGE-A12__Homo_sapiens__AAH03408
augccccuggagcagcgcagccagcacugcaagccggaggagggccucgaggcccagggggaggcccugggccuggugggggcgcaggcccccgccaccgaggagcaggagaccgccuccagcuccagcacgcucgucgaggugacccugcgggaggugcccgccgcggagucccccagcccgccccacagcccccagggcgccuccacccugcccaccacgaucaacuacacccucuggucccagagcgacgagggguccagcaacgaggagcaggagggcccguccaccuuccccgaccuggagaccagcuuccaggucgcccugucccgcaagauggccgagcucgugcacuuccugcugcucaaguaccgggcgcgcgagcccuucacgaaggccgagaugcugggcagcgugauccggaacuuccaggacuucuuccccgucaucuucuccaaggccagcgaguaccugcagcucguguucgggaucgagguggucgagguggugcgcaucggccaccuguacauccuggugaccugccucgggcuguccuacgacggccugcucggggacaaccagaucgucccgaagaccggccugcugaucaucgugcucgccaucaucgccaaggagggcgacugcgcgcccgaggagaagaucugggaggagcugagcguccuggaggccagcgacgggcgggaggacuccguguucgcccacccccgcaagcuccugacccaggaccuggugcaggagaacuaccucgaguaccggcagguccccggcagcgacccggccugcuacgaguuccugugggggccccgcgcccugguggagacguccuacgugaagguccuccaccaccuccugaagaucagcggcggcccccacaucuccuacccgccccugcacgagugggcguuccgggagggggaggaguga

SEQ ID NO: 2207 - RNA, 945 nt, Artificial Sequence
  derived and/or modified sequence opt2 from MAGE-A12__Homo_sapiens__AAH03408
augccccucgagcagcgcucccagcacugcaagcccgaggagggccucgaggcccagggcgaggcccucggccucgucggcgcccaggcccccgccaccgaggagcaggagaccgccuccuccuccuccacccucgucgaggucacccuccgcgagguccccgccgccgagucccccucccccccccacuccccccagggcgccuccacccuccccaccaccaucaacuacacccucuggucccaguccgacgagggcuccuccaacgaggagcaggagggccccuccaccuuccccgaccucgagaccuccuuccaggucgcccucucccgcaagauggccgagcucguccacuuccuccuccucaaguaccgcgcccgcgagcccuucaccaaggccgagaugcucggcuccgucauccgcaacuuccaggacuucuuccccgucaucuucuccaaggccuccgaguaccuccagcucgucuucggcaucgaggucgucgaggucguccgcaucggccaccucuacauccucgucaccugccucggccucuccuacgacggccuccucggcgacaaccagaucguccccaagaccggccuccucaucaucguccucgccaucaucgccaaggagggcgacugcgcccccgaggagaagaucugggaggagcucuccguccucgaggccuccgacggccgcgaggacuccgucuucgcccacccccgcaagcuccucacccaggaccucguccaggagaacuaccucgaguaccgccagguccccggcuccgaccccgccugcuacgaguuccucuggggcccccgcgcccucgucgagaccuccuacgucaagguccuccaccaccuccucaagaucuccggcggcccccacaucuccuaccccccccuccacgagugggccuuccgcgagggcgaggaguga

SEQ ID NO: 2208 - RNA, 945 nt, Artificial Sequence
  derived and/or modified sequence opt3 from MAGE-A12__Homo_sapiens__AAH03408
augccccuggagcagagaagccaacacugcaagccugaagagggccucgaagcccagggggaggcucuuggacuggugggugcacaggccccagcgaccgaagaacaggagacagcuuccucuucaaguacuuuggucgaaguuacguuaagggaggugccggccgcagaaagccccuccccuccacauucuccccaaggcgccucgacccugccuacaacuaucaacuacacccuauggucacagagcgacgaggggaguuccaaugaggaacaggagggaccaucuacauuccccgaucucgaaaccagcuuucagguagcucugucccggaaaauggcagagcuugugcacuuccuguugcucaaguaccgcgcccgagaaccuuuuacuaaagcugagaugcugggcucagucauucguaacuuccaagacuuuuucccagugauauuuaguaaggccagcgaguaccugcagcucguuuucgguaucgaaguggucgaggugguaagaauugggcauuuauauauccugguuacaugucuuggauugucuuacgauggccugcuaggcgacaaucagauugugccgaaaaccgggcuccugaucauaguccuugcgaucauugcaaaggaaggagauugcgcccccgaggaaaagaucugggaggagcuguccguguuggaggcuucagacgguagggaggauagcguguuugcccacccucggaaacuccugacgcaggacuuaguccaagaaaacuaucuggaguaccgccagguuccaggcagugaucccgcauguuaugaguuccucugggggccuagagcucuuguggaaacuucuuacguaaaggugcugcaucacuugcuaaaaauuuccggaggcccacacaucagcuaucccccgcugcaugagugggccuuuagggaaggugaggaauga

SEQ ID NO: 2209 - RNA, 945 nt, Artificial Sequence
  derived and/or modified sequence opt4 from MAGE-A12__Homo_sapiens__AAH03408
augccccuggagcagagaagccagcacugcaagcccgaggagggccuggaggcccagggcgaggcccugggccuggugggcgcccaggcccccgccaccgaggagcaggagaccgccagcagcagcagcacccugguggaggugacccugagagaggugcccgccgccgagagccccagccccccccacagcccccagggcgccagcacccugcccaccaccaucaacuacacccuguggagccagagcgacgagggcagcagcaacgaggagcaggagggccccagcaccuuccccgaccuggagaccagcuuccagguggcccugagcagaaagauggccgagcuggugcacuuccugcugcugaaguacagagccagagagcccuucaccaaggccgagaugcugggcagcgugaucagaaacuuccaggacuucuuccccgugaucuucagcaaggccagcgaguaccugcagcugguguucggcaucgaggugguggagguggugagaaucggccaccuguacauccuggugaccugccugggccugagcuacgacggccugcugggcgacaaccagaucgugcccaagaccggccugcugaucaucgugcuggccaucaucgccaaggagggcgacugcgcccccgaggagaagaucugggaggagcugagcgugcuggaggccagcgacggcagagaggacagcguguucgcccaccccagaaagcugcugacccaggaccuggugcaggagaacuaccuggaguacagacaggugcccggcagcgaccccgccugcuacgaguuccuguggggccccagagcccugguggagaccagcuacgugaaggugcugcaccaccugcugaagaucagcggcggcccccacaucagcuaccccccccugcacgagugggccuucagagagggcgaggaguga

SEQ ID NO: 2210 - RNA, 945 nt, Artificial Sequence
  derived and/or modified sequence opt5 from MAGE-A12__Homo_sapiens__AAH03408
augccccuggagcagagaagccaacacugcaagccugaagagggccucgaagcccagggggaggcucugggacuugugggcgcccaggcgccggcuaccgaagaacaggagacagccuccucuagcuccacgcuggucgaaguuacccuccgggaggugcccgccgcugaaucuccuagcccuccccauucuccccaaggggccuccacacugccuaccacaaucaacuacacccuuuggagccaguccgacgagggaagcucuaaugaggaacaggagggcccguccacauuccccgaucuggaaaccagcuuucagguggcucucucucgcaaaauggccgagcugguccacuuccugcuccugaaguacagagcgcgggaaccuuuuacgaaagccgagaugcuuggguccgugauucgcaacuuccaagacuuuuuccccguuaucuuuagcaaggcuucugaguaccugcagcucguguucggaauugaagucguggagguugugagaaucggccaucuguauauucuugucaccugucugggccucuccuacgaugggcugcugggagacaaucagaucgugccuaaaacaggccuccugaucauugugcuugccaucauugcuaaggaaggggauugcgcccccgaggaaaagaucugggaggagcugagcguccucgaagcguccgacggacgggaggauucuguuuuugcccacccgcgcaaacugcuuacccaggaccuggugcaagaaaacuaucucgaguacagacaggugccuggcagcgaucccgcuuguuaugaguuccugugggggccucgggcccuggucgagacauccuacgugaagguucuccaucaucugcuuaaaauuagcggaggcccccacaucucuuaucccccucugcacgagugggcuuuucgcgaaggcgaggaauga

SEQ ID NO: 2211 - protein, 309 aa, Artificial Sequence
  MAGE-A1__Homo_sapiens__P43355
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 2212 - RNA, 930 nt, Artificial Sequence
  MAGE-A1__Homo_sapiens__AAA03229
augucucuugagcagaggagucugcacugcaagccugaggaagcccuugaggcccaacaagaggcccugggccuggugugugugcaggcugccaccuccuccuccucuccucugguccugggcacccuggaggaggugcccacugcugggucaacagauccuccccagaguccucagggagccuccgccuuucccacuaccaucaacuucacucgacagaggcaacccagugaggguuccagcagccgugaagaggaggggccaagcaccucuuguauccuggaguccuuguuccgagcaguaaucacuaagaagguggcugauuugguugguuuucugcuccucaaauaucgagccagggagccagucacaaaggcagaaaugcuggagagugucaucaaaaauuacaagcacuguuuuccugagaucuucggcaaagccucugaguccuugcagcuggucuuuggcauugacgugaaggaagcagaccccaccggccacuccuauguccuugucaccugccuaggucucuccuaugauggccugcugggugauaaucagaucaugcccaagacaggcuuccugauaauuguccuggucaugauugcaauggagggcggccaugcuccugaggaggaaaucugggaggagcugagugugauggagguguaugaugggagggagcacagugccuauggggagcccaggaagcugcucacccaagauuuggugcaggaaaaguaccuggaguaccggcaggugccggacagugaucccgcacgcuaugaguuccugugggguccaagggcccucgcugaaaccagcuaugugaaaguccuugaguaugugaucaaggucagugcaagaguucgcuuuuucuucccaucccugcgugaagcagcuuugagagaggaggaagagggagucuga

SEQ ID NO: 2213 - RNA, 930 nt, Artificial Sequence
  derived and/or modified sequence opt1 from MAGE-A1__Homo_sapiens__AAA03229
augagccuggagcagcgcucccuccacugcaagcccgaggaggcccuggaggcccagcaggaggcgcugggccucgugugcguccaggccgccaccagcuccagcuccccgcuggugcuggggacccucgaggaggugcccacggccggcagcaccgacccgccccaguccccgcagggggccagcgcguuccccaccaccaucaacuucacgcggcagcgccagcccuccgagggcagcuccagccgggaggaggaggggcccuccaccagcugcauccuggagucccuguuccgcgccgucaucaccaagaagguggccgaccucgugggcuuccugcugcucaaguaccgggcccgcgagcccgucaccaaggcggagaugcuggagagcgugaucaagaacuacaagcacugcuuccccgagaucuucggcaaggccuccgagagccugcagcucguguucgggaucgacgucaaggaggccgaccccacgggccacuccuacgugcuggugaccugccuggggcucagcuacgacggccugcugggggacaaccagaucaugcccaagaccggcuuccucaucaucguccuggugaugaucgccauggagggcgggcacgccccggaggaggagaucugggaggagcugagcgugauggaggucuacgacggccgggagcacuccgcguacggggagccccgcaagcuccugacccaggaccuggugcaggagaaguaccucgaguaccgccaggugcccgacagcgaccccgcccgguacgaguuccuguggggcccgcgggcccuggccgagacguccuacgucaaggugcucgaguacgugaucaaggucagcgcccgcgugcgguucuucuuccccucccugcgcgaggcggcccugcgggaggaggaggagggcguguga

SEQ ID NO: 2214 - RNA, 930 nt, Artificial Sequence
  derived and/or modified sequence opt2 from MAGE-A1__Homo_sapiens__AAA03229
augucccucgagcagcgcucccuccacugcaagcccgaggaggcccucgaggcccagcaggaggcccucggccucgucugcguccaggccgccaccuccuccuccuccccccucguccucggcacccucgaggagguccccaccgccggcuccaccgaccccccccaguccccccagggcgccuccgccuuccccaccaccaucaacuucacccgccagcgccagcccuccgagggcuccuccucccgcgaggaggagggccccuccaccuccugcauccucgagucccucuuccgcgccgucaucaccaagaaggucgccgaccucgucggcuuccuccuccucaaguaccgcgcccgcgagcccgucaccaaggccgagaugcucgaguccgucaucaagaacuacaagcacugcuuccccgagaucuucggcaaggccuccgagucccuccagcucgucuucggcaucgacgucaaggaggccgaccccaccggccacuccuacguccucgucaccugccucggccucuccuacgacggccuccucggcgacaaccagaucaugcccaagaccggcuuccucaucaucguccucgucaugaucgccauggagggcggccacgcccccgaggaggagaucugggaggagcucuccgucauggaggucuacgacggccgcgagcacuccgccuacggcgagccccgcaagcuccucacccaggaccucguccaggagaaguaccucgaguaccgccagguccccgacuccgaccccgcccgcuacgaguuccucuggggcccccgcgcccucgccgagaccuccuacgucaagguccucgaguacgucaucaaggucuccgcccgcguccgcuucuucuuccccucccuccgcgaggccgcccuccgcgaggaggaggagggcgucuga

SEQ ID NO: 2215 - RNA, 930 nt, Artificial Sequence
  derived and/or modified sequence opt3 from MAGE-A1__Homo_sapiens__AAA03229
augagccuggagcagagaucccuccacugcaagcccgaagaggcccuugaagcucaacaggaggcacugggcuugguguguguccaggccgcgaccucuucaaguagcccuuuaguucuggggacacuagaagaggugccaacugcuggauccacggacccgccccagucuccucaaggugccucggcauucccaaccacaaucaacuuuacuaggcagcggcagcccucagagggcagcaguucccgcgaagaggaagggccuucuaccagcugcauucucgagucccuguuccgagccguaauaaccaaaaagguggcugaucuugucggauuucuguugcucaaauaccgugcaagagagccagugacaaaggccgaaaugcuggagucaguuaucaaaaauuauaagcauuguuuccccgaaauuuuuggcaaggcuagugagagccugcagcucguguucgguaucgacgucaaagaagccgauccuacugggcacucuuacguguuaguaacaugccugggacuuuccuaugacggcuugcugggcgauaaccaaauuaugccaaagaccggguuucuaaucauaguucucgugaugaucgcgauggagggaggucaugcaccggaggaagagauuugggaagaacugucagucauggaaguguacgacggcagggagcacagcgccuauggggagccccggaaacuucugacgcaggauuuggugcaggaaaaguaccucgaguaucgccaggucccugacagugauccagcuagauacgaguuccuguggggacccagggccuuagcagagacuucuuacguuaaagugcuggaauauguaaucaagguguccgcucggguccgcuuuuucuuuccuagccuccgagaggccgcgcuuagagaggaagaggaaggcguguga

SEQ ID NO: 2216 - RNA, 930 nt, Artificial Sequence
  derived and/or modified sequence opt4 from MAGE-A1__Homo_sapiens__AAA03229
augagccuggagcagagaagccugcacugcaagcccgaggaggcccuggaggcccagcaggaggcccugggccuggugugcgugcaggccgccaccagcagcagcagcccccuggugcugggcacccuggaggaggugcccaccgccggcagcaccgaccccccccagagcccccagggcgccagcgccuuccccaccaccaucaacuucaccagacagagacagcccagcgagggcagcagcagcagagaggaggagggccccagcaccagcugcauccuggagagccuguucagagccgugaucaccaagaagguggccgaccuggugggcuuccugcugcugaaguacagagccagagagcccgugaccaaggccgagaugcuggagagcgugaucaagaacuacaagcacugcuuccccgagaucuucggcaaggccagcgagagccugcagcugguguucggcaucgacgugaaggaggccgaccccaccggccacagcuacgugcuggugaccugccugggccugagcuacgacggccugcugggcgacaaccagaucaugcccaagaccggcuuccugaucaucgugcuggugaugaucgccauggagggcggccacgcccccgaggaggagaucugggaggagcugagcgugauggagguguacgacggcagagagcacagcgccuacggcgagcccagaaagcugcugacccaggaccuggugcaggagaaguaccuggaguacagacaggugcccgacagcgaccccgccagauacgaguuccuguggggccccagagcccuggccgagaccagcuacgugaaggugcuggaguacgugaucaaggugagcgccagagugagauucuucuuccccagccugagagaggccgcccugagagaggaggaggagggcguguga

SEQ ID NO: 2217 - RNA, 930 nt, Artificial Sequence
  derived and/or modified sequence opt5 from MAGE-A1__Homo_sapiens__AAA03229
augagccuggagcagagaucccuccacugcaagcccgaagaggcccuggaagcucaacaggaggcccuuggccugguguguguccaggcggcuaccucuagcuccucuccucucguucuggggacacuugaagaggugccgacggccggaagcaccgaucccccucagucuccccaaggcgccuccgcuuucccuacaaccaucaacuuuacacggcagcgccagcccagcgagggguccagcucuagagaagaggaaggaccuuccaccagcugcauucuggagucucucuuccgggccgugaucaccaaaaaggucgcugaccuggugggcuuucugcuccugaaauaccgcgccagagagccgguuacaaaggcggaaaugcuugaguccgugauuaaaaauuauaagcauuguuuccccgaaaucuuugggaaggccagcgagucucugcagcucgucuucggaauugacgugaaagaagcugauccuacgggccacuccuacguucuggugaccugccuuggccugagcuaugacgggcuccugggagauaaccaaaucaugcccaagacaggcuuucugaucauuguccucgugaugaucgccauggaagggggacaugcuccugaggaagagauuugggaggagcuguccgugauggaagucuacgacggccgggagcacucugccuauggggagccccgcaaacuucugacccaggaucucguucaggaaaaguaccuggaguauagacaggugccggacagcgauccugcgcgguacgaguuccuuuggggaccccgcgcccuggcugaaacauccuacgugaaaguccucgaauaugugaucaagguuagcgccagagugcgguuuuucuuuccuucucugcgcgaggcugcccugagagaggaagaggaaggcgucuga

SEQ ID NO: 2218 - protein, 314 aa, Artificial Sequence
  MAGE-A2__Homo_sapiens__P43356
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 2219 - RNA, 945 nt, Artificial Sequence
  MAGE-A2__Homo_sapiens__AAA17729
augccucuugagcagaggagucagcacugcaagccugaagaaggccuugaggcccgaggagaggcccugggccuggugggugcgcaggcuccugcuacugaggagcagcagaccgcuucuuccucuucuacucuaguggaaguuacccugggggaggugccugcugccgacucaccgaguccuccccacaguccucagggagccuccagcuucucgacuaccaucaacuacacucuuuggagacaauccgaugagggcuccagcaaccaagaagaggaggggccaagaauguuucccgaccuggaguccgaguuccaagcagcaaucaguaggaagaugguugaguugguucauuuucugcuccucaaguaucgagccagggagccggucacaaaggcagaaaugcuggagaguguccucagaaauugccaggacuucuuucccgugaucuucagcaaagccuccgaguacuugcagcuggucuuuggcaucgaggugguggaagugguccccaucagccacuuguacauccuugucaccugccugggccucuccuacgauggccugcugggcgacaaucaggucaugcccaagacaggccuccugauaaucguccuggccauaaucgcaauagagggcgacugugccccugaggagaaaaucugggaggagcugaguauguuggagguguuugaggggagggaggacagugucuucgcacaucccaggaagcugcucaugcaagaucuggugcaggaaaacuaccuggaguaccggcaggugcccggcagugauccugcaugcuacgaguuccugugggguccaagggcccucauugaaaccagcuaugugaaaguccugcaccauacacuaaagaucgguggagaaccucacauuuccuacccaccccugcaugaacgggcuuugagagagggagaagaguga

SEQ ID NO: 2220 - RNA, 945 nt, Artificial Sequence
  derived and/or modified sequence opt1 from MAGE-A2__Homo_sapiens__AAA17729
augccccuggagcagcgcagccagcacugcaagccggaggagggccucgaggcccgcggggaggcccugggccuggugggggcgcaggcccccgccaccgaggagcagcagaccgccuccagcuccagcacgcucgucgaggugacccugggcgaggugcccgccgcggacucccccagcccgccccacagcccccagggggccuccuccuucagcaccaccaucaacuacacgcuguggcggcaguccgacgagggcagcuccaaccaggaggaggagggcccccggauguucccggaccucgagagcgaguuccaggccgccaucucccgcaagauggucgagcuggugcacuuccugcuccugaaguaccgggcgcgcgagcccgugaccaaggccgagaugcuggagagcguccuccggaacugccaggacuucuuccccgugaucuucuccaaggccagcgaguaccugcagcugguguucgggaucgaggucguggaggugguccccaucucccaccucuacauccuggugaccugccugggccucagcuacgacgggcugcugggcgacaaccaggugaugccgaagaccgggcuccugaucaucguccuggccaucaucgccaucgagggcgacugcgcgcccgaggagaagaucugggaggagcucagcaugcuggagguguucgagggccgcgaggacuccguguucgcccacccccggaagcugcucaugcaggaccugguccaggagaacuaccuggaguaccgccaggugcccgggagcgacccggccugcuacgaguuccucuggggcccccgggcccugaucgagacguccuacgugaagguccugcaccacacccucaagaucgggggcgagccccacaucagcuacccgccccugcacgagcgcgcccugcgggagggcgaggaguga

SEQ ID NO: 2221 - RNA, 945 nt, Artificial Sequence
  derived and/or modified sequence opt2 from MAGE-A2__Homo_sapiens__AAA17729
augccccucgagcagcgcucccagcacugcaagcccgaggagggccucgaggcccgcggcgaggcccucggccucgucggcgcccaggcccccgccaccgaggagcagcagaccgccuccuccuccuccacccucgucgaggucacccucggcgagguccccgccgccgacucccccucccccccccacuccccccagggcgccuccuccuucuccaccaccaucaacuacacccucuggcgccaguccgacgagggcuccuccaaccaggaggaggagggcccccgcauguuccccgaccucgaguccgaguuccaggccgccaucucccgcaagauggucgagcucguccacuuccuccuccucaaguaccgcgcccgcgagcccgucaccaaggccgagaugcucgaguccguccuccgcaacugccaggacuucuuccccgucaucuucuccaaggccuccgaguaccuccagcucgucuucggcaucgaggucgucgaggucguccccaucucccaccucuacauccucgucaccugccucggccucuccuacgacggccuccucggcgacaaccaggucaugcccaagaccggccuccucaucaucguccucgccaucaucgccaucgagggcgacugcgcccccgaggagaagaucugggaggagcucuccaugcucgaggucuucgagggccgcgaggacuccgucuucgcccacccccgcaagcuccucaugcaggaccucguccaggagaacuaccucgaguaccgccagguccccggcuccgaccccgccugcuacgaguuccucuggggcccccgcgcccucaucgagaccuccuacgucaagguccuccaccacacccucaagaucggcggcgagccccacaucuccuaccccccccuccacgagcgcgcccuccgcgagggcgaggaguga

SEQ ID NO: 2222 - RNA, 945 nt, Artificial Sequence
  derived and/or modified sequence opt3 from MAGE-A2__Homo_sapiens__AAA17729
augccccuggagcagagaagccaacacugcaagccugaagagggccucgaagccaggggagaggcucuugggcuggugggugcacaggccccagcgaccgaggaacagcagacagcuuccucuucaaguacuuuggucgagguuacguuaggcgaagugccggccgcagacagccccuccccuccacauucuccccaaggggccucgucauucagcaccacaaucaacuacacucuguggcggcagagugaugagggauccucuaaucaggaagaggagggcccucgcauguuuccagaccuagaaagcgaguuccaggcugcaauuucccgaaaaaugguagaacucgugcacuuucugcuucugaaguaccgugccagagagcccgucaccaaagcugaaauguuggagucagugcucaggaacugucaagauuucuuuccuguuauauucaguaaggccagcgaguaccugcagcugguguuugguaucgaagucguggagguaguuccaauuucucaucucuauaucuuagugacaugccuggggcuuuccuacgacggauugcugggcgauaaucaggucaugccgaaaaccggccuacucauuaucgugcuggcgauaaucgcaauugaaggggacugugcccccgaggaaaagaucugggaggagcuuucaaugcuggaaguguucgagggacgggaagauagcgucuuugcucacccucgcaaguugcucaugcaggaccugguucaagagaacuauuuagaauacagacaggugccagguagugaucccgccugcuaugaguuccuguggggcccuagggcacucauugagacuucuuacguaaaagugcuucaucacacacugaagaucgggggagaaccacacauauccuaucccccguugcaugagcgggcucuacgcgaaggcgaggaguga

SEQ ID NO: 2223 - RNA, 945 nt, Artificial Sequence
  derived and/or modified sequence opt4 from MAGE-A2__Homo_sapiens__AAA17729
augccccuggagcagagaagccagcacugcaagcccgaggagggccuggaggccagaggcgaggcccugggccuggugggcgcccaggcccccgccaccgaggagcagcagaccgccagcagcagcagcacccugguggaggugacccugggcgaggugcccgccgccgacagccccagccccccccacagcccccagggcgccagcagcuucagcaccaccaucaacuacacccuguggagacagagcgacgagggcagcagcaaccaggaggaggagggccccagaauguuccccgaccuggagagcgaguuccaggccgccaucagcagaaagaugguggagcuggugcacuuccugcugcugaaguacagagccagagagcccgugaccaaggccgagaugcuggagagcgugcugagaaacugccaggacuucuuccccgugaucuucagcaaggccagcgaguaccugcagcugguguucggcaucgaggugguggagguggugcccaucagccaccuguacauccuggugaccugccugggccugagcuacgacggccugcugggcgacaaccaggugaugcccaagaccggccugcugaucaucgugcuggccaucaucgccaucgagggcgacugcgcccccgaggagaagaucugggaggagcugagcaugcuggagguguucgagggcagagaggacagcguguucgcccaccccagaaagcugcugaugcaggaccuggugcaggagaacuaccuggaguacagacaggugcccggcagcgaccccgccugcuacgaguuccuguggggccccagagcccugaucgagaccagcuacgugaaggugcugcaccacacccugaagaucggcggcgagccccacaucagcuaccccccccugcacgagagagcccugagagagggcgaggaguga

SEQ ID NO: 2224 - RNA, 945 nt, Artificial Sequence
  derived and/or modified sequence opt5 from MAGE-A2__Homo_sapiens__AAA17729
augccccuggagcagagaagccaacacugcaagccugaagagggccucgaagcccggggcgaggcucugggacuugugggcgcccaggcgccggcuaccgaggaacagcagacagccuccucuagcuccacgcuggucgagguuacccucggggaagugcccgccgcugacucuccuagcccuccccauucuccccaaggagccuccagcuucuccacaaccaucaacuacacacuguggcgccagagcgaugaggggucuuccaaucaggaagaggaggggccuagaauguuuccggaccuugaaagcgaguuccaggcugccauuucucggaaaaugguggaacugguccacuuucuccugcugaaguaccgcgcgagagagcccgugaccaaagccgaaaugcucgaguccguucugcggaacugucaagauuucuuuccugugaucuucagcaaggcuucugaguaccuucagcuggucuuuggaauugaagugguugaggugguccccaucucccaucucuauauucuggugacaugccuuggccugagcuacgacggccuccugggggauaaucaggugaugccuaaaaccggacugcucaucaucguccuggccauuaucgcuauugaaggcgacugugcccccgaggaaaagaucugggaggagcuuuccaugcuggaaguuuucgaggggcgcgaagauucuguguuugcgcacccgagaaagcuccugaugcaggaccuugugcaagagaacuaucuggaauaccggcaggucccuggaagcgaucccgccugcuaugaguuccucuggggcccucgcgcucugauugagacguccuacgugaaaguucugcaucacacccucaagaucgggggagaaccccacauuagcuaucccccucugcaugagagagcccuucgggaaggcgaggaguga

SEQ ID NO: 2225 - protein, 314 aa, Artificial Sequence
  MAGE-A3__Homo_sapiens__P43357
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 2226 - RNA, 945 nt, Artificial Sequence
  MAGE-A3__Homo_sapiens__AAA17446
augccucuugagcagaggagucagcacugcaagccugaagaaggccuugaggcccgaggagaggcccugggccuggugggugcgcaggcuccugcuacugaggagcaggaggcugccuccuccucuucuacucuaguugaagucacccugggggaggugccugcugccgagucaccagauccuccccagaguccucagggagccuccagccuccccacuaccaugaacuacccucucuggagccaauccuaugaggacuccagcaaccaagaagaggaggggccaagcaccuucccugaccuggaguccgaguuccaagcagcacucaguaggaagguggccgaguugguucauuuucugcuccucaaguaucgagccagggagccggucacaaaggcagaaaugcuggggagugucgucggaaauuggcaguauuucuuuccugugaucuucagcaaagcuuccaguuccuugcagcuggucuuuggcaucgagcugauggaaguggaccccaucggccacuuguacaucuuugccaccugccugggccucuccuacgauggccugcugggugacaaucagaucaugcccaaggcaggccuccugauaaucguccuggccauaaucgcaagagagggcgacugugccccugaggagaaaaucugggaggagcugaguguguuagagguguuugaggggagggaagacaguaucuugggggaucccaagaagcugcucacccaacauuucgugcaggaaaacuaccuggaguaccggcagguccccggcagugauccugcauguuaugaauuccugugggguccaagggcccucguugaaaccagcuaugugaaaguccugcaccauaugguaaagaucaguggaggaccucacauuuccuacccaccccugcaugaguggguuuugagagagggggaagaguga

SEQ ID NO: 2227 - RNA, 945 nt, Artificial Sequence
  derived and/or modified sequence opt1 from MAGE-A3__Homo_sapiens__AAA17446
augccccuggagcagcgcagccagcacugcaagcccgaggagggccucgaggcccgcggggaggcccugggccuggugggggcgcaggcccccgccaccgaggagcaggaggccgccuccagcuccagcacccucgucgaggugacgcugggcgaggugcccgcggccgagucccccgacccgccccagagcccccagggggccuccagccugcccaccaccaugaacuacccgcucuggucccagagcuacgaggacuccagcaaccaggaggaggagggccccuccaccuuccccgaccuggagagcgaguuccaggccgcgcugucccggaaggucgccgagcucgugcacuuccugcugcucaaguaccgggcccgcgagcccgugacgaaggccgagaugcugggcagcgucguggggaacuggcaguacuucuucccggugaucuucuccaaggccagcuccagccugcagcucgucuucggcaucgagcugauggagguggaccccaucgggcaccuguacaucuucgcgaccugccucggccugagcuacgacgggcugcucggcgacaaccagaucaugcccaaggccggccugcugaucaucgugcucgccaucaucgcccgggagggggacugcgcccccgaggagaagaucugggaggagcuguccguccuggagguguucgagggccgcgaggacagcauccucggggacccgaagaagcugcugacccagcacuucgugcaggagaacuaccucgaguaccggcagguccccggcuccgaccccgcgugcuacgaguuccuguggggcccccgcgcccugguggagaccagcuacgugaagguccuccaccacauggugaagaucuccgggggcccgcacaucagcuacccgccccugcacgagugggugcugcgggagggggaggaguga

SEQ ID NO: 2228 - RNA, 945 nt, Artificial Sequence
  derived and/or modified sequence opt2 from MAGE-A3__Homo_sapiens__AAA17446
augccccucgagcagcgcucccagcacugcaagcccgaggagggccucgaggcccgcggcgaggcccucggccucgucggcgcccaggcccccgccaccgaggagcaggaggccgccuccuccuccuccacccucgucgaggucacccucggcgagguccccgccgccgagucccccgaccccccccaguccccccagggcgccuccucccuccccaccaccaugaacuacccccucuggucccaguccuacgaggacuccuccaaccaggaggaggagggccccuccaccuuccccgaccucgaguccgaguuccaggccgcccucucccgcaaggucgccgagcucguccacuuccuccuccucaaguaccgcgcccgcgagcccgucaccaaggccgagaugcucggcuccgucgucggcaacuggcaguacuucuuccccgucaucuucuccaaggccuccuccucccuccagcucgucuucggcaucgagcucauggaggucgaccccaucggccaccucuacaucuucgccaccugccucggccucuccuacgacggccuccucggcgacaaccagaucaugcccaaggccggccuccucaucaucguccucgccaucaucgcccgcgagggcgacugcgcccccgaggagaagaucugggaggagcucuccguccucgaggucuucgagggccgcgaggacuccauccucggcgaccccaagaagcuccucacccagcacuucguccaggagaacuaccucgaguaccgccagguccccggcuccgaccccgccugcuacgaguuccucuggggcccccgcgcccucgucgagaccuccuacgucaagguccuccaccacauggucaagaucuccggcggcccccacaucuccuaccccccccuccacgaguggguccuccgcgagggcgaggaguga

SEQ ID NO: 2229 - RNA, 945 nt, Artificial Sequence
  derived and/or modified sequence opt3 from MAGE-A3__Homo_sapiens__AAA17446
augccccuggagcagagaagccagcacugcaagccugaagagggccucgaagccaggggagaggcucuugggcuggugggugcacaggccccagcgaccgaggaacaggaggcugccuccucuucaaguacauuggucgaaguuacuuuaggcgaggugccggcagccgaaagccccgacccuccacagagcccccaaggggcuucuucgcugccuacgaccaugaacuacccacuauggucacagagcuaugaggauaguuccaaucaggaggaagagggacccucuacauucccugaccucgaaagcgaguuucaggcagcccugucccggaaaguagcugaacuugugcauuuccuguugcucaaguaccgcgcccgagagccagucacuaaagcggagaugcugggcucagugguugguaacuggcaauacuuuuucccggugaucuuuaguaaggcauccucuucccugcagcucgucuucgggauugaauuaauggagguggaucccauaggacaccuguauaucuuugccaccugucuuggcuugucauaugacggccugcuaggggauaaucagauuaugccuaaagcuggacuccugaucauuguacuugccaucauagcacgugaaggugacugcgcuccagaggaaaagaucugggaggagcugagcguuuuggaaguguucgagggcagagaagauaguauucucggggaccccaagaaacuguuaacacagcauuuuguccaagagaacuaccuggaauauaggcaagugccuggaucugauccagccuguuacgaguuccucuggggcccccgggcgcuuguggagaccuccuacgucaagguucugcaccauauggugaaaaucagcggugggccgcacauuucguauccucccuugcacgaauggguacuacgcgagggagaagaguga

SEQ ID NO: 2230 - RNA, 945 nt, Artificial Sequence
  derived and/or modified sequence opt4 from MAGE-A3__Homo_sapiens__AAA17446
augccccuggagcagagaagccagcacugcaagcccgaggagggccuggaggccagaggcgaggcccugggccuggugggcgcccaggcccccgccaccgaggagcaggaggccgccagcagcagcagcacccugguggaggugacccugggcgaggugcccgccgccgagagccccgaccccccccagagcccccagggcgccagcagccugcccaccaccaugaacuacccccuguggagccagagcuacgaggacagcagcaaccaggaggaggagggccccagcaccuuccccgaccuggagagcgaguuccaggccgcccugagcagaaagguggccgagcuggugcacuuccugcugcugaaguacagagccagagagcccgugaccaaggccgagaugcugggcagcguggugggcaacuggcaguacuucuuccccgugaucuucagcaaggccagcagcagccugcagcugguguucggcaucgagcugauggagguggaccccaucggccaccuguacaucuucgccaccugccugggccugagcuacgacggccugcugggcgacaaccagaucaugcccaaggccggccugcugaucaucgugcuggccaucaucgccagagagggcgacugcgcccccgaggagaagaucugggaggagcugagcgugcuggagguguucgagggcagagaggacagcauccugggcgaccccaagaagcugcugacccagcacuucgugcaggagaacuaccuggaguacagacaggugcccggcagcgaccccgccugcuacgaguuccuguggggccccagagcccugguggagaccagcuacgugaaggugcugcaccacauggugaagaucagcggcggcccccacaucagcuaccccccccugcacgagugggugcugagagagggcgaggaguga

SEQ ID NO: 2231 - RNA, 945 nt, Artificial Sequence
  derived and/or modified sequence opt5 from MAGE-A3__Homo_sapiens__AAA17446
augccccuggagcagagaagccaacacugcaagccugaagagggccucgaagcccgcggggaggcucugggacuugugggcgcccaggcgccggcuaccgaggaacaggaggccgccuccucuagcuccacacuggucgaaguuacgcucggggaggugcccgcugccgaaucuccugaucccccucagagcccccaaggagcuuccucucugccuaccacaaugaacuacccgcuuuggagccaguccuaugaggacagcucuaaucaggaggaagagggccccuccaccuucccugaccuggaaagcgaguuucaggccgcgcucucucggaaaguggccgaacugguccauuuccugcuccugaaguacagagcucgggagcccgugacaaaagccgagaugcuuggguccguugugggaaacuggcaauacuuuuucccugucaucuuuagcaaggcuucuuccagccugcagcucguguucggcauugaacugauggagguugaucccaucggccaccuuuauauuuuugccaccugucuggggcucuccuaugacggacugcugggcgauaaucagaucaugccgaaagcggggcuccugauuaucgugcuugccaucauugcucgcgaaggagacugcgccccugaggaaaagaucugggaggagcugucuguccucgaaguguucgagggcagagaagauagcauucugggggaccccaagaaacuucugacacagcauuuugugcaagagaacuaccucgaauaucggcaggucccuggauccgaucccgcuuguuacgaguuccuguggggcccccgcgcccugguugagaccagcuacgugaaggugcuccaccauauggucaaaaucucuggcgggccucacauuuccuauccgccccugcacgaaugggugcuuagagagggagaagaguga

SEQ ID NO: 2232 - protein, 317 aa, Artificial Sequence
  MAGE-A4__Homo_sapiens__A0A024RC12
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 2233 - RNA, 954 nt, Artificial Sequence
  MAGE-A4__Homo_sapiens__EAW99410
augucuucugagcagaagagucagcacugcaagccugaggaaggcguugaggcccaagaagaggcccugggccuggugggugcacaggcuccuacuacugaggagcaggaggcugcugucuccuccuccucuccucuggucccuggcacccuggaggaagugccugcugcugagucagcagguccuccccagaguccucagggagccucugccuuacccacuaccaucagcuucacuugcuggaggcaacccaaugaggguuccagcagccaagaagaggaggggccaagcaccucgccugacgcagaguccuuguuccgagaagcacucaguaacaagguggaugaguuggcucauuuucugcuccgcaaguaucgagccaaggagcuggucacaaaggcagaaaugcuggagagagucaucaaaaauuacaagcgcugcuuuccugugaucuucggcaaagccuccgagucccugaagaugaucuuuggcauugacgugaaggaaguggaccccgccagcaacaccuacacccuugucaccugccugggccuuuccuaugauggccugcuggguaauaaucagaucuuucccaagacaggccuucugauaaucguccugggcacaauugcaauggagggcgacagcgccucugaggaggaaaucugggaggagcugggugugauggggguguaugaugggagggagcacacugucuauggggagcccaggaaacugcucacccaagauugggugcaggaaaacuaccuggaguaccggcagguacccggcaguaauccugcgcgcuaugaguuccugugggguccaagggcucuggcugaaaccagcuaugugaaaguccuggagcauguggucagggucaaugcaagaguucgcauugccuacccaucccugcgugaagcagcuuuguuagaggaggaagagggagucuga

SEQ ID NO: 2234 - RNA, 954 nt, Artificial Sequence
  derived and/or modified sequence opt1 from MAGE-A4__Homo_sapiens__EAW99410
augagcuccgagcagaagucccagcacugcaagcccgaggagggcguggaggcccaggaggaggcccuggggcucgucggcgcgcaggccccgaccaccgaggagcaggaggccgccgugagcagcuccagcccccuggugcccgggacgcuggaggagguccccgccgcggaguccgccggcccgccccagagcccccagggggccuccgcccuccccaccaccaucagcuucacgugcuggcgccagccgaacgagggcuccagcucccaggaggaggagggccccagcaccucccccgacgcggagagccuguuccgggaggcccuguccaacaagguggacgagcucgcccacuuccugcugcgcaaguaccgggccaaggagcucgugaccaaggccgagaugcuggagcgcgucaucaagaacuacaagcggugcuuccccgugaucuucgggaaggcgagcgagucccugaagaugaucuucggcaucgacgugaaggaggucgacccggccagcaacaccuacacccucgugacgugccuggggcugagcuacgacggccuccuggggaacaaccagaucuuccccaagaccggccugcucaucaucgugcugggcaccaucgccauggagggggacuccgccagcgaggaggagaucugggaggagcugggcgucauggggguguacgacggccgcgagcacaccguguacggcgagccccggaagcuccugacgcaggacuggguccaggagaacuaccuggaguaccgccaggugcccggguccaacccggcccgguacgaguuccucuggggcccccgcgcgcuggccgagaccagcuacgugaagguccuggagcacguggugcgggucaacgcccgcgugcggaucgccuaccccucccuccgcgaggccgcgcugcuggaggaggaggaggggguguga

SEQ ID NO: 2235 - RNA, 954 nt, Artificial Sequence
  derived and/or modified sequence opt2 from MAGE-A4__Homo_sapiens__EAW99410
auguccuccgagcagaagucccagcacugcaagcccgaggagggcgucgaggcccaggaggaggcccucggccucgucggcgcccaggcccccaccaccgaggagcaggaggccgccgucuccuccuccuccccccucguccccggcacccucgaggagguccccgccgccgaguccgccggccccccccaguccccccagggcgccuccgcccuccccaccaccaucuccuucaccugcuggcgccagcccaacgagggcuccuccucccaggaggaggagggccccuccaccucccccgacgccgagucccucuuccgcgaggcccucuccaacaaggucgacgagcucgcccacuuccuccuccgcaaguaccgcgccaaggagcucgucaccaaggccgagaugcucgagcgcgucaucaagaacuacaagcgcugcuuccccgucaucuucggcaaggccuccgagucccucaagaugaucuucggcaucgacgucaaggaggucgaccccgccuccaacaccuacacccucgucaccugccucggccucuccuacgacggccuccucggcaacaaccagaucuuccccaagaccggccuccucaucaucguccucggcaccaucgccauggagggcgacuccgccuccgaggaggagaucugggaggagcucggcgucaugggcgucuacgacggccgcgagcacaccgucuacggcgagccccgcaagcuccucacccaggacuggguccaggagaacuaccucgaguaccgccagguccccggcuccaaccccgcccgcuacgaguuccucuggggcccccgcgcccucgccgagaccuccuacgucaagguccucgagcacgucguccgcgucaacgcccgcguccgcaucgccuaccccucccuccgcgaggccgcccuccucgaggaggaggagggcgucuga

SEQ ID NO: 2236 - RNA, 954 nt, Artificial Sequence
  derived and/or modified sequence opt3 from MAGE-A4__Homo_sapiens__EAW99410
augagcuccgagcagaagucucaacacugcaaacccgaagagggcguggaagcccaggaggaagcucuggggcucgucggagcacaggccccuaccacagaggagcaggaagcggcuguuucaaguagcuccccacuugugccggguacucuggaggaaguacccgccgcagagucugccggcccuccacaaucgccccagggggcuucagcauugccuacgaccaucagcuucacauguuggagacagccaaacgagggaaguuccucucaggaagaggaaggccccagcacuuccccugacgccgagucauuauuuagggaagcucugaguaauaagguggaugagcuagcccauuuccuccugcggaaauaccgcgcgaaggagcuugucaccaaagcagaaaugcuggagcgagugauuaagaacuauaagcguugcuuuccaguuauauucgguaaagccagcgaaucuuugaagaugaucuuugggauugacgugaaagaggucgauccggcuuccaauacauacacccucgugacuugucugggacugucauaugacggccucuuaggcaacaaucaaaucuuccccaagacagggcugcuuauuaucguauugggaaccauagccauggaaggugauagcgcaagugaggaggaaaucugggaggaacugggcguuauggggguguacgacggaagagagcacacggucuauggcgaaccuaggaaacuacucacucaggauugggugcaggagaacuaccuggaguaucgccaggugccagguucuaaucccgcucgguacgaauuucuuugggggccuagagcccuggcggagaccuccuacgucaagguuuuggaacaugugguaagggugaacgcccggguccgcauugcauauccaagccuccgagaggcugcccuguuagaggaagaggaaggaguguga

SEQ ID NO: 2237 - RNA, 954 nt, Artificial Sequence
  derived and/or modified sequence opt4 from MAGE-A4__Homo_sapiens__EAW99410
augagcagcgagcagaagagccagcacugcaagcccgaggagggcguggaggcccaggaggaggcccugggccuggugggcgcccaggcccccaccaccgaggagcaggaggccgccgugagcagcagcagcccccuggugcccggcacccuggaggaggugcccgccgccgagagcgccggccccccccagagcccccagggcgccagcgcccugcccaccaccaucagcuucaccugcuggagacagcccaacgagggcagcagcagccaggaggaggagggccccagcaccagccccgacgccgagagccuguucagagaggcccugagcaacaagguggacgagcuggcccacuuccugcugagaaaguacagagccaaggagcuggugaccaaggccgagaugcuggagagagugaucaagaacuacaagagaugcuuccccgugaucuucggcaaggccagcgagagccugaagaugaucuucggcaucgacgugaaggagguggaccccgccagcaacaccuacacccuggugaccugccugggccugagcuacgacggccugcugggcaacaaccagaucuuccccaagaccggccugcugaucaucgugcugggcaccaucgccauggagggcgacagcgccagcgaggaggagaucugggaggagcugggcgugaugggcguguacgacggcagagagcacaccguguacggcgagcccagaaagcugcugacccaggacugggugcaggagaacuaccuggaguacagacaggugcccggcagcaaccccgccagauacgaguuccuguggggccccagagcccuggccgagaccagcuacgugaaggugcuggagcacguggugagagugaacgccagagugagaaucgccuaccccagccugagagaggccgcccugcuggaggaggaggagggcguguga

SEQ ID NO: 2238 - RNA, 954 nt, Artificial Sequence
  derived and/or modified sequence opt5 from MAGE-A4__Homo_sapiens__EAW99410
augagcuccgagcagaagucucaacacugcaaacccgaagagggcguggaagcccaggaggaagcucuggggcucgucggagcccaggcgccuaccacagaggagcaggaagcugccguuagcuccucuagcccgcuggugcccggcacgcuugaggaagugccugccgcugaguccgccgggcccccucaaucuccccagggagcuagcgcccugccuaccacaaucuccuucaccuguuggagacagccgaacgagggcucuagcucccaggaagaggaagggcccagcacaucuccugacgcggagucccucuuucgggaagcccugagcaauaaggucgaugagcuugcucauuuccugcuccgcaaauacagagccaaggagcuggugaccaaagcugaaaugcuggagcggguuauuaagaacuauaagcgcugcuuucccgugaucuucggaaaagccucugaaucccucaagaugauuuuuggcaucgacgucaaagagguggauccugcgagcaauacauacacccugguuacgugucuuggccuguccuaugacgggcuccugggaaacaaucaaauuuuccccaagaccggccuucugaucaucgugcucgggacaauugccauggaaggagauucugcuagcgaggaggaaaucugggaggaacugggcgucauggggguguacgacggaagagagcacaccguguauggcgaaccgcggaaacugcucacacaggauuggguccaggagaacuaccuggaguaucgccagguuccuggcuccaaucccgccagauacgaauuucuuugggggccucgggcucuggccgagaccagcuacgugaaggugcucgaacaugucgugcgcguuaacgccagagugcggauugcuuaucccucucugcgcgaggcggcccuucuggaggaagaggaaggagucuga

SEQ ID NO: 2239 - protein, 317 aa, Artificial Sequence; identical to SEQ ID NO: 2232
  MAGE-A4__Homo_sapiens__P43358

SEQ ID NO: 2240 - RNA, 954 nt, Artificial Sequence; identical to SEQ ID NO: 2233
  MAGE-A4__Homo_sapiens__AAA68871

SEQ ID NO: 2241 - RNA, 954 nt, Artificial Sequence; identical to SEQ ID NO: 2234
  derived and/or modified sequence opt1 from MAGE-A4__Homo_sapiens__AAA68871

SEQ ID NO: 2242 - RNA, 954 nt, Artificial Sequence; identical to SEQ ID NO: 2235
  derived and/or modified sequence opt2 from MAGE-A4__Homo_sapiens__AAA68871

SEQ ID NO: 2243 - RNA, 954 nt, Artificial Sequence; identical to SEQ ID NO: 2236
  derived and/or modified sequence opt3 from MAGE-A4__Homo_sapiens__AAA68871

SEQ ID NO: 2244 - RNA, 954 nt, Artificial Sequence; identical to SEQ ID NO: 2237
  derived and/or modified sequence opt4 from MAGE-A4__Homo_sapiens__AAA68871

SEQ ID NO: 2245 - RNA, 954 nt, Artificial Sequence; identical to SEQ ID NO: 2238
  derived and/or modified sequence opt5 from MAGE-A4__Homo_sapiens__AAA68871

SEQ ID NO: 2246 - protein, 317 aa, Artificial Sequence
  MAGE-A4__Homo_sapiens__Q1RN33
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPTSNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 2247 - RNA, 954 nt, Artificial Sequence
  MAGE-A4__Homo_sapiens__AAY27261
augucuucugagcagaagagucagcacugcaagccugaggaaggcguugaggcccaagaagaggcccugggccuggugggugcgcaggcuccuacuacugaggagcaggaggcugcugucuccuccuccucuccucuggucccuggcacccuggaggaagugccugcugcugagucagcagguccuccccagaguccucagggagccucugccuuacccacuaccaucagcuucacuugcuggaggcaacccaaugaggguuccagcagccaagaagaggaggggccaagcaccucgccugacgcagaguccuuguuccgagaagcacucaguaacaagguggaugaguuggcucauuuucugcuccgcaaguaucgagccaaggagcuggucacaaaggcagaaaugcuggagagagucaucaaaaauuacaagcgcugcuuuccugugaucuucggcaaagccuccgagucccugaagaugaucuuuggcauugacgugaaggaaguggaccccaccagcaacaccuacacccuugucaccugccugggccuuuccuaugauggccugcuggguaauaaucagaucuuucccaagacaggccuucugauaaucguccugggcacaauugcaauggagggcgacagcgccucugaggaggaaaucugggaggagcugggugugauggggguguaugaugggagggagcacacugucuauggggagcccaggaaacugcucacccaagauugggugcaggaaaacuaccuggaguaccggcagguacccggcaguaauccugcgcgcuaugaguuccugugggguccaagggcucuggcugaaaccagcuaugugaaaguccuggagcauguggucagggucaaugcaagaguucgcauugccuacccaucccugcgugaagcagcuuuguuagaggaggaagagggagucuga

SEQ ID NO: 2248 - RNA, 954 nt, Artificial Sequence
  derived and/or modified sequence opt1 from MAGE-A4__Homo_sapiens__AAY27261
augagcuccgagcagaagucccagcacugcaagcccgaggagggcguggaggcccaggaggaggcccuggggcucgucggcgcgcaggccccgaccaccgaggagcaggaggccgccgugagcagcuccagcccccuggugcccgggacgcuggaggagguccccgccgcggaguccgccggcccgccccagagcccccagggggccuccgcccuccccaccaccaucagcuucacgugcuggcgccagccgaacgagggcuccagcucccaggaggaggagggccccagcaccucccccgacgcggagagccuguuccgggaggcccuguccaacaagguggacgagcucgcccacuuccugcugcgcaaguaccgggccaaggagcucgugaccaaggccgagaugcuggagcgcgucaucaagaacuacaagcggugcuuccccgugaucuucgggaaggcgagcgagucccugaagaugaucuucggcaucgacgugaaggaggucgacccgaccagcaacaccuacacgcucgugaccugccuggggcugagcuacgacggccuccuggggaacaaccagaucuuccccaagaccggccugcucaucaucgugcugggcaccaucgccauggagggggacuccgccagcgaggaggagaucugggaggagcugggcgucauggggguguacgacggccgcgagcacacgguguacggcgagccccggaagcuccugacccaggacuggguccaggagaacuaccuggaguaccgccaggugcccggguccaacccggcccgguacgaguuccucuggggcccccgcgcccuggcggagaccagcuacgugaagguccuggagcacguggugcgggucaacgcccgcgugcggaucgccuaccccucccuccgcgaggccgcccugcuggaggaggaggaggggguguga

SEQ ID NO: 2249 - RNA, 954 nt, Artificial Sequence
  derived and/or modified sequence opt2 from MAGE-A4__Homo_sapiens__AAY27261
auguccuccgagcagaagucccagcacugcaagcccgaggagggcgucgaggcccaggaggaggcccucggccucgucggcgcccaggcccccaccaccgaggagcaggaggccgccgucuccuccuccuccccccucguccccggcacccucgaggagguccccgccgccgaguccgccggccccccccaguccccccagggcgccuccgcccuccccaccaccaucuccuucaccugcuggcgccagcccaacgagggcuccuccucccaggaggaggagggccccuccaccucccccgacgccgagucccucuuccgcgaggcccucuccaacaaggucgacgagcucgcccacuuccuccuccgcaaguaccgcgccaaggagcucgucaccaaggccgagaugcucgagcgcgucaucaagaacuacaagcgcugcuuccccgucaucuucggcaaggccuccgagucccucaagaugaucuucggcaucgacgucaaggaggucgaccccaccuccaacaccuacacccucgucaccugccucggccucuccuacgacggccuccucggcaacaaccagaucuuccccaagaccggccuccucaucaucguccucggcaccaucgccauggagggcgacuccgccuccgaggaggagaucugggaggagcucggcgucaugggcgucuacgacggccgcgagcacaccgucuacggcgagccccgcaagcuccucacccaggacuggguccaggagaacuaccucgaguaccgccagguccccggcuccaaccccgcccgcuacgaguuccucuggggcccccgcgcccucgccgagaccuccuacgucaagguccucgagcacgucguccgcgucaacgcccgcguccgcaucgccuaccccucccuccgcgaggccgcccuccucgaggaggaggagggcgucuga

SEQ ID NO: 2250 - RNA, 954 nt, Artificial Sequence
  derived and/or modified sequence opt3 from MAGE-A4__Homo_sapiens__AAY27261
augagcuccgagcagaagucucaacacugcaaacccgaagagggcguggaagcccaggaggaagcucuggggcucgucggagcacaggccccuaccacagaggagcaggaagcggcuguuucaaguagcuccccacuugugccggguacucuggaggaaguacccgccgcagagucugccggcccuccacaaucgccccagggggcuucagcauugccuacgaccaucagcuucacauguuggagacagccaaacgagggaaguuccucucaggaagaggaaggccccagcacuuccccugacgccgagucauuauuuagggaagcucugaguaauaagguggaugagcuagcccauuuccuccugcggaaauaccgcgcgaaggagcuugucaccaaagcagaaaugcuggagcgagugauuaagaacuauaagcguugcuuuccaguuauauucgguaaagccagcgaaucuuugaagaugaucuuugggauugacgugaaagaggucgauccgacauccaauaccuacacucucgugacaugucugggacugucauaugacggccucuuaggcaacaaucaaaucuuccccaagaccgggcugcuuauuaucguauugggaacgauagcuauggaaggugauagcgccagugaggaggaaaucugggaggaacugggcguuauggggguguacgacggaagagagcacacugucuauggcgaaccuaggaaacuacucacccaggauugggugcaggagaacuaccuggaguaucgccaggugccagguucuaaucccgcacgguacgaauuucuuugggggccuagagcucuggccgagacauccuacgucaagguuuuggaacaugugguaagggugaacgcgcggguccgcauugccuauccaagccuccgagaggcagcucuguuagaggaagaggaaggaguguga

SEQ ID NO: 2251 - RNA, 954 nt, Artificial Sequence
  derived and/or modified sequence opt4 from MAGE-A4__Homo_sapiens__AAY27261
augagcagcgagcagaagagccagcacugcaagcccgaggagggcguggaggcccaggaggaggcccugggccuggugggcgcccaggcccccaccaccgaggagcaggaggccgccgugagcagcagcagcccccuggugcccggcacccuggaggaggugcccgccgccgagagcgccggccccccccagagcccccagggcgccagcgcccugcccaccaccaucagcuucaccugcuggagacagcccaacgagggcagcagcagccaggaggaggagggccccagcaccagccccgacgccgagagccuguucagagaggcccugagcaacaagguggacgagcuggcccacuuccugcugagaaaguacagagccaaggagcuggugaccaaggccgagaugcuggagagagugaucaagaacuacaagagaugcuuccccgugaucuucggcaaggccagcgagagccugaagaugaucuucggcaucgacgugaaggagguggaccccaccagcaacaccuacacccuggugaccugccugggccugagcuacgacggccugcugggcaacaaccagaucuuccccaagaccggccugcugaucaucgugcugggcaccaucgccauggagggcgacagcgccagcgaggaggagaucugggaggagcugggcgugaugggcguguacgacggcagagagcacaccguguacggcgagcccagaaagcugcugacccaggacugggugcaggagaacuaccuggaguacagacaggugcccggcagcaaccccgccagauacgaguuccuguggggccccagagcccuggccgagaccagcuacgugaaggugcuggagcacguggugagagugaacgccagagugagaaucgccuaccccagccugagagaggccgcccugcuggaggaggaggagggcguguga

SEQ ID NO: 2252 - RNA, 954 nt, Artificial Sequence
  derived and/or modified sequence opt5 from MAGE-A4__Homo_sapiens__AAY27261
augagcuccgagcagaagucucaacacugcaaacccgaagagggcguggaagcccaggaggaagcucuggggcucgucggagcccaggcgccuaccacagaggagcaggaagcugccguuagcuccucuagcccgcuggugcccggcacgcuugaggaagugccugccgcugaguccgccgggcccccucaaucuccccagggagcuagcgcccugccuaccacaaucuccuucaccuguuggagacagccgaacgagggcucuagcucccaggaagaggaagggcccagcacaucuccugacgcggagucccucuuucgggaagcccugagcaauaaggucgaugagcuugcucauuuccugcuccgcaaauacagagccaaggagcuggugaccaaagcugaaaugcuggagcggguuauuaagaacuauaagcgcugcuuucccgugaucuucggaaaagccucugaaucccucaagaugauuuuuggcaucgacgucaaagagguggauccuacaagcaauaccuacacgcugguuaccugucuuggccuguccuaugacgggcuccugggaaacaaucaaauuuuccccaagacaggccuucugaucaucgugcucgggaccauugcgauggaaggagauucugccagcgaggaggaaaucugggaggaacugggcgucauggggguguacgacggaagagagcacacaguguauggcgaaccgcggaaacugcucacccaggauuggguccaggagaacuaccuggaguaucgccagguuccuggcuccaaucccgcuagauacgaauuucuuugggggccucgggcccuggcugagacgagcuacgugaaggugcucgaacaugucgugcgcguuaacgccagagugcggauugccuaucccucucugcgcgaggcugcgcuucuggaggaagaggaaggagucuga

SEQ ID NO: 2253 - protein, 314 aa, Artificial Sequence [sequence omitted]

SEQ ID NO: 2254 - RNA, 945 nt, Artificial Sequence
  MAGE-A6__Homo_sapiens__BAF82126
augccucuugagcagaggagucagcacugcaagccugaagaaggccuugaggcccgaggagaggcccugggccuggugggugcgcaggcuccugcuacugaggagcaggaggcugccuccuccucuucuacucuaguugaagucacccugggggaggugccugcugccgagucaccagauccuccccagaguccucagggagccuccagccuccccacuaccaugaacuacccucucuggagccaauccuaugaggacuccagcaaccaagaagaggaggggccaagcaccuucccugaccuggagucugaguuccaagcagcacucaguaggaagcuggccaaguugguucauuuucugcuccucaaguaucgagccagggagccggucacaaaggcagaaaugcuggggagugucgucggaaauuggcaguacuucuuuccugugaucuucagcaaagcuuccgauuccuugcagcuggucuuuggcaucgagcugauggaaguggaccccaucggccacguguacaucuuugccaccugccugggccucuccuacgauggccugcugggugacaaucagaucaugcccaagacaggcuuccugauaaucauccuggccauaaucgcaaaagagggcgacugugccccugaggagaaaaucugggaggagcugaguguguuagagguguuugaggggagggaagacauuaucuucggggaucccaagaagcugcucacccaauauuucgugcaggaaaacuaccuggaguaccggcagguccccggcagugauccugcaugcuaugaguuccugugggguccaagggcccucauugaaaccagcuaugugaaaguccugcaccauaugguaaagaucaguggaggaccucgcauuuccuacccacuccugcaugagugggcuuugagagagggggaagaguga

SEQ ID NO: 2255 - RNA, 945 nt, Artificial Sequence
  derived and/or modified sequence opt1 from MAGE-A6__Homo_sapiens__BAF82126
augccccuggagcagcgcagccagcacugcaagccggaggagggccucgaggcccgcggggaggcccugggccuggugggggcgcaggcccccgccaccgaggagcaggaggccgccuccagcuccagcacccucgucgaggugacgcugggcgaggugcccgcggccgagucccccgacccgccccagagcccccagggggccuccagccugcccaccaccaugaacuacccgcucuggucccagagcuacgaggacuccagcaaccaggaggaggagggccccuccaccuuccccgaccuggagagcgaguuccaggccgcgcugucccggaagcucgccaagcugguccacuuccugcuccugaaguaccgggcccgcgagcccgugacgaaggccgagaugcugggcagcguggucgggaacuggcaguacuucuucccggugaucuucuccaaggccagcgacucccuccagcugguguucggcaucgagcugauggaggucgaccccaucgggcacguguacaucuucgcgaccugccucggccugagcuacgacgggcugcucggcgacaaccagaucaugcccaagaccggcuuccugaucaucauccuggccaucaucgccaaggagggggacugcgcccccgaggagaagaucugggaggagcucagcgugcuggaggucuucgagggccgggaggacaucaucuucggggacccgaagaagcugcucacccaguacuucgugcaggagaacuaccuggaguaccgccaggugcccggcuccgaccccgccugcuacgaguuccuguggggcccccgggcgcucaucgagacgagcuacgucaaggugcugcaccacauggugaagaucuccgggggcccgcgcaucagcuacccccugcuccacgagugggcccugcgggagggggaggaguga

SEQ ID NO: 2256 - RNA, 945 nt, Artificial Sequence
  derived and/or modified sequence opt2 from MAGE-A6__Homo_sapiens__BAF82126
augccccucgagcagcgcucccagcacugcaagcccgaggagggccucgaggcccgcggcgaggcccucggccucgucggcgcccaggcccccgccaccgaggagcaggaggccgccuccuccuccuccacccucgucgaggucacccucggcgagguccccgccgccgagucccccgaccccccccaguccccccagggcgccuccucccuccccaccaccaugaacuacccccucuggucccaguccuacgaggacuccuccaaccaggaggaggagggccccuccaccuuccccgaccucgaguccgaguuccaggccgcccucucccgcaagcucgccaagcucguccacuuccuccuccucaaguaccgcgcccgcgagcccgucaccaaggccgagaugcucggcuccgucgucggcaacuggcaguacuucuuccccgucaucuucuccaaggccuccgacucccuccagcucgucuucggcaucgagcucauggaggucgaccccaucggccacgucuacaucuucgccaccugccucggccucuccuacgacggccuccucggcgacaaccagaucaugcccaagaccggcuuccucaucaucauccucgccaucaucgccaaggagggcgacugcgcccccgaggagaagaucugggaggagcucuccguccucgaggucuucgagggccgcgaggacaucaucuucggcgaccccaagaagcuccucacccaguacuucguccaggagaacuaccucgaguaccgccagguccccggcuccgaccccgccugcuacgaguuccucuggggcccccgcgcccucaucgagaccuccuacgucaagguccuccaccacauggucaagaucuccggcggcccccgcaucuccuacccccuccuccacgagugggcccuccgcgagggcgaggaguga

SEQ ID NO: 2257 - RNA, 945 nt, Artificial Sequence
  derived and/or modified sequence opt3 from MAGE-A6__Homo_sapiens__BAF82126
augccccuggagcagagaagccaacacugcaagccugaagagggccucgaagccaggggagaggcucuugggcuggugggugcacaggccccagcgaccgaagaacaggaggcugccuccucuucaaguacauuggucgaaguuacuuuaggcgaggugccggcagccgaaagccccgacccuccacagaguccccaaggggcuucuucgcugccuacgaccaugaacuacccacuauggucacagagcuaugaggauaguuccaaucaggaggaagagggacccucuacauucccugaccucgaaagcgaguuucaggcagcccugucccggaaacuugcuaagcugguacauuucuugcuccugaaauaccgcgcccgagaaccagugacuaaggcggagaugcugggcucagucguggguaacuggcaauauuucuucccgguuaucuuuaguaaagcaagcgauucucuccaguuaguguucgggauugagcugauggaagucgaccccauaggacacguguacaucuuugccaccugucuuggcuuguccuaugauggccugcuaggggacaaucagauuaugccuaagacaggauuccucaucauuauccuggcuauaaucgccaaggagggugauugcgcaccagaagagaaaauuugggaggagcuuucaguacuggagguuuuugaaggccgugaggacaucauuuucggggaucccaagaaauugcucacccaguacuuugugcaagaaaacuaucuggaguacagacaggucccuggaagcgacccagcuuguuacgaauuuuuauggggccccagggcccugaucgagacuuccuaugugaaggugcuccaucacauggucaaaauaucuggugggccgcggauuuccuacccucuucugcaugagugggcguugcgcgaaggagaggaauga

SEQ ID NO: 2258 - RNA, 945 nt, Artificial Sequence
  derived and/or modified sequence opt4 from MAGE-A6__Homo_sapiens__BAF82126
augccccuggagcagagaagccagcacugcaagcccgaggagggccuggaggccagaggcgaggcccugggccuggugggcgcccaggcccccgccaccgaggagcaggaggccgccagcagcagcagcacccugguggaggugacccugggcgaggugcccgccgccgagagccccgaccccccccagagcccccagggcgccagcagccugcccaccaccaugaacuacccccuguggagccagagcuacgaggacagcagcaaccaggaggaggagggccccagcaccuuccccgaccuggagagcgaguuccaggccgcccugagcagaaagcuggccaagcuggugcacuuccugcugcugaaguacagagccagagagcccgugaccaaggccgagaugcugggcagcguggugggcaacuggcaguacuucuuccccgugaucuucagcaaggccagcgacagccugcagcugguguucggcaucgagcugauggagguggaccccaucggccacguguacaucuucgccaccugccugggccugagcuacgacggccugcugggcgacaaccagaucaugcccaagaccggcuuccugaucaucauccuggccaucaucgccaaggagggcgacugcgcccccgaggagaagaucugggaggagcugagcgugcuggagguguucgagggcagagaggacaucaucuucggcgaccccaagaagcugcugacccaguacuucgugcaggagaacuaccuggaguacagacaggugcccggcagcgaccccgccugcuacgaguuccuguggggccccagagcccugaucgagaccagcuacgugaaggugcugcaccacauggugaagaucagcggcggccccagaaucagcuacccccugcugcacgagugggcccugagagagggcgaggaguga

SEQ ID NO: 2259 - RNA, 945 nt, Artificial Sequence
  derived and/or modified sequence opt5 from MAGE-A6__Homo_sapiens__BAF82126
augccccuggagcagagaagccaacacugcaagccugaagagggccucgaagcccgcggggaggcucugggacuugugggcgcccaggcgccggcuaccgaagaacaggaggccgccuccucuagcuccacacuggucgaaguuacgcucggggaggugcccgcugccgaaucuccugaucccccucagagcccccaaggagcuuccucucugccuaccacaaugaacuacccgcuuuggagccaguccuaugaggacagcucuaaucaggaggaagagggccccuccaccuucccugaccuggaaagcgaguuucaggccgcgcucucucggaaacuggccaagcuggugcauuuccuccugcuuaaauacagagcucgggaacccgucacaaaggccgagaugcugggguccgugguuggaaacuggcaauauuucuucccugugaucuuuagcaaggcuucugauucccuccagcuggucuucggcauugagcuuauggaaguggaccccaucggccacguuuacauuuuugccaccugucuggggcucagcuaugauggacugcugggcgacaaucagaucaugccgaaaacaggguuccucauuaucauccuggcgauuaucgccaaggagggagauugcgcuccugaagagaaaauuugggaggagcuuuccgugcuggaggucuuugaaggccgcgaggacaucauuuucggggaucccaagaaacuccugacccaguacuuugugcaagaaaacuaucuugaguacagacaggugccuggaucugaccccgccuguuacgaauuucuguggggcccccgggcucucaucgagacgagcuaugucaagguucugcaucacauggugaaaauuuccggcgggccucgcaucagcuacccgcugcuccaugagugggcccugagagaaggagaggaauga

SEQ ID NO: 2260 - protein, 314 aa, Artificial Sequence
  MAGE-A6__Homo_sapiens__P43360
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGREDSIFGDPKKLLTQYFVQENYLEYRQVPGSDPACYEFLWGPRALIETSYVKVLHHMVKISGGPRISYPLLHEWALREGEE

SEQ ID NO: 2261 - RNA, 945 nt, Artificial Sequence
  MAGE-A6__Homo_sapiens__AAA19006
augccucuugagcagaggagucagcacugcaagccugaagaaggccuugaggcccgaggagaggcccugggccuggugggugcgcaggcuccugcuacugaggagcaggaggcugccuccuccucuucuacucuaguugaagucacccugggggaggugccugcugccgagucaccagauccuccccagaguccucagggagccuccagccuccccacuaccaugaacuacccucucuggagccaauccuaugaggacuccagcaaccaagaagaggaggggccaagcaccuucccugaccuggagucugaguuccaagcagcacucaguaggaagguggccaaguugguucauuuucugcuccucaaguaucgagccagggagccggucacaaaggcagaaaugcuggggagugucgucggaaauuggcaguacuucuuuccugugaucuucagcaaagcuuccgauuccuugcagcuggucuuuggcaucgagcugauggaaguggaccccaucggccacguguacaucuuugccaccugccugggccucuccuacgauggccugcugggugacaaucagaucaugcccaagacaggcuuccugauaaucauccuggccauaaucgcaaaagagggcgacugugccccugaggagaaaaucugggaggagcugaguguguuagagguguuugaggggagggaagacaguaucuucggggaucccaagaagcugcucacccaauauuucgugcaggaaaacuaccuggaguaccggcagguccccggcagugauccugcaugcuaugaguuccugugggguccaagggcccucauugaaaccagcuaugugaaaguccugcaccauaugguaaagaucaguggaggaccucgcauuuccuacccacuccugcaugagugggcuuugagagagggggaagaguga

SEQ ID NO: 2262 - RNA, 945 nt, Artificial Sequence
  derived and/or modified sequence opt1 from MAGE-A6__Homo_sapiens__AAA19006
augccccuggagcagcgcagccagcacugcaagccggaggagggccucgaggcccgcggggaggcccugggccuggugggggcgcaggcccccgccaccgaggagcaggaggccgccuccagcuccagcacccucgucgaggugacgcugggcgaggugcccgcggccgagucccccgacccgccccagagcccccagggggccuccagccugcccaccaccaugaacuacccgcucuggucccagagcuacgaggacuccagcaaccaggaggaggagggccccuccaccuuccccgaccuggagagcgaguuccaggccgcgcugucccggaaggucgccaagcucgugcacuuccugcugcucaaguaccgggcccgcgagcccgugacgaaggccgagaugcugggcagcgucguggggaacuggcaguacuucuucccggugaucuucuccaaggccagcgacucccugcagcucgucuucggcaucgagcugauggagguggaccccaucgggcacguguacaucuucgcgaccugccugggccucagcuacgacgggcugcugggcgacaaccagaucaugcccaagaccggcuuccucaucaucauccuggccaucaucgccaaggagggggacugcgcccccgaggagaagaucugggaggagcugagcguccucgagguguucgagggccgggaggacuccaucuucggggacccgaagaagcugcugacccaguacuucgugcaggagaacuaccucgaguaccgccagguccccggcagcgaccccgccugcuacgaguuccuguggggcccccgggcgcugaucgagacguccuacgugaaggugcuccaccacauggucaagaucagcgggggcccgcgcaucuccuacccccugcugcacgagugggcccuccgggagggggaggaguga

SEQ ID NO: 2263 - RNA, 945 nt, Artificial Sequence
  derived and/or modified sequence opt2 from MAGE-A6__Homo_sapiens__AAA19006
augccccucgagcagcgcucccagcacugcaagcccgaggagggccucgaggcccgcggcgaggcccucggccucgucggcgcccaggcccccgccaccgaggagcaggaggccgccuccuccuccuccacccucgucgaggucacccucggcgagguccccgccgccgagucccccgaccccccccaguccccccagggcgccuccucccuccccaccaccaugaacuacccccucuggucccaguccuacgaggacuccuccaaccaggaggaggagggccccuccaccuuccccgaccucgaguccgaguuccaggccgcccucucccgcaaggucgccaagcucguccacuuccuccuccucaaguaccgcgcccgcgagcccgucaccaaggccgagaugcucggcuccgucgucggcaacuggcaguacuucuuccccgucaucuucuccaaggccuccgacucccuccagcucgucuucggcaucgagcucauggaggucgaccccaucggccacgucuacaucuucgccaccugccucggccucuccuacgacggccuccucggcgacaaccagaucaugcccaagaccggcuuccucaucaucauccucgccaucaucgccaaggagggcgacugcgcccccgaggagaagaucugggaggagcucuccguccucgaggucuucgagggccgcgaggacuccaucuucggcgaccccaagaagcuccucacccaguacuucguccaggagaacuaccucgaguaccgccagguccccggcuccgaccccgccugcuacgaguuccucuggggcccccgcgcccucaucgagaccuccuacgucaagguccuccaccacauggucaagaucuccggcggcccccgcaucuccuacccccuccuccacgagugggcccuccgcgagggcgaggaguga

SEQ ID NO: 2264 - RNA, 945 nt, Artificial Sequence
  derived and/or modified sequence opt3 from MAGE-A6__Homo_sapiens__AAA19006
augccccuggagcagagaagccaacacugcaagccugaagagggccucgaagccaggggagaggcucuugggcuggugggugcacaggccccagcgaccgaagaacaggaggcugccuccucuucaaguacauuggucgaaguuacuuuaggcgaggugccggcagccgaaagccccgacccuccacagucuccccaaggggcuuccucgcugccuacgaccaugaacuacccacuauggucacagagcuaugaggauaguuccaaucaggaggaagagggacccucuacauucccugaccucgaaagcgaguuucaggcagcccugucccggaaaguagcuaaacuugugcauuuccuguugcucaaguaccgcgcccgagaaccagucacuaaggcggagaugcugggcucagugguugguaacuggcaauauuucuucccggugaucuuuaguaaagcaagcgauucucugcagcucgucuucgggauugaguuaauggaaguggaccccauaggacacguauacaucuuugccaccugucugggccuuuccuaugauggcuugcugggggacaaucagauuaugccuaagacaggauuccuaaucauuauccucgcuauaaucgccaaggagggugauugcgcaccagaagagaaaauuugggaggagcugucaguucuugagguguuugaaggccgugaggacagcaucuucggggaucccaagaaacuguugacccaguacuuuguccaagaaaacuaucucgaguacagacaggugccuggaagugacccagcuuguuacgaauuucuguggggccccagggccuuaauugagacuucuuaugugaagguccugcaucacaugguuaaaaucuccggugggccgcggauaagcuacccucuccuucaugagugggcgcugcgcgaaggagaggaauga

SEQ ID NO: 2265 - RNA, 945 nt, Artificial Sequence
  derived and/or modified sequence opt4 from MAGE-A6__Homo_sapiens__AAA19006
augccccuggagcagagaagccagcacugcaagcccgaggagggccuggaggccagaggcgaggcccugggccuggugggcgcccaggcccccgccaccgaggagcaggaggccgccagcagcagcagcacccugguggaggugacccugggcgaggugcccgccgccgagagccccgaccccccccagagcccccagggcgccagcagccugcccaccaccaugaacuacccccuguggagccagagcuacgaggacagcagcaaccaggaggaggagggccccagcaccuuccccgaccuggagagcgaguuccaggccgcccugagcagaaagguggccaagcuggugcacuuccugcugcugaaguacagagccagagagcccgugaccaaggccgagaugcugggcagcguggugggcaacuggcaguacuucuuccccgugaucuucagcaaggccagcgacagccugcagcugguguucggcaucgagcugauggagguggaccccaucggccacguguacaucuucgccaccugccugggccugagcuacgacggccugcugggcgacaaccagaucaugcccaagaccggcuuccugaucaucauccuggccaucaucgccaaggagggcgacugcgcccccgaggagaagaucugggaggagcugagcgugcuggagguguucgagggcagagaggacagcaucuucggcgaccccaagaagcugcugacccaguacuucgugcaggagaacuaccuggaguacagacaggugcccggcagcgaccccgccugcuacgaguuccuguggggccccagagcccugaucgagaccagcuacgugaaggugcugcaccacauggugaagaucagcggcggccccagaaucagcuacccccugcugcacgagugggcccugagagagggcgaggaguga

SEQ ID NO: 2266 - RNA, 945 nt, Artificial Sequence
  derived and/or modified sequence opt5 from MAGE-A6__Homo_sapiens__AAA19006
augccccuggagcagagaagccaacacugcaagccugaagagggccucgaagcccgcggggaggcucugggacuugugggcgcccaggcgccggcuaccgaagaacaggaggccgccuccucuagcuccacacuggucgaaguuacgcucggggaggugcccgcugccgaaucuccugaucccccucagagcccccaaggagcuuccucucugccuaccacaaugaacuacccgcuuuggagccaguccuaugaggacagcucuaaucaggaggaagagggccccuccaccuucccugaccuggaaagcgaguuucaggccgcgcucucucggaaaguggccaagcugguccauuuccugcuccugaaauacagagcucgggaacccgugacaaaggccgagaugcuuggguccguugugggaaacuggcaauauuucuucccugucaucuuuagcaaggcuucugauucccugcagcucguguucggcauugagcugauggaaguugaccccaucggccacguguacauuuuugccaccugucuugggcugagcuaugauggacuccugggcgacaaucagaucaugccgaaaacaggguuccugauuaucauccucgcgauuaucgccaaggagggagauugcgcuccugaagagaaaauuugggaggagcuguccguccuugagguguuugaaggccgcgaggacucuaucuucggggaucccaagaaacugcucacccaguacuuugugcaagaaaacuaucuggaguacagacaggucccuggaagcgaccccgccuguuacgaauuucuuuggggcccccgggcucugauugagacguccuauguuaaggugcuccaucacauggugaaaaucagcggcgggccucgcauuucuuacccgcugcugcaugagugggcccucagagaaggagaggaauga

SEQ ID NO: 2267 - protein, 314 aa, Artificial Sequence [sequence omitted]

SEQ ID NO: 2268 - RNA, 945 nt, Artificial Sequence
  MAGE-A6__Homo_sapiens__CAG46567
augccacuugagcagaggagucagcacugcaagccugaagaaggccuugaggcccgaggagaggcccugggccuggugggugcgcaggcuccugcuacugaggagcaggaggcugccuccuccucuucuacucuaguugaagucacccugggggaggugccugcugccgagucaccagauccuccccagaguccucagggagccuccagccuccccacuaccaugaacuacccucucuggagccaauccuaugaggacuccagcaaccaagaagaggaggggccaagcaccuucccugaccuggagucugaguuccaagcagcacucaguaggaagguggccaaguugguucauuuucugcuccucaaguaucgagccagggagccggucacaaaggcagaaaugcuggggagugucgucggaaauuggcaguacuucuuuccugugaucuucagcaaagcuuccgauuccuugcagcuggucuuuggcaucgagcugauggaaguggaccccaucggccacguguacaucuuugccaccugccugggccucuccuacgauggccugcugggugacaaucagaucaugcccaagacaggcuuccugauaaucauccuggccauaaucgcaaaagagggcgacugugccccugaggagaaaaucugggaggagcugaguguguuagagguguuugaggggagggaagacaguaucuucggggaucccaagaagcugcucacccaauauuucgugcaggaaaacuaccuggaguaccggcagguccccggcagugauccugcaugcuaugaguuccugugggguccaagggcccucauugaaaccagcuaugugaaaguccugcaccauaugguaaagaucaguggaggaccucgcauuuccuacccacuccugcaugagugggcuuuuagagagggggaagaguga

SEQ ID NO: 2269 - RNA, 945 nt, Artificial Sequence
  derived and/or modified sequence opt1 from MAGE-A6__Homo_sapiens__CAG46567
augccccuggagcagcgcagccagcacugcaagccggaggagggccucgaggcccgcggggaggcccugggccuggugggggcgcaggcccccgccaccgaggagcaggaggccgccuccagcuccagcacccucgucgaggugacgcugggcgaggugcccgcggccgagucccccgacccgccccagagcccccagggggccuccagccugcccaccaccaugaacuacccgcucuggucccagagcuacgaggacuccagcaaccaggaggaggagggccccuccaccuuccccgaccuggagagcgaguuccaggccgcgcugucccggaaggucgccaagcucgugcacuuccugcugcucaaguaccgggcccgcgagcccgugacgaaggccgagaugcugggcagcgucguggggaacuggcaguacuucuucccggugaucuucuccaaggccagcgacucccugcagcucgucuucggcaucgagcugauggagguggaccccaucgggcacguguacaucuucgcgaccugccugggccucagcuacgacgggcugcugggcgacaaccagaucaugcccaagaccggcuuccucaucaucauccuggccaucaucgccaaggagggggacugcgcccccgaggagaagaucugggaggagcugagcguccucgagguguucgagggccgggaggacuccaucuucggggacccgaagaagcugcugacccaguacuucgugcaggagaacuaccucgaguaccgccagguccccggcagcgaccccgccugcuacgaguuccuguggggcccccgggcgcugaucgagacguccuacgugaaggugcuccaccacauggucaagaucagcgggggcccgcgcaucuccuacccccugcugcacgagugggccuuccgggagggggaggaguga

SEQ ID NO: 2270 - RNA, 945 nt, Artificial Sequence
  derived and/or modified sequence opt2 from MAGE-A6__Homo_sapiens__CAG46567
augccccucgagcagcgcucccagcacugcaagcccgaggagggccucgaggcccgcggcgaggcccucggccucgucggcgcccaggcccccgccaccgaggagcaggaggccgccuccuccuccuccacccucgucgaggucacccucggcgagguccccgccgccgagucccccgaccccccccaguccccccagggcgccuccucccuccccaccaccaugaacuacccccucuggucccaguccuacgaggacuccuccaaccaggaggaggagggccccuccaccuuccccgaccucgaguccgaguuccaggccgcccucucccgcaaggucgccaagcucguccacuuccuccuccucaaguaccgcgcccgcgagcccgucaccaaggccgagaugcucggcuccgucgucggcaacuggcaguacuucuuccccgucaucuucuccaaggccuccgacucccuccagcucgucuucggcaucgagcucauggaggucgaccccaucggccacgucuacaucuucgccaccugccucggccucuccuacgacggccuccucggcgacaaccagaucaugcccaagaccggcuuccucaucaucauccucgccaucaucgccaaggagggcgacugcgcccccgaggagaagaucugggaggagcucuccguccucgaggucuucgagggccgcgaggacuccaucuucggcgaccccaagaagcuccucacccaguacuucguccaggagaacuaccucgaguaccgccagguccccggcuccgaccccgccugcuacgaguuccucuggggcccccgcgcccucaucgagaccuccuacgucaagguccuccaccacauggucaagaucuccggcggcccccgcaucuccuacccccuccuccacgagugggccuuccgcgagggcgaggaguga

SEQ ID NO: 2271 - RNA, 945 nt, Artificial Sequence
  derived and/or modified sequence opt3 from MAGE-A6__Homo_sapiens__CAG46567
augccccuggagcagagaagccaacacugcaagccugaagagggccucgaagccaggggagaggcucuugggcuggugggugcacaggccccagcgaccgaagaacaggaggcugccuccucuucaaguacauuggucgaaguuacuuuaggcgaggugccggcagccgaaagccccgacccuccacagucuccccaaggggcuuccucgcugccuacgaccaugaacuacccacuauggucacagagcuaugaggauaguuccaaucaggaggaagagggacccucuacauucccugaccucgaaagcgaguuucaggcagcccugucccggaaaguagcuaaacuugugcauuuccuguugcucaaguaccgcgcccgagaaccagucacuaaggcggagaugcugggcucagugguugguaacuggcaauauuucuucccggugaucuuuaguaaagcaagcgauucucugcagcucgucuucgggauugaguuaauggaaguggaccccauaggacacguauacaucuuugccaccugucugggccuuuccuaugauggcuugcugggggacaaucagauuaugccuaagacaggauuccuaaucauuauccucgcuauaaucgccaaggagggugauugcgcaccagaagagaaaauuugggaggagcugucaguucuugagguguuugaaggccgugaggacagcaucuucggggaucccaagaaacuguugacccaguacuuuguccaagaaaacuaucucgaguacagacaggugccuggaagugacccagcuuguuacgaauuucuguggggccccagggccuuaauugagacuucuuaugugaagguccugcaucacaugguuaaaaucuccggugggccgcggauaagcuacccucuccuucaugagugggcguuucgcgaaggagaggaauga

SEQ ID NO: 2272 - RNA, 945 nt, Artificial Sequence
  derived and/or modified sequence opt4 from MAGE-A6__Homo_sapiens__CAG46567
augccccuggagcagagaagccagcacugcaagcccgaggagggccuggaggccagaggcgaggcccugggccuggugggcgcccaggcccccgccaccgaggagcaggaggccgccagcagcagcagcacccugguggaggugacccugggcgaggugcccgccgccgagagccccgaccccccccagagcccccagggcgccagcagccugcccaccaccaugaacuacccccuguggagccagagcuacgaggacagcagcaaccaggaggaggagggccccagcaccuuccccgaccuggagagcgaguuccaggccgcccugagcagaaagguggccaagcuggugcacuuccugcugcugaaguacagagccagagagcccgugaccaaggccgagaugcugggcagcguggugggcaacuggcaguacuucuuccccgugaucuucagcaaggccagcgacagccugcagcugguguucggcaucgagcugauggagguggaccccaucggccacguguacaucuucgccaccugccugggccugagcuacgacggccugcugggcgacaaccagaucaugcccaagaccggcuuccugaucaucauccuggccaucaucgccaaggagggcgacugcgcccccgaggagaagaucugggaggagcugagcgugcuggagguguucgagggcagagaggacagcaucuucggcgaccccaagaagcugcugacccaguacuucgugcaggagaacuaccuggaguacagacaggugcccggcagcgaccccgccugcuacgaguuccuguggggccccagagcccugaucgagaccagcuacgugaaggugcugcaccacauggugaagaucagcggcggccccagaaucagcuacccccugcugcacgagugggccuucagagagggcgaggaguga

SEQ ID NO: 2273 - RNA, 945 nt, Artificial Sequence
  derived and/or modified sequence opt5 from MAGE-A6__Homo_sapiens__CAG46567
augccccuggagcagagaagccaacacugcaagccugaagagggccucgaagcccgcggggaggcucugggacuugugggcgcccaggcgccggcuaccgaagaacaggaggccgccuccucuagcuccacacuggucgaaguuacgcucggggaggugcccgcugccgaaucuccugaucccccucagagcccccaaggagcuuccucucugccuaccacaaugaacuacccgcuuuggagccaguccuaugaggacagcucuaaucaggaggaagagggccccuccaccuucccugaccuggaaagcgaguuucaggccgcgcucucucggaaaguggccaagcugguccauuuccugcuccugaaauacagagcucgggaacccgugacaaaggccgagaugcuuggguccguugugggaaacuggcaauauuucuucccugucaucuuuagcaaggcuucugauucccugcagcucguguucggcauugagcugauggaaguugaccccaucggccacguguacauuuuugccaccugucuugggcugagcuaugauggacuccugggcgacaaucagaucaugccgaaaacaggguuccugauuaucauccucgcgauuaucgccaaggagggagauugcgcuccugaagagaaaauuugggaggagcuguccguccuugagguguuugaaggccgcgaggacucuaucuucggggaucccaagaaacugcucacccaguacuuugugcaagaaaacuaucuggaguacagacaggucccuggaagcgaccccgccuguuacgaauuucuuuggggcccccgggcucugauugagacguccuauguuaaggugcuccaucacauggugaaaaucagcggcgggccucgcauuucuuacccgcugcugcaugagugggccuuuagagaaggagaggaauga

SEQ ID NO: 2274 - protein, 315 aa, Artificial Sequence
  MAGE-A9__Homo_sapiens__P43362
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 2275 - RNA, 948 nt, Artificial Sequence
  MAGE-A9__Homo_sapiens__AAA68877
augucucucgagcagaggaguccgcacugcaagccugaugaagaccuugaagcccaaggagaggacuugggccugaugggugcacaggaacccacaggcgaggaggaggagacuaccuccuccucugacagcaaggaggaggaggugucugcugcugggucaucaaguccuccccagaguccucagggaggcgcuuccuccuccauuuccgucuacuacacuuuauggagccaauucgaugagggcuccagcagucaagaagaggaagagccaagcuccucggucgacccagcucagcuggaguucauguuccaagaagcacugaaauugaagguggcugaguugguucauuuccugcuccacaaauaucgagucaaggagccggucacaaaggcagaaaugcuggagagcgucaucaaaaauuacaagcgcuacuuuccugugaucuucggcaaagccuccgaguucaugcaggugaucuuuggcacugaugugaaggagguggaccccgccggccacuccuacauccuugucacugcucuuggccucucgugcgauagcaugcugggugauggucauagcaugcccaaggccgcccuccugaucauuguccugggugugauccuaaccaaagacaacugcgccccugaagagguuaucugggaagcguugagugugauggggguguauguugggaaggagcacauguucuacggggagcccaggaagcugcucacccaagauugggugcaggaaaacuaccuggaguaccggcaggugcccggcagugauccugcgcacuacgaguuccugugggguuccaaggcccacgcugaaaccagcuaugagaaggucauaaauuauuuggucaugcucaaugcaagagagcccaucugcuacccaucccuuuaugaagagguuuugggagaggagcaagagggagucuga

SEQ ID NO: 2276 - RNA, 948 nt, Artificial Sequence
  derived and/or modified sequence opt1 from MAGE-A9__Homo_sapiens__AAA68877
augagccuggagcagcgcagcccccacugcaagccggacgaggaccucgaggcccagggcgaggaccuggggcugaugggcgcccaggagcccaccggggaggaggaggagaccacguccuccagcgacuccaaggaggaggaggugagcgcggccggcuccagcuccccgccccagagcccccagggcggggccuccagcuccaucagcgucuacuacacccucuggucccaguucgacgagggcagcuccagccaggaggaggaggagcccuccagcagcguggaccccgcccagcuggaguucauguuccaggaggcccugaagcucaagguggcggagcugguccacuuccugcuccacaaguaccgggugaaggagcccgugaccaaggccgagaugcuggaguccgucaucaagaacuacaagcgcuacuucccggugaucuucgggaaggccagcgaguucaugcaggucaucuucggcaccgacgugaaggagguggaccccgccgggcacuccuacauccuggugacggcgcucggccugagcugcgacuccaugcugggggacggccacagcaugcccaaggccgcccuccugaucaucguccugggcgugauccucaccaaggacaacugcgcccccgaggaggugaucugggaggcccuguccgucauggggguguacgugggcaaggagcacauguucuacggggagccgcggaagcugcucacccaggacuggguccaggagaacuaccuggaguaccgccaggugcccggcagcgaccccgcgcacuacgaguuccuguggggcuccaaggcccacgccgagaccagcuacgagaaggugaucaacuaccucgucaugcugaacgcccgggagcccaucugcuacccgucccuguacgaggaggugcucggggaggagcaggagggcguguga

SEQ ID NO: 2277 - RNA, 948 nt, Artificial Sequence
  derived and/or modified sequence opt2 from MAGE-A9__Homo_sapiens__AAA68877
augucccucgagcagcgcuccccccacugcaagcccgacgaggaccucgaggcccagggcgaggaccucggccucaugggcgcccaggagcccaccggcgaggaggaggagaccaccuccuccuccgacuccaaggaggaggaggucuccgccgccggcuccuccucccccccccaguccccccagggcggcgccuccuccuccaucuccgucuacuacacccucuggucccaguucgacgagggcuccuccucccaggaggaggaggagcccuccuccuccgucgaccccgcccagcucgaguucauguuccaggaggcccucaagcucaaggucgccgagcucguccacuuccuccuccacaaguaccgcgucaaggagcccgucaccaaggccgagaugcucgaguccgucaucaagaacuacaagcgcuacuuccccgucaucuucggcaaggccuccgaguucaugcaggucaucuucggcaccgacgucaaggaggucgaccccgccggccacuccuacauccucgucaccgcccucggccucuccugcgacuccaugcucggcgacggccacuccaugcccaaggccgcccuccucaucaucguccucggcgucauccucaccaaggacaacugcgcccccgaggaggucaucugggaggcccucuccgucaugggcgucuacgucggcaaggagcacauguucuacggcgagccccgcaagcuccucacccaggacuggguccaggagaacuaccucgaguaccgccagguccccggcuccgaccccgcccacuacgaguuccucuggggcuccaaggcccacgccgagaccuccuacgagaaggucaucaacuaccucgucaugcucaacgcccgcgagcccaucugcuaccccucccucuacgaggagguccucggcgaggagcaggagggcgucuga

SEQ ID NO: 2278 - RNA, 948 nt, Artificial Sequence
  derived and/or modified sequence opt3 from MAGE-A9__Homo_sapiens__AAA68877
augagccuggagcagagaucuccccacugcaagccugacgaagaucucgaggcccaaggcgaagaccuugggcugaugggagcucaggagccaaccggugaagaggaggaaacaacuuccucaagugauagcaaagaggaagagguguccgcagccgggucuucgucaccgccccagagcccucagggcggagcgaguuccucuaucagcgucuacuauacguuguggucccaauucgacgagggcucaaguagccaggaagaggaggaaccaucuuccucaguugaucccgcucaguuagaauuuauguuccaggaggcccugaagcuaaaaguggcagagcucguacauuuucugcuucacaaguacagggugaaagaaccugucaccaaggccgagaugcuggaaagcgugauuaagaacuauaaacgguacuucccaguuauauuugguaaggcuagugaguucaugcaagugaucuuugggacagacgucaaagaaguggaucccgcaggacauucuuauauuuugguaacugcccucggccuguccugugacagcaugcugggcgaugggcacucgaugccuaaggcugcccucuuaaucauuguucugggagugauccuuaccaaagacaauugcgcgccagaggaggucauaugggaagcauugucugugauggguguguacgucggcaaggagcauauguucuauggggaaccgcgcaagcugcuaacacaggauuggguucaggagaacuaccucgaauaccgacaggugcccggauccgacccugcccacuaugaguuucuguggggcucaaaagcucacgccgagaccaguuacgaaaagguaaucaauuaucuugugaugcugaacgcacgugagccaauuuguuaccccagcuuguaugaagagguccucggugaggaacaagaggggguguga

SEQ ID NO: 2279 - RNA, 948 nt, Artificial Sequence
  derived and/or modified sequence opt4 from MAGE-A9__Homo_sapiens__AAA68877
augagccuggagcagagaagcccccacugcaagcccgacgaggaccuggaggcccagggcgaggaccugggccugaugggcgcccaggagcccaccggcgaggaggaggagaccaccagcagcagcgacagcaaggaggaggaggugagcgccgccggcagcagcagccccccccagagcccccagggcggcgccagcagcagcaucagcguguacuacacccuguggagccaguucgacgagggcagcagcagccaggaggaggaggagcccagcagcagcguggaccccgcccagcuggaguucauguuccaggaggcccugaagcugaagguggccgagcuggugcacuuccugcugcacaaguacagagugaaggagcccgugaccaaggccgagaugcuggagagcgugaucaagaacuacaagagauacuuccccgugaucuucggcaaggccagcgaguucaugcaggugaucuucggcaccgacgugaaggagguggaccccgccggccacagcuacauccuggugaccgcccugggccugagcugcgacagcaugcugggcgacggccacagcaugcccaaggccgcccugcugaucaucgugcugggcgugauccugaccaaggacaacugcgcccccgaggaggugaucugggaggcccugagcgugaugggcguguacgugggcaaggagcacauguucuacggcgagcccagaaagcugcugacccaggacugggugcaggagaacuaccuggaguacagacaggugcccggcagcgaccccgcccacuacgaguuccuguggggcagcaaggcccacgccgagaccagcuacgagaaggugaucaacuaccuggugaugcugaacgccagagagcccaucugcuaccccagccuguacgaggaggugcugggcgaggagcaggagggcguguga

SEQ ID NO: 2280 - RNA, 948 nt, Artificial Sequence
  derived and/or modified sequence opt5 from MAGE-A9__Homo_sapiens__AAA68877
augagccuggagcagagaagcccccacugcaagccugacgaagaucucgaggcccaaggcgaagaccuggggcuuaugggagcucaggagccgaccggcgaagaggaggaaacaacgucuagcuccgauucuaaagaggaagaggugagcgccgcgggguccucuagcccuccccagucuccccagggaggcgcuuccuccuccaucagcgucuacuauacccuguggucucaauucgacgagggguccagcucucaggaagaggaggaaccuuccagcuccguugaucccgcccagcucgaauuuauguuccaggaggcccugaaacuuaagguggcugagcuggugcauuuucuccugcacaaguaccgggucaaagaaccugugacaaaggccgagaugcuggaaucuguuauuaagaacuauaaacgcuacuucccggugaucuuuggaaaggcuagcgaguucaugcaagucauuuuuggcaccgacgugaaagaaguugaucccgccggccauuccuauauccucgugacagcgcuggggcuuagcugugacucuaugcugggagauggccacuccaugccuaaggccgcucuccugauuaucguccuuggggugauccugaccaaagacaauugcgcccccgaggaggugauuugggaagcucucagcgucaugggaguuuacgugggcaaggagcauauguucuauggggaaccuagaaagcugcugacacaggauugggugcaggagaacuaccucgaauaccggcagguccccggaucugacccggcccacuaugaguuucuguggggcagcaaagcgcacgccgagaccuccuacgaaaaggugaucaauuaucuuguuaugcugaacgcucgcgagccuauuuguuaccccucucucuaugaagaggugcugggcgaggaacaagagggggucuga

SEQ ID NO: 2281 - protein, 347 aa, Artificial Sequence
  MAGE-B10__Homo_sapiens__Q96LZ2
MPRGQKSKLRAREKRRQARGGLEDLIDALDILEEEEESPPSASACLKDVFQSSLDGASNNPHGLREAQSTSTSATAASHTRHPEGVNDQMEERPICTQDLEATDSFPRGPVDEKVIILVHYLLYKYQMKEPITKADMLRNVTQMSKSQFPVILSRASEHLELIFGLDLKEVEPNKHIYVLVNKLDLGCDAKLSDETGVPKTGLLMTVLGIIFTNGNCVAEEEVWKVFNTMGLYDGIEHFMFGEPRKLLTKDLVKENYLEYQQVPNSDPPRYQFLWGPRAHAETSKMKVLEFLAKVNDTAPSEFSNWYTEALQDEEERARARVAAKARVSATAGARSKVKSSKSSQLQ

SEQ ID NO: 2282 - RNA, 1044 nt, Artificial Sequence
  MAGE-B10__Homo_sapiens__AAI01309
augccucgaggucagaagaguaaacuccgugccagggaaaaacgccgucaggcccgaggagggcuggaagauuugauagaugcucuggacauuuuagaagaggaggaagaaucuccccccucugccucugcuuguuugaaggauguuuuccagaguucacuugauggggcauccaacaauccccauggacuucgggaagcccaauccaccagcacaucugcuacagcugcuucacacacaagacaucccgaaggagucaacgaccaaauggaagaaaggccaauaugcacacaagaucuagaagccacugauagcuuucccagaggcccuguagaugagaaaguaauuauauuggugcauuacuugcuguacaaguaccaaaugaaagagcccauuacaaaggcagauaugcugagaaauguaacccaaauguccaagagccaguucccuguaauccugagcagagcuucugagcaccuggagcugaucuuuggucuugaccugaaggaaguggagccuaauaagcacaucuauguccuugucaacaaacuagaucuaggcugugaugcaaagcugagugaugaaacaggcgugcccaagacuggccugcugaugacuguccuggguauuaucuucacaaauggcaauugugucgcugaggaggaagucuggaaaguguuuaacacgaugggguuauaugacggaauugagcacuucauguuuggggagcccaggaagcuccuuaccaaagauuuggugaaagaaaauuaccuggaguaccagcaagugcccaacagugauccuccacgcuaucaauuccuauggggcccaagagcccaugcugaaaccagcaagaugaaaguucuugaguuuuuggccaagguaaaugauacagcucccagugaauucucaaacugguauacagaggcuuuacaagaugaggaagagagagccagagccagaguugcagccaaggcucgcguuagugccacagccggugcacguuccaagguuaaguccagcaaguccucccaacugcaguaa

SEQ ID NO: 2283 - RNA, 1044 nt, Artificial Sequence
  derived and/or modified sequence opt1 from MAGE-B10__Homo_sapiens__AAI01309
augccccgcggccagaaguccaagcugcgggcccgcgagaagcggcgccaggcccgcgggggccucgaggaccugaucgacgcgcuggacauccucgaggaggaggaggagagcccgcccagcgccuccgccugccugaaggacguguuccagagcucccuggacggggccagcaacaacccccacggccuccgggaggcccaguccaccagcaccuccgcgacggccgccagccacacccggcaccccgagggggugaacgaccagauggaggagcgcccgaucugcacccaggaccuggaggccaccgacuccuucccccggggccccguggacgagaaggugaucauccugguccacuaccuccuguacaaguaccagaugaaggagcccaucacgaaggcggacaugcugcgcaacgugacccagaugagcaagucccaguucccggugauccucagccgggccuccgagcaccuggagcugaucuucggccucgaccugaaggaggucgagcccaacaagcacaucuacgugcuggugaacaagcucgaccuggggugcgacgccaagcugagcgacgagaccggcguccccaagaccgggcuccugaugacggugcugggcaucaucuucaccaacgggaacugcguggccgaggaggaggucuggaagguguucaacaccaugggccucuacgacggcaucgagcacuucauguucggggagccccgcaagcugcugaccaaggaccucgugaaggagaacuaccuggaguaccagcaggucccgaacuccgacccgccccgguaccaguuccuguggggcccccgcgcccacgcggagacgagcaagaugaaggugcucgaguuccuggccaaggugaacgacaccgcccccuccgaguucagcaacugguacaccgaggcccugcaggacgaggaggagcgggcccgcgcgcgggucgccgccaaggcccgcgugagcgccaccgcgggggcccgguccaaggucaagagcuccaagagcucccagcuccaguga

SEQ ID NO: 2284 - RNA, 1044 nt, Artificial Sequence
  derived and/or modified sequence opt2 from MAGE-B10__Homo_sapiens__AAI01309
augccccgcggccagaaguccaagcuccgcgcccgcgagaagcgccgccaggcccgcggcggccucgaggaccucaucgacgcccucgacauccucgaggaggaggaggaguccccccccuccgccuccgccugccucaaggacgucuuccaguccucccucgacggcgccuccaacaacccccacggccuccgcgaggcccaguccaccuccaccuccgccaccgccgccucccacacccgccaccccgagggcgucaacgaccagauggaggagcgccccaucugcacccaggaccucgaggccaccgacuccuucccccgcggccccgucgacgagaaggucaucauccucguccacuaccuccucuacaaguaccagaugaaggagcccaucaccaaggccgacaugcuccgcaacgucacccagauguccaagucccaguuccccgucauccucucccgcgccuccgagcaccucgagcucaucuucggccucgaccucaaggaggucgagcccaacaagcacaucuacguccucgucaacaagcucgaccucggcugcgacgccaagcucuccgacgagaccggcguccccaagaccggccuccucaugaccguccucggcaucaucuucaccaacggcaacugcgucgccgaggaggaggucuggaaggucuucaacaccaugggccucuacgacggcaucgagcacuucauguucggcgagccccgcaagcuccucaccaaggaccucgucaaggagaacuaccucgaguaccagcagguccccaacuccgaccccccccgcuaccaguuccucuggggcccccgcgcccacgccgagaccuccaagaugaagguccucgaguuccucgccaaggucaacgacaccgcccccuccgaguucuccaacugguacaccgaggcccuccaggacgaggaggagcgcgcccgcgcccgcgucgccgccaaggcccgcgucuccgccaccgccggcgcccgcuccaaggucaaguccuccaaguccucccagcuccaguga

SEQ ID NO: 2285 - RNA, 1044 nt, Artificial Sequence
  derived and/or modified sequence opt3 from MAGE-B10__Homo_sapiens__AAI01309
augcccagaggccaaaagagcaaacugagggcccgggagaagcgccgacaggcucgugggggacucgaagaccuuaucgaugcacuggacauuuuggaggaagaggaagaguccccuccaucugccucagcgugcuuaaaagauguguuccagaguagccuggacggugcuuccaacaauccgcacggccuaagagaggcccagucuaccucgacaucagcaacugccgcuagccauacgaggcaccccgaaggggucaacgaucagauggaggaacggccuauauguacccaagaccucgaggcaacagauaguuuuccacgcggacccguugacgagaaggugaucauucugguacauuaccuucuguauaaauaccagaugaaggaaccuaucacuaaggccgauauguugagaaaugugacccagauguccaaaucucaguucccagucauucucagcagggcuuccgagcaccuggaacugaucuuuggccucgacuuaaaggagguggaacccaacaaacauauauauguucuggugaauaaacuugauuuggguugcgacgccaagcugucagaugagacaggggucccuaagaccggacuacucaugacugugcugggcaucauuuucacaaacggcaauuguguagcggaggaagagguuuggaagguguuuaacaccauggggcuuuacgacggaaucgaacacuucauguuuggugagccacggaaacuguugacgaaggaccucgucaaagaaaauuaucuggaguaccaacaggugccgaacagugaucccccucgcuaucaguucuuauggggcccacgagcacacgccgagacuagcaagaugaaagugcuggaauuucucgcuaaggucaaugacaccgcccccucugaguucuccaacugguacacagaagcacuucaggaugaggaagagagagcuagggcccggguugcggccaaagcacgugugucagcuacugccggggcucgcagcaagguaaagaguucuaaauccagccaacugcaguga

SEQ ID NO: 2286 - RNA, 1044 nt, Artificial Sequence
  derived and/or modified sequence opt4 from MAGE-B10__Homo_sapiens__AAI01309
augcccagaggccagaagagcaagcugagagccagagagaagagaagacaggccagaggcggccuggaggaccugaucgacgcccuggacauccuggaggaggaggaggagagcccccccagcgccagcgccugccugaaggacguguuccagagcagccuggacggcgccagcaacaacccccacggccugagagaggcccagagcaccagcaccagcgccaccgccgccagccacaccagacaccccgagggcgugaacgaccagauggaggagagacccaucugcacccaggaccuggaggccaccgacagcuuccccagaggccccguggacgagaaggugaucauccuggugcacuaccugcuguacaaguaccagaugaaggagcccaucaccaaggccgacaugcugagaaacgugacccagaugagcaagagccaguuccccgugauccugagcagagccagcgagcaccuggagcugaucuucggccuggaccugaaggagguggagcccaacaagcacaucuacgugcuggugaacaagcuggaccugggcugcgacgccaagcugagcgacgagaccggcgugcccaagaccggccugcugaugaccgugcugggcaucaucuucaccaacggcaacugcguggccgaggaggagguguggaagguguucaacaccaugggccuguacgacggcaucgagcacuucauguucggcgagcccagaaagcugcugaccaaggaccuggugaaggagaacuaccuggaguaccagcaggugcccaacagcgacccccccagauaccaguuccuguggggccccagagcccacgccgagaccagcaagaugaaggugcuggaguuccuggccaaggugaacgacaccgcccccagcgaguucagcaacugguacaccgaggcccugcaggacgaggaggagagagccagagccagaguggccgccaaggccagagugagcgccaccgccggcgccagaagcaaggugaagagcagcaagagcagccagcugcaguga

SEQ ID NO: 2287 - RNA, 1044 nt, Artificial Sequence
  derived and/or modified sequence opt5 from MAGE-B10__Homo_sapiens__AAI01309
augcccagaggccaaaagagcaaacugcgggcccgcgagaagagacggcaggcucgcgggggacucgaagaccugaucgaugcccuugacauucuggaggaagaggaagaguccccuccgucugcgagcgcuugccucaaagauguguuccaguccucucuggacggcgccagcaacaauccccacgggcuuagagaggcccaguccaccucuacaagcgcuacggccgcuucccauacccggcacccugaaggagugaacgaucagauggaggaacgccccaucuguacacaagaccuggaggccaccgauagcuuuccuagaggccccguugacgagaaggugauuauccucgugcauuaccugcuguauaaauaccagaugaaggaaccuauuacaaaggcggauaugcuccggaaugucacccagaugucuaaaucccaguucccggugauccugagccgcgccucugagcaccuugaacugaucuuugggcucgaccugaaggagguugaacccaacaaacauauuuaugugcuugucaauaagcuggaucucggaugcgacgcuaaacuguccgaugagacaggcgugccuaagaccggccugcucaugacgguucuggggaucauuuucaccaacggaaauuguguggccgaggaagaggucuggaagguguuuaacacaaugggccuuuacgacgggaucgaacacuucauguuuggagagcccagaaaacugcucaccaaggaccuggugaaagaaaauuaucuugaguaccaacaggucccuaacagcgaucccccgcgguaucaguuccuguggggcccucgcgcucacgccgagacaucuaagaugaaaguucucgaauuucuggcgaaggugaaugacaccgcccccuccgaguucagcaacugguacacggaagcucugcaggaugaggaagagagagcccgggcucgcguggccgccaaagcuagagucuccgcgacagccggggcucggucuaaggucaagagcuccaaaagcucucaacuccaguga

SEQ ID NO: 2288 - protein, 324 aa, Artificial Sequence
  MAGE-B16__Homo_sapiens__A2A368
MSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERARARI

SEQ ID NO: 2289 - RNA, 975 nt, Artificial Sequence
  MAGE-B16__Homo_sapiens__CCDS43927.1
augucucaggaucaggagaguccacgaugcacacaugaucagcaccuucagaccuucagugagacccagagccuggagguugcacaggucuccaaggcucuggagaagacccuccucuccuccucccauccucuagugccuggcaaacugaaggaagcuccugcugcuaaggcagagaguccucuugagguuccucagaguuucugcuccucuuccauugccgucacaaccaccucaucaagugaaucugaugaggcuuccagcaaucaagaagaggaagauaguccaagcuccucagaggauacaucagaccccaggaaugugcccgcagaugcucucgaccagaaaguggcuuuuuuggugaauuucaugcugcacaagugucagaugaaaaagccaauaacaaaggcagauauguugaagauuaucaucaaagaugaugagagccacuucucugagauccuccugagagcuucugagcaccuagagaugauauuuggccuugaugugguggagguggaccccaccacccauugcuauggccucuucaucaaacugggccucaccuaugaugggaugcugaguggugaaaagggugugcccaagacuggccuccugauaauuguccugggugugaucuucaugaagggcaaccgugccacugaagaggaagucugggaagugcugaauuugacgggaguauauucugggaagaagcacuucaucuuuggagagcccagaaugcucaucaccaaagauuuugugaaggagaaguaccuggaguaccagcagguggccaacagugauccugcacgauaugaauuccuguggggcccaagagccaaagcugaaaccagcaagaugaaaguccuggaguuuguggccaaaguucaugggucuuacccacauucuuucccaucucaguaugcggaagcucugaaagaggaagaagagagagcuagagccagaauuuga

SEQ ID NO: 2290 - RNA, 975 nt, Artificial Sequence
  derived and/or modified sequence opt1 from MAGE-B16__Homo_sapiens__CCDS43927.1
augagccaggaccaggagagcccccgcugcacccacgaccagcaccuccagaccuucuccgagacgcagucccuggagguggcccaggucagcaaggcccuggagaagacccugcucuccagcucccacccgcuggugcccggcaagcugaaggaggcgcccgccgccaaggccgagagcccccucgaggugccgcaguccuucugcagcuccagcaucgccgucaccaccacguccagcuccgagagcgacgaggcguccagcaaccaggaggaggaggacucccccagcagcuccgaggacaccagcgacccccggaacgugcccgccgacgcccuggaccagaagguggccuuccuggucaacuucaugcuccacaagugccagaugaagaagccgaucaccaaggcggacaugcugaagaucaucaucaaggacgacgagucccacuucagcgagauccugcuccgcgccuccgagcaccuggagaugaucuucgggcuggacgugguggaggucgaccccaccacgcacugcuacggccucuucaucaagcuggggcugaccuacgacggcaugcucagcggggagaagggcgugcccaagaccggccugcugaucaucgugcucggggucaucuucaugaagggcaaccgggccaccgaggaggaggugugggaggugcugaaccugacgggggucuacuccggcaagaagcacuucaucuucggggagccccgcaugcucaucaccaaggacuucgugaaggagaaguaccuggaguaccagcaggucgccaacagcgacccggcccgguacgaguuccuguggggcccccgcgcgaaggccgagaccuccaagaugaaggugcucgaguucguggccaaggugcacggcagcuacccccacuccuuccccagccaguacgccgaggcccugaaggaggaggaggagcgggcgcgcgcccggaucuga

SEQ ID NO: 2291 - RNA, 975 nt, Artificial Sequence
  derived and/or modified sequence opt2 from MAGE-B16__Homo_sapiens__CCDS43927.1
augucccaggaccaggaguccccccgcugcacccacgaccagcaccuccagaccuucuccgagacccagucccucgaggucgcccaggucuccaaggcccucgagaagacccuccucuccuccucccacccccucguccccggcaagcucaaggaggcccccgccgccaaggccgaguccccccucgaggucccccaguccuucugcuccuccuccaucgccgucaccaccaccuccuccuccgaguccgacgaggccuccuccaaccaggaggaggaggacucccccuccuccuccgaggacaccuccgacccccgcaacguccccgccgacgcccucgaccagaaggucgccuuccucgucaacuucaugcuccacaagugccagaugaagaagcccaucaccaaggccgacaugcucaagaucaucaucaaggacgacgagucccacuucuccgagauccuccuccgcgccuccgagcaccucgagaugaucuucggccucgacgucgucgaggucgaccccaccacccacugcuacggccucuucaucaagcucggccucaccuacgacggcaugcucuccggcgagaagggcguccccaagaccggccuccucaucaucguccucggcgucaucuucaugaagggcaaccgcgccaccgaggaggaggucugggagguccucaaccucaccggcgucuacuccggcaagaagcacuucaucuucggcgagccccgcaugcucaucaccaaggacuucgucaaggagaaguaccucgaguaccagcaggucgccaacuccgaccccgcccgcuacgaguuccucuggggcccccgcgccaaggccgagaccuccaagaugaagguccucgaguucgucgccaagguccacggcuccuacccccacuccuuccccucccaguacgccgaggcccucaaggaggaggaggagcgcgcccgcgcccgcaucuga

SEQ ID NO: 2292 - RNA, 975 nt, Artificial Sequence
  derived and/or modified sequence opt3 from MAGE-B16__Homo_sapiens__CCDS43927.1
augagccaggaccaagagucccccagaugcacccacgaucagcaucugcagacauucucugaaacucagucacucgagguggcccaagucaguaaggcucuugagaaaacgcuguugagcuccucucacccuuuaguuccaggcaagcugaaagaagcaccggccgcgaaggcugaaucgccccuagaggugccucagucauuuuguagcaguuccaucgccguaaccacaacuucuagcuccgagucagacgaagcaaguagcaaccaggaggaagaggauucuccauccucaagcgaggacaccagugaucccaggaaugugccugccgacgcucucgaucagaaagucgcauuccuggugaacuuuaugcuucauaagugccaaaugaagaaaccaauuacaaaggccgacaugcugaaaauaaucauuaaggaugacgaaucucacuucuccgagaucuugcuccgggcuagcgaacaucuggagaugauuuuugggcuggauguuguggaagucgaccccaccacucacuguuacggacucuucaucaaauuaggucugacauaugauggcaugcuuucgggggagaagggagugccuaagaccggcuugcugauaaucguacuagguguuauuuuuaugaaagggaaucgcgccacggaggaagaggugugggaaguccucaaccugacuggaguguacucuggcaagaaacacuucaucuuuggcgagccacgaaugcuuauuaccaaggacuucgugaaagaaaaguaucuggaguaccagcaggucgcaaauuccgacccggcgcguuaugaguuuuugugggggcccagagccaaagcugaaacaucaaagaugaagguucucgaguucguggccaaaguacauggaaguuacccucacagcuuuccaucccaguaugcagaagcucugaaggaggaagaggagagggcccgggcgcgcaucuga

SEQ ID NO: 2293 - RNA, 975 nt, Artificial Sequence
  derived and/or modified sequence opt4 from MAGE-B16__Homo_sapiens__CCDS43927.1
augagccaggaccaggagagccccagaugcacccacgaccagcaccugcagaccuucagcgagacccagagccuggagguggcccaggugagcaaggcccuggagaagacccugcugagcagcagccacccccuggugcccggcaagcugaaggaggcccccgccgccaaggccgagagcccccuggaggugccccagagcuucugcagcagcagcaucgccgugaccaccaccagcagcagcgagagcgacgaggccagcagcaaccaggaggaggaggacagccccagcagcagcgaggacaccagcgaccccagaaacgugcccgccgacgcccuggaccagaagguggccuuccuggugaacuucaugcugcacaagugccagaugaagaagcccaucaccaaggccgacaugcugaagaucaucaucaaggacgacgagagccacuucagcgagauccugcugagagccagcgagcaccuggagaugaucuucggccuggacgugguggagguggaccccaccacccacugcuacggccuguucaucaagcugggccugaccuacgacggcaugcugagcggcgagaagggcgugcccaagaccggccugcugaucaucgugcugggcgugaucuucaugaagggcaacagagccaccgaggaggaggugugggaggugcugaaccugaccggcguguacagcggcaagaagcacuucaucuucggcgagcccagaaugcugaucaccaaggacuucgugaaggagaaguaccuggaguaccagcagguggccaacagcgaccccgccagauacgaguuccuguggggccccagagccaaggccgagaccagcaagaugaaggugcuggaguucguggccaaggugcacggcagcuacccccacagcuuccccagccaguacgccgaggcccugaaggaggaggaggagagagccagagccagaaucuga

SEQ ID NO: 2294 - RNA, 975 nt, Artificial Sequence
  derived and/or modified sequence opt5 from MAGE-B16__Homo_sapiens__CCDS43927.1
augagccaggaccaggagucccccagaugcacccacgaucagcaucugcagacauucucugaaacgcagagccucgagguggcccaagucuccaaggcucuggagaaaacccuucugucuagcucccacccucucguuccgggcaagcugaaagaagcccccgcggcuaaggccgaaucuccucuugaggugccccagagcuuuuguuccagcucuaucgccgugacaaccacauccagcucugaguccgacgaagcuagcucuaaccaggaggaagaggauuccccuagcuccucugaggacaccagcgauccccggaaugucccugccgacgcucuggaucagaaaguggccuuccucguuaacuuuaugcugcauaagugccaaaugaagaaaccgauuacaaaggcggacaugcugaaaaucauuaucaaggaugacgaaucccacuucagcgagauucuccugcgcgccucugaacaucuugagaugaucuuugggcuggauguggucgaaguggaccccaccacgcacuguuacggacucuucaucaaacugggccuuaccuaugaugggaugcuguccggagagaagggcguuccuaagacagggcuccugauuaucgugcugggagucauuuuuaugaaaggcaauagagcuaccgaggaagaggugugggaagugcucaaccugacaggcgucuacagcgggaagaaacacuucaucuuuggagagccccggaugcuuauuaccaaggacuucguuaaagaaaaguaucuggaguaccaacagguggccaauucugacccugcucgcuaugaguuucucuggggccccagagccaaagcggaaacgagcaagaugaaggugcuggaguucgucgccaaagugcauggguccuacccgcacucuuuuccuagccaguaugcugaagcccuuaaggaggaagaggagcgggcucgcgccagaaucuga

SEQ ID NO: 2295 - protein, 336 aa, Artificial Sequence
  MAGE-B17__Homo_sapiens__A8MXT2
MPRGQASKRRAREKRRQARGEDQCLGGAQATAAEKEKLPSSSSPACQSPPQSFPNAGIPQESQRASYPSSPASAVSLTSSDEGAKGQKGESPNSFHGPSSSESTGRDLLNTKTGELVQFLLNKYIRKEPITREAMLKVINRKYKQHFPEILRRSTENVEVVFGLYLKEMDPSRQSYVLVGKLDFPNQGSLSDGGGFPLSGLLMVLLSTIFMHGNRATEEEMWECLNALGMYKGRKHFIYGEPQELVTKDLVREGYLEYQQVPSSDPPRYEFLWGPRARAETSKMKVLEFVAKLNDTVASTYKSRYEEALREEEEQARARAVARDSARARASRSFQP

SEQ ID NO: 2296 - RNA, 1011 nt, Artificial Sequence
  MAGE-B17__Homo_sapiens__CCDS59524.1
augccucgcggucaggcgaguaagcgccgugcccgugagaaacgccgccaggcucgaggugaagaccaaugucucgggggugcucaagccaccgcagcagagaaggaaaagcugccauccuccuccucuccugcaugccagaguccuccccagagcuuccccaaugcaggcauuccucaggagucccagagagccagcuaccccagcucuccugcuucagcuguuucacucacaaguucugaugaaggugccaagggccaaaagggggaaagucccaacuccuuccauggcccguccuccucugagagcacaggaagagaucuucugaacacgaagacgggcgaauuggugcaguuccuccucaacaaguauauaaggaaagagcccauuacgagggaagccaugcugaagguuaucaacagaaaguacaagcagcacuucccugagauccuccggagaagcacugagaacguagagguggucuuuggccucuaccugaaggaaauggaccccagccgucaguccuaugugcuuguuggcaagcuggacuuucccaaucaaggaagcuugagcgauggcgggggcuuuccccugagcgggcuccugaugguucuccugagcaccaucuucaugcauggcaaccgugccacugaggaagagaugugggaaugccugaaugcauuggggauguauaaggguaggaagcacuucaucuauggggagccccaggagcuugucaccaaagauuuggugcgagagggguaccuggaguaccagcaggugcccagcagcgauccuccacgcuacgaguuccuguggggucccagggcccgugcugaaaccagcaaaaugaaaguccuggaguuuguggccaagcucaaugauaccguugccaguaccuacaagucccgguaugaggaggcucugagagaggaggaagagcaagccagagccagagcgguagccagggauagcgccagggccagggcuagcagguccuuucagcccuag

SEQ ID NO: 2297 - RNA, 1011 nt, Artificial Sequence
  derived and/or modified sequence opt1 from MAGE-B17__Homo_sapiens__CCDS59524.1
augccccgcggccaggccagcaagcggcgcgcccgggagaagcgccggcaggcgcgcggggaggaccagugccugggcggggcccaggccaccgccgccgagaaggagaagcucccguccagcuccagccccgcgugccaguccccgccccagagcuuccccaacgccggcaucccccaggagucccagcgggccagcuaccccuccagccccgccuccgcggugagccugaccuccagcgacgagggggccaagggccagaagggcgaguccccgaacagcuuccacgggcccuccagcuccgagagcacgggccgcgaccugcucaacaccaagaccggggagcugguccaguuccugcucaacaaguacauccggaaggagcccaucacccgcgaggccaugcugaaggugaucaaccggaaguacaagcagcacuuccccgagauccugcgccggagcacggagaacguggaggucguguucggccucuaccugaaggagauggacccgucccgccagagcuacgugcuggucgggaagcucgacuuccccaaccagggcucccugagcgacggcgggggcuucccccuguccgggcuccugauggugcugcucagcaccaucuucaugcacggcaaccgggccaccgaggaggagaugugggagugccugaacgcccugggcauguacaaggggcgcaagcacuucaucuacggcgagccccaggagcucgugaccaaggaccugguccgggagggguaccuggaguaccagcaggucccguccagcgacccgccccgcuacgaguuccucuggggcccccgggcgcgcgccgagacguccaagaugaaggugcuggaguucguggccaagcugaacgacaccguggccagcaccuacaagucccgguacgaggaggcccuccgcgaggaggaggagcaggcgcgcgcccgggccguggcccgcgacagcgcccgggcgcgcgccucccggagcuuccagcccuga

SEQ ID NO: 2298 - RNA, 1011 nt, Artificial Sequence
  derived and/or modified sequence opt2 from MAGE-B17__Homo_sapiens__CCDS59524.1
augccccgcggccaggccuccaagcgccgcgcccgcgagaagcgccgccaggcccgcggcgaggaccagugccucggcggcgcccaggccaccgccgccgagaaggagaagcuccccuccuccuccucccccgccugccagucccccccccaguccuuccccaacgccggcaucccccaggagucccagcgcgccuccuaccccuccucccccgccuccgccgucucccucaccuccuccgacgagggcgccaagggccagaagggcgagucccccaacuccuuccacggccccuccuccuccgaguccaccggccgcgaccuccucaacaccaagaccggcgagcucguccaguuccuccucaacaaguacauccgcaaggagcccaucacccgcgaggccaugcucaaggucaucaaccgcaaguacaagcagcacuuccccgagauccuccgccgcuccaccgagaacgucgaggucgucuucggccucuaccucaaggagauggaccccucccgccaguccuacguccucgucggcaagcucgacuuccccaaccagggcucccucuccgacggcggcggcuucccccucuccggccuccucaugguccuccucuccaccaucuucaugcacggcaaccgcgccaccgaggaggagaugugggagugccucaacgcccucggcauguacaagggccgcaagcacuucaucuacggcgagccccaggagcucgucaccaaggaccucguccgcgagggcuaccucgaguaccagcagguccccuccuccgaccccccccgcuacgaguuccucuggggcccccgcgcccgcgccgagaccuccaagaugaagguccucgaguucgucgccaagcucaacgacaccgucgccuccaccuacaagucccgcuacgaggaggcccuccgcgaggaggaggagcaggcccgcgcccgcgccgucgcccgcgacuccgcccgcgcccgcgccucccgcuccuuccagcccuga

SEQ ID NO: 2299 - RNA, 1011 nt, Artificial Sequence
  derived and/or modified sequence opt3 from MAGE-B17__Homo_sapiens__CCDS59524.1
augcccagaggccaggccagcaagaggcgggcucgcgagaaacgacgucaagcaagaggggaagaccagugccugggaggugcccaggcgaccgcugccgagaaggaaaaacucccuuccucuucaaguccagcaugucagagcccgccccaauccuucccuaacgccggcaucccacaggagucucagagggcuucguaccccucaagcccugcaagugccgugucccuuacaucuagcgaugaaggggcuaagggacagaaaggcgaguccccaaauucauuucacggucccaguagcucugaguccacugggcgggaccuguugaacacgaagaccggagaauuaguccaauuccugcuaaauaaguauauucgcaaagagccuauaacaagagaagccaugcucaagguuaucaacaggaaauacaagcagcauuuuccagagauucugcggcgcucaacugagaauguggaaguaguguucggccuuuaucugaaagagauggauccgagccgacagaguuacgucuuggugggcaagcucgacuuucccaaccaggggucucuguccgauggagguggcuucccucugagcgggcucuuaaugguucugcuuucgaccaucuuuaugcacggaaauagagcgacagaagaggaaaugugggagugcuugaacgcacugggcauguauaaggguaggaaacauuucauuuacggggagccacaagagcuagugaccaaggaccucguccgggaaggauaucuggaauaccaacaggugcccucuuccgauccuccacguuacgaguuucuuuggggcccccgcgccagagcugaaacuucaaaaaugaagguacuggaguucguugccaaauugaaugacacaguggcaaguaccuauaagagcagguacgaggaagcucuccgggaggaagaggaacaggcccgagcgcgcgccgucgcaagagauuccgcuagggcccgggcuucucgcagcuuucagccguga

SEQ ID NO: 2300 - RNA, 1011 nt, Artificial Sequence
  derived and/or modified sequence opt4 from MAGE-B17__Homo_sapiens__CCDS59524.1
augcccagaggccaggccagcaagagaagagccagagagaagagaagacaggccagaggcgaggaccagugccugggcggcgcccaggccaccgccgccgagaaggagaagcugcccagcagcagcagccccgccugccagagccccccccagagcuuccccaacgccggcaucccccaggagagccagagagccagcuaccccagcagccccgccagcgccgugagccugaccagcagcgacgagggcgccaagggccagaagggcgagagccccaacagcuuccacggccccagcagcagcgagagcaccggcagagaccugcugaacaccaagaccggcgagcuggugcaguuccugcugaacaaguacaucagaaaggagcccaucaccagagaggccaugcugaaggugaucaacagaaaguacaagcagcacuuccccgagauccugagaagaagcaccgagaacguggaggugguguucggccuguaccugaaggagauggaccccagcagacagagcuacgugcuggugggcaagcuggacuuccccaaccagggcagccugagcgacggcggcggcuucccccugagcggccugcugauggugcugcugagcaccaucuucaugcacggcaacagagccaccgaggaggagaugugggagugccugaacgcccugggcauguacaagggcagaaagcacuucaucuacggcgagccccaggagcuggugaccaaggaccuggugagagagggcuaccuggaguaccagcaggugcccagcagcgacccccccagauacgaguuccuguggggccccagagccagagccgagaccagcaagaugaaggugcuggaguucguggccaagcugaacgacaccguggccagcaccuacaagagcagauacgaggaggcccugagagaggaggaggagcaggccagagccagagccguggccagagacagcgccagagccagagccagcagaagcuuccagcccuga

SEQ ID NO: 2301 - RNA, 1011 nt, Artificial Sequence
  derived and/or modified sequence opt5 from MAGE-B17__Homo_sapiens__CCDS59524.1
augcccagaggccaggccagcaagcggcgcgcuagagagaaacggcgccaagccagaggggaagaccagugccugggaggcgcgcaggcuaccgccgccgagaaggaaaaacucccuuccucuagcuccccggcuugucagucucccccucagagcuuccccaacgccgggaucccucaagagucccagcgggcuucuuaccccagcuccccugccagcgcggugucucugacauccagcgaugaaggagccaagggccagaaaggggagucuccgaauagcuuucacggacccuccucuuccgagagcacgggccgcgaccuucugaacaccaagacaggcgaacucguccaauuccugcuuaauaaguauauuagaaaagagccuaucacccgggaagcuaugcugaagguuauuaaccgcaaauacaagcagcauuuucccgagauccucagacgguccacagagaauguggaaguggucuucgggcuguaucugaaagagauggauccuucucgccagagcuacgugcucguuggaaagcuggacuuucccaaccagggcucccuuagcgaugggggaggcuucccgcugucugggcuccugauggugcuucuguccaccauuuuuaugcacggaaauagagccacagaagaggaaaugugggagugccucaacgcucugggcauguauaagggccggaaacauuucaucuacggggagccucaagaacuggucaccaaggaccucgugcgcgagggauaucuggaauaccagcagguucccagcucugauccucccagauacgaguuucuuuggggcccccgggccagagcggaaacgagcaaaaugaaggugcuggaguucgucgccaaacucaaugacaccguggcuuccacauauaagucucgcuacgaggaagcccugcgggaggaagaggaacaagcuagagcccgcgccguggcucgggauagcgcgagagcccgcgcuucccggagcuuucagccuuga

SEQ ID NO: 2302 - protein, 347 aa, Artificial Sequence [sequence omitted]

SEQ ID NO: 2303 - RNA, 1044 nt, Artificial Sequence
  MAGE-_B1__Homo_sapiens__AAC23616
augccucggggucagaagaguaagcuccgugcucgugagaaacgccgcaaggcgcgagaggagacccagggucucaagguucgucacgccacugcagcagagaaagaggagugccccuccuccucuccuguuuuaggggauacucccacaagcuccccugcugcuggcauuccccagaagccucagggagcuccacccaccaccacugcugcugcagcugugucauguaccgaaucugacgaaggugccaaaugccaaggugaggaaaaugcaaguuucucccaggccacaacauccacugagagcucagucaaagauccuguagccugggaggcaggaaugcugaugcacuucauucuacguaaguauaaaaugagagagcccauuaugaaggcagauaugcugaagguuguugaugaaaaguacaaggaucacuucacugagauccucaauggagccucucgccgcuuggagcucgucuuuggccuugauuugaaggaagacaacccuaguagccacaccuacacccucgucaguaagcuaaaccucaccaaugauggaaaccugagcaaugauugggacuuucccaggaaugggcuucugaugccucuccugggugugaucuucuuaaagggcaacucugccaccgaggaagagaucuggaaauucaugaauguguugggagccuaugauggagaggagcacuuaaucuauggggaaccccguaaguucaucacccaagaucuggugcaggaaaaauaucugaaguacgagcaggugcccaacagugaucccccacgcuaucaauuccuaugggguccgagagccuaugcugaaaccaccaagaugaaaguccucgaguuuuuggccaagaugaauggugccacuccccgugacuucccaucccauuaugaagaggcuuugagagaugaggaagagagagcccaaguccgauccaguguuagagccaggcgucgcacuacugccacgacuuuuagagcgcguucuagagccccauucagcagguccucccaccccauguga

SEQ ID NO: 2304 - RNA, 1044 nt, Artificial Sequence
  derived and/or modified sequence opt1 from MAGE-_B1__Homo_sapiens__AAC23616
augccccgcggccagaaguccaagcugcgggcccgcgagaagcggcgcaaggcccgggaggagacccaggggcucaaggugcgccacgcgaccgccgccgagaaggaggagugcccgagcagcucccccguccugggcgacacgcccaccagcucccccgccgccgggaucccgcagaagccccagggcgcgccgcccaccaccacggccgccgccgcggugagcugcaccgaguccgacgagggggccaagugccagggcgaggagaacgccagcuucucccaggccaccaccagcacggaguccagcgugaaggaccccgucgccugggaggcgggcaugcugaugcacuucauccuccggaaguacaagaugcgcgagcccaucaugaaggccgacaugcugaaggugguggacgagaaguacaaggaccacuucaccgagauccugaacggggccucccggcgccucgagcuggucuucggccuggaccucaaggaggacaaccccagcucccacaccuacacccuggugagcaagcugaaccucacgaacgacgggaaccuguccaacgacugggacuucccccggaacggccugcucaugccgcugcugggggugaucuuccucaagggcaacagcgccaccgaggaggagaucuggaaguucaugaacguccugggcgccuacgacggggaggagcaccugaucuacggcgagccccgcaaguucaucacccaggaccucgugcaggagaaguaccugaaguacgagcagguccccaacuccgacccgccccgguaccaguuccugugggggccccgcgcguacgccgagaccacgaagaugaaggugcucgaguuccuggccaagaugaacggcgccacgccccgggacuuccccagccacuacgaggaggcccugcgcgacgaggaggagcgggcccaggugcgcagcuccgugcgggcgcgccggcgcaccaccgccaccaccuuccgcgcccggagccgcgccccguucucccggagcucccaccccauguga

SEQ ID NO: 2305 - RNA, 1044 nt, Artificial Sequence
  derived and/or modified sequence opt2 from MAGE-_B1__Homo_sapiens__AAC23616
augccccgcggccagaaguccaagcuccgcgcccgcgagaagcgccgcaaggcccgcgaggagacccagggccucaagguccgccacgccaccgccgccgagaaggaggagugccccuccuccucccccguccucggcgacacccccaccuccucccccgccgccggcaucccccagaagccccagggcgccccccccaccaccaccgccgccgccgccgucuccugcaccgaguccgacgagggcgccaagugccagggcgaggagaacgccuccuucucccaggccaccaccuccaccgaguccuccgucaaggaccccgucgccugggaggccggcaugcucaugcacuucauccuccgcaaguacaagaugcgcgagcccaucaugaaggccgacaugcucaaggucgucgacgagaaguacaaggaccacuucaccgagauccucaacggcgccucccgccgccucgagcucgucuucggccucgaccucaaggaggacaaccccuccucccacaccuacacccucgucuccaagcucaaccucaccaacgacggcaaccucuccaacgacugggacuucccccgcaacggccuccucaugccccuccucggcgucaucuuccucaagggcaacuccgccaccgaggaggagaucuggaaguucaugaacguccucggcgccuacgacggcgaggagcaccucaucuacggcgagccccgcaaguucaucacccaggaccucguccaggagaaguaccucaaguacgagcagguccccaacuccgaccccccccgcuaccaguuccucuggggcccccgcgccuacgccgagaccaccaagaugaagguccucgaguuccucgccaagaugaacggcgccaccccccgcgacuuccccucccacuacgaggaggcccuccgcgacgaggaggagcgcgcccagguccgcuccuccguccgcgcccgccgccgcaccaccgccaccaccuuccgcgcccgcucccgcgcccccuucucccgcuccucccaccccauguga

SEQ ID NO: 2306 - RNA, 1044 nt, Artificial Sequence
  derived and/or modified sequence opt3 from MAGE-_B1__Homo_sapiens__AAC23616
augcccagaggccaaaagagcaaacugagggcccgggagaagcgccgaaaagcucgugaagagacccaggggcucaaggugagacacgcaacagccgcggaaaaagaggaaugcccuuccucuucaccaguccuuggagacacuccgacgaguagccccgcugccgguaucccucagaagccacagggcgcacccccuaccacaacugccgcugcagccguuuccuguaccgagucugaugagggggcuaagugccagggagaagagaacgccucguucucacaagcgacaaccagcacugaaaguuccgugaaagacccaguagcaugggaggccggcaugcugaugcauuuuauuuugaggaaguacaaaaugcgggagcccauaaugaaggcugauauguuaaaaguggucgacgaaaaguauaaggaucacuucacagagauccugaauggugccucucgcagacuagaacucguguuugggcuggaccuuaaagaggauaacccuagcucccauaccuacacgcugguuucaaaguugaaucucacuaacgacggaaaucugaguaacgauugggacuucccaaggaauggccugcucaugccguuacugggcgugauuuuucuuaaagggaacagcgcaaccgaagaggagaucuggaaguucaugaaugucuugggagcuuaugauggugaggaacaccugauuuacggcgaaccccggaaauuuaucacacaggaccuagugcaggagaaguaucucaaauacgaacagguaccuaacucugauccaccccgcuaucaauuccugugggggccucgagccuacgcggagacuaccaagaugaagguucuugaguuucuggccaaaaugaauggagcaacaccaagagacuuccccucccauuacgaagaggcuuugagggacgaagaggaacgggcccaggugcguucaagcguccgcgcuagaaggcggaccacggccacuacauuucgagcacgcaguagagccccguucucuagguccagccacccuauguga

SEQ ID NO: 2307 - RNA, 1044 nt, Artificial Sequence
  derived and/or modified sequence opt4 from MAGE-_B1__Homo_sapiens__AAC23616
augcccagaggccagaagagcaagcugagagccagagagaagagaagaaaggccagagaggagacccagggccugaaggugagacacgccaccgccgccgagaaggaggagugccccagcagcagccccgugcugggcgacacccccaccagcagccccgccgccggcaucccccagaagccccagggcgccccccccaccaccaccgccgccgccgccgugagcugcaccgagagcgacgagggcgccaagugccagggcgaggagaacgccagcuucagccaggccaccaccagcaccgagagcagcgugaaggaccccguggccugggaggccggcaugcugaugcacuucauccugagaaaguacaagaugagagagcccaucaugaaggccgacaugcugaaggugguggacgagaaguacaaggaccacuucaccgagauccugaacggcgccagcagaagacuggagcugguguucggccuggaccugaaggaggacaaccccagcagccacaccuacacccuggugagcaagcugaaccugaccaacgacggcaaccugagcaacgacugggacuuccccagaaacggccugcugaugccccugcugggcgugaucuuccugaagggcaacagcgccaccgaggaggagaucuggaaguucaugaacgugcugggcgccuacgacggcgaggagcaccugaucuacggcgagcccagaaaguucaucacccaggaccuggugcaggagaaguaccugaaguacgagcaggugcccaacagcgacccccccagauaccaguuccuguggggccccagagccuacgccgagaccaccaagaugaaggugcuggaguuccuggccaagaugaacggcgccacccccagagacuuccccagccacuacgaggaggcccugagagacgaggaggagagagcccaggugagaagcagcgugagagccagaagaagaaccaccgccaccaccuucagagccagaagcagagcccccuucagcagaagcagccaccccauguga

SEQ ID NO: 2308 - RNA, 1044 nt, Artificial Sequence
  derived and/or modified sequence opt5 from MAGE-_B1__Homo_sapiens__AAC23616
augcccagaggccaaaagagcaaacugcgggcccgcgagaagagacggaaagcucgcgaagagacccaggggcucaaggugagacacgccacagcggcugaaaaagaggaaugcccuuccucuagcccgguccugggagacacgcccaccuccucuccugccgccggcaucccccagaagccucagggggcucccccuacaaccacagccgcugccgcgguuagcuguaccgaguccgaugagggagccaagugccagggcgaagagaacgcuucuuucagccaagccacaaccuccacggaaagcucugugaaagacccgguggcuugggaggccgggaugcuuaugcauuuuauucugcggaaguacaaaaugcgcgagcccaucaugaaggcggauaugcucaaagucguggacgaaaaguauaaggaucacuucaccgagauucugaauggagccuccagacggcuugaacugguuuuuggccucgaccugaaagaggauaacccuagcucucauacauacacccugguguccaagcucaaucugacaaacgacggcaaucuuagcaacgauugggacuucccccgcaaugggcugcucaugccucugcuuggagucaucuuucugaaaggcaacucugcuaccgaagaggagauuuggaaguucaugaaugugcucggggccuaugauggagaggaacaccugaucuacggcgaacccagaaaauuuaucacgcaggaccugguucaggagaaguaucucaaauacgaacaggugccgaacuccgauccuccccgguaucaauuccugugggggccucgcgcuuacgccgagacaaccaagaugaagguccuugaguuucuggccaaaaugaauggagcuacacccagagacuuccccagccauuacgaagaggcgcuccgggacgaagaggaacgcgcccaggugagauccucugugcgggcuagacgccggaccaccgccacaacguuuagagcccgcagccgggcuccuuucuccagaagcucucacccgauguga

SEQ ID NO: 2309 - protein, 319 aa, Artificial Sequence
  MAGE-B2__Homo_sapiens__O15479
MPRGQKSKLRAREKRRKARDETRGLNVPQVTEAEEEEAPCCSSSVSGGAASSSPAAGIPQEPQRAPTTAAAAAAGVSSTKSKKGAKSHQGEKNASSSQASTSTKSPSEDPLTRKSGSLVQFLLYKYKIKKSVTKGEMLKIVGKRFREHFPEILKKASEGLSVVFGLELNKVNPNGHTYTFIDKVDLTDEESLLSSWDFPRRKLLMPLLGVIFLNGNSATEEEIWEFLNMLGVYDGEEHSVFGEPWKLITKDLVQEKYLEYKQVPSSDPPRFQFLWGPRAYAETSKMKVLEFLAKVNGTTPCAFPTHYEEALKDEEKAGV

SEQ ID NO: 2310 - RNA, 960 nt, Artificial Sequence
  MAGE-B2__Homo_sapiens__AAD10635
augccucguggucagaagaguaagcuccgugcccgugagaaacgccgcaaggcccgagaugagacccggggucucaauguuccucaggucacugaagcagaggaagaagaggcccccugcuguuccucuucuguuucugggggugcugcuucaagcucuccugcugcuggcauuccccaggagccucagagagccccaaccacugccgcugcugcggcugcggguguuucauccacaaaaucuaaaaaaggugccaagagccaccaaggugagaaaaaugcaaguuccucccaggccucaacauccacuaagagcccaagcgaagauccucuaaccaggaagucagggucguuggugcaguuccuguuguacaaguauaaaauaaaaaaguccguuacaaagggagaaaugcugaaaauuguuggcaaaagguucagggagcacuucccugagauccucaagaaagccucugagggccucaguguugucuuuggccuugagcugaauaaagucaaccccaacggccacacuuacaccuucaucgacaagguagaccucacugaugaggaaucccugcucaguuccugggacuuucccaggagaaagcuucugaugccucuccugggugugaucuucuuaaauggcaacucagcuacugaggaagagaucugggaauuccugaauauguugggagucuaugauggagaggagcacucagucuuuggggaacccuggaagcucaucaccaaagaucuggugcaggaaaaauaucuggaguacaagcaggugcccagcagugaucccccacgcuuucaauuccugugggguccgagagccuaugcugaaaccagcaagaugaaaguccuggaguuuuuggccaagguaaaugguaccacccccugugccuucccaacccauuacgaagaagcuuugaaagaugaagagaaagccggagucuga

SEQ ID NO: 2311 - RNA, 960 nt, Artificial Sequence
  derived and/or modified sequence opt1 from MAGE-B2__Homo_sapiens__AAD10635
augccccgcggccagaaguccaagcugcgggcccgcgagaagcggcgcaaggcccgggacgagacccgcgggcucaacgugccgcaggucaccgaggcggaggaggaggaggcccccugcugcagcagcuccgugagcggcggggccgccuccagcucccccgccgcgggcaucccccaggagccgcagcgggcccccacgaccgccgccgcggccgccgccggggugagcuccaccaagagcaagaagggcgccaagucccaccagggcgagaagaacgcgagcuccagccaggccuccaccagcacgaagucccccagcgaggacccccugacccgcaaguccgggagccugguccaguuccuccuguacaaguacaagaucaagaaguccgugaccaagggcgagaugcugaagaucguggggaagcgguuccgcgagcacuucccggagauccucaagaaggccagcgagggccugagcgucguguucgggcuggagcucaacaaggugaaccccaacggccacaccuacacguucaucgacaaggucgaccugaccgacgaggagucccugcucagcuccugggacuucccccggcgcaagcugcugaugccccuccugggcgugaucuuccugaacgggaacagcgccaccgaggaggagaucugggaguuccucaacaugcugggcguguacgacggggaggagcacuccgucuucggcgagccguggaagcugaucaccaaggaccucgugcaggagaaguaccuggaguacaagcagguccccagcuccgacccgccccgguuccaguuccuguggggcccccgcgccuacgcggagacgagcaagaugaaggugcucgaguuccuggccaaggugaacgggaccacccccugcgccuuccccacccacuacgaggaggcccugaaggacgaggagaaggccggcguguga

SEQ ID NO: 2312 - RNA, 960 nt, Artificial Sequence
  derived and/or modified sequence opt2 from MAGE-B2__Homo_sapiens__AAD10635
augccccgcggccagaaguccaagcuccgcgcccgcgagaagcgccgcaaggcccgcgacgagacccgcggccucaacgucccccaggucaccgaggccgaggaggaggaggcccccugcugcuccuccuccgucuccggcggcgccgccuccuccucccccgccgccggcaucccccaggagccccagcgcgcccccaccaccgccgccgccgccgccgccggcgucuccuccaccaaguccaagaagggcgccaagucccaccagggcgagaagaacgccuccuccucccaggccuccaccuccaccaagucccccuccgaggacccccucacccgcaaguccggcucccucguccaguuccuccucuacaaguacaagaucaagaaguccgucaccaagggcgagaugcucaagaucgucggcaagcgcuuccgcgagcacuuccccgagauccucaagaaggccuccgagggccucuccgucgucuucggccucgagcucaacaaggucaaccccaacggccacaccuacaccuucaucgacaaggucgaccucaccgacgaggagucccuccucuccuccugggacuucccccgccgcaagcuccucaugccccuccucggcgucaucuuccucaacggcaacuccgccaccgaggaggagaucugggaguuccucaacaugcucggcgucuacgacggcgaggagcacuccgucuucggcgagcccuggaagcucaucaccaaggaccucguccaggagaaguaccucgaguacaagcagguccccuccuccgaccccccccgcuuccaguuccucuggggcccccgcgccuacgccgagaccuccaagaugaagguccucgaguuccucgccaaggucaacggcaccacccccugcgccuuccccacccacuacgaggaggcccucaaggacgaggagaaggccggcgucuga

SEQ ID NO: 2313 - RNA, 960 nt, Artificial Sequence
  derived and/or modified sequence opt3 from MAGE-B2__Homo_sapiens__AAD10635
augcccagaggccagaaaagcaaacugagggcccgggagaagcgccgaaaagcucgugacgaaaccagagggcucaacgugccucaagucacagaggcagaagaggaagaggccccaugcuguuccucuucaguuaguggaggugcggcuagcuccucuccggccgcaggcaucccccaggagccucagagggccccaacuacggcugcagccgcugccgcgggggugucgucaaccaagagcaaaaagggagcaaagagucaccagggcgaaaagaaugccuccucuagccaagcuaguacaucaacuaagagucccagcgaggauccucuuacccggaaaucugguucccugguacaguucuuguuauacaaguauaaaauuaagaagucagugacaaaaggggaaaugcugaagauagucggaaaacgcuuuagagagcauuucccagagauccuaaagaaagccagcgaaggccucagugugguuuuuggccuggagcuuaacaaggugaaucccaacgggcacaccuacacuuucauugacaaagucgaucugacagacgaagagucuuugcucuccagcugggauuuuccuaggcggaagcugcugaugccacucuuaggagugaucuuccugaaugguaacucggcaaccgaagaggagauuugggaauuucuuaauauguugggcguauaugacggggaggaacauucuguuuucggagagccguggaagcugaucacgaaagaucuagugcaggaaaaguaccucgaguauaaacagguccccuccucagacccuccacgcuuucaauuccuguggggcccccgagcuuacgccgagacuuccaagaugaaagugcuugaauuucuggcgaaggugaacgguaccacaccuugcgccuucccaacucacuaugaggaagcauugaaggaugaggaaaaagcuggggucuga

SEQ ID NO: 2314 - RNA, 960 nt, Artificial Sequence
  derived and/or modified sequence opt4 from MAGE-B2__Homo_sapiens__AAD10635
augcccagaggccagaagagcaagcugagagccagagagaagagaagaaaggccagagacgagaccagaggccugaacgugccccaggugaccgaggccgaggaggaggaggcccccugcugcagcagcagcgugagcggcggcgccgccagcagcagccccgccgccggcaucccccaggagccccagagagcccccaccaccgccgccgccgccgccgccggcgugagcagcaccaagagcaagaagggcgccaagagccaccagggcgagaagaacgccagcagcagccaggccagcaccagcaccaagagccccagcgaggacccccugaccagaaagagcggcagccuggugcaguuccugcuguacaaguacaagaucaagaagagcgugaccaagggcgagaugcugaagaucgugggcaagagauucagagagcacuuccccgagauccugaagaaggccagcgagggccugagcgugguguucggccuggagcugaacaaggugaaccccaacggccacaccuacaccuucaucgacaagguggaccugaccgacgaggagagccugcugagcagcugggacuuccccagaagaaagcugcugaugccccugcugggcgugaucuuccugaacggcaacagcgccaccgaggaggagaucugggaguuccugaacaugcugggcguguacgacggcgaggagcacagcguguucggcgagcccuggaagcugaucaccaaggaccuggugcaggagaaguaccuggaguacaagcaggugcccagcagcgacccccccagauuccaguuccuguggggccccagagccuacgccgagaccagcaagaugaaggugcuggaguuccuggccaaggugaacggcaccacccccugcgccuuccccacccacuacgaggaggcccugaaggacgaggagaaggccggcguguga

SEQ ID NO: 2315 - RNA, 960 nt, Artificial Sequence
  derived and/or modified sequence opt5 from MAGE-B2__Homo_sapiens__AAD10635
augcccagaggccaaaagagcaaacugcgggcccgcgagaagagacggaaagcucgcgacgaaaccagagggcucaacgugccucaggucacagaggccgaagaggaagaggcgccgugcuguuccucuagcguuuccggaggcgcugccucuagcucccccgccgcugggaucccucaggagccccagcgggccccuacgaccgcugccgcggccgcugccggagugucuagcacaaaguccaaaaagggcgcuaagagccaccagggggaaaagaaugccucuuccagccaagcgucuaccuccacaaagagccccucugaggauccucugacccgcaaauccggaagccuugugcaguuccugcucuacaaguauaaaauuaagaaguccgucacaaaaggcgaaaugcugaagaucgugggcaaaagauuucgggagcauuucccggagauucuuaagaaagccucugaagggcugagcguuguguuuggacucgagcugaacaaggucaaucccaacggccacaccuacacguucaucgacaaaguggaucugaccgacgaagagucccuccugagcucuugggauuuuccucgcagaaaacuucugaugccccuccuggggguuauuuuccuuaauggaaacuccgcuacagaagaggagaucugggaauuucugaauaugcucggcguguaugacggggaggaacauagcgucuucggagagccuuggaagcugaucaccaaagaucuggugcaggaaaaguaccucgaguauaaacaggugcccucuagcgacccgccucgguuucaauuccuguggggcccccgcgccuacgcugagacauccaagaugaaaguccuugaauuucuggccaagguuaacggcaccacgccuugcgccuuccccacacacuaugaggaagcucucaaggaugaggaaaaagcggggguguga

SEQ ID NO: 2316 - protein, 346 aa, Artificial Sequence
  MAGE-B3__Homo_sapiens__O15480
MPRGQKSTLHAREKRQQTRGQTQDHQGAQITATNKKKVSFSSPLILGATIQKKSAGRSRSALKKPQRALSTTTSVDVSYKKSYKGANSKIEKKQSFSQGLSSTVQSRTDPLIMKTNMLVQFLMEMYKMKKPIMKADMLKIVQKSHKNCFPEILKKASFNMEVVFGVDLKKVDSTKDSYVLVSKMDLPNNGTVTRGRGFPKTGLLLNLLGVIFMKGNCATEEKIWEFLNKMRIYDGKKHFIFGEPRKLITQDLVKLKYLEYRQVPNSNPARYEFLWGPRAHAETSKMKVLEFWAKVNKTVPSAFQFWYEEALRDEEERVQAAAMLNDGSSAMGRKCSKAKASSSSHA

SEQ ID NO: 2317 - RNA, 1041 nt, Artificial Sequence
  MAGE-B3__Homo_sapiens__AAD10636
augccucggggucagaagaguacgcuccaugcacgugagaaacgccagcagacccggggucagacccaggaucaccagggugcucagaucacugcaacuaacaagaaaaaaguauccuuuucauccccucuuauuuugggggcuacuauccagaaaaagucugcugguaggucacguagugcucucaagaagccucagagagcacuauccaccacuacaucuguagauguuucuuacaaaaagucauacaagggagccaacagcaaaauugagaaaaagcaaagcuucucucagggucuauccuccacugugcagucucgcacagacccucuaaucaugaagacaaauauguuggugcaguuccugauggaaauguacaagaugaaaaagcccauuaugaaagcagauaugcuaaaaauuguccaaaaaagccauaagaauugcuucccugagauccuuaaaaaagcuucuuucaacauggaggugguauuugguguugauuuaaagaaaguugauucuaccaaggacuccuauguccuugucagcaaaauggaucuccccaacaaugggacagugacucgugggaggggauuucccaagacaggucuccugcugaaucuccugggcgugaucuucaugaagggcaacugugccacugaggagaagaucugggaauuccugaauaagaugagaauauaugaugggaagaaacacuucauauuuggggagcccagaaagcucaucacccaagauuuggugaagcuuaaauaccuggaguaccgacaagugcccaacaguaauccugcacgcuaugaauuccugugggguccaagagcccaugcugaaaccagcaagaugaagguccuggaguuuugggccaaggucaauaaaacuguccccagugcguuccaguucugguaugaagaggcuuugagagaugaggaagaaagaguccaagcugcagcuaugcucaaugauggcaguagugccaugggcagaaaguguuccaaggccaaggcuagcagcucuucccacgccuag

SEQ ID NO: 2318 - RNA, 1041 nt, Artificial Sequence
  derived and/or modified sequence opt1 from MAGE-B3__Homo_sapiens__AAD10636
augccccgcggccagaaguccacccugcacgcccgggagaagcgccagcagacccgggggcagacgcaggaccaccagggcgcccagaucaccgcgaccaacaagaagaaggugagcuucagcuccccgcucauccugggggccaccauccagaagaaguccgccggccgcagccggagcgcccugaagaagccccagcgcgcccucuccacgaccaccagcgucgacguguccuacaagaaguccuacaagggggcgaacagcaagaucgagaagaagcagagcuucucccagggccugagcuccaccgugcagagccggacggacccccugaucaugaagaccaacaugcucguccaguuccugauggagauguacaagaugaagaagcccaucaugaaggccgacaugcugaagaucgugcagaagucccacaagaacugcuucccggagauccucaagaaggccagcuucaacauggagguggucuucggcguggaccugaagaagguggacuccaccaaggacagcuacguccuggugagcaagauggaccuccccaacaacgggaccgugacgcgcggccggggguuccccaagaccggccugcugcucaaccugcugggggucaucuucaugaagggcaacugcgccaccgaggagaagaucugggaguuccucaacaagaugcgcaucuacgacggcaagaagcacuucaucuucggggagccccggaagcugaucacccaggaccuggugaagcucaaguaccuggaguaccgccaggugccgaacuccaaccccgcgcgguacgaguuccuguggggcccccgcgcccacgccgagacgagcaagaugaagguccucgaguucugggccaaggugaacaagaccgugcccuccgccuuccaguucugguacgaggaggcgcugcgggacgaggaggagcgcguccaggccgccgccaugcugaacgacgggagcuccgccaugggccggaagugcagcaaggcgaaggccuccagcuccagccacgccuga

SEQ ID NO: 2319 - RNA, 1041 nt, Artificial Sequence
  derived and/or modified sequence opt2 from MAGE-B3__Homo_sapiens__AAD10636
augccccgcggccagaaguccacccuccacgcccgcgagaagcgccagcagacccgcggccagacccaggaccaccagggcgcccagaucaccgccaccaacaagaagaaggucuccuucuccuccccccucauccucggcgccaccauccagaagaaguccgccggccgcucccgcuccgcccucaagaagccccagcgcgcccucuccaccaccaccuccgucgacgucuccuacaagaaguccuacaagggcgccaacuccaagaucgagaagaagcaguccuucucccagggccucuccuccaccguccagucccgcaccgacccccucaucaugaagaccaacaugcucguccaguuccucauggagauguacaagaugaagaagcccaucaugaaggccgacaugcucaagaucguccagaagucccacaagaacugcuuccccgagauccucaagaaggccuccuucaacauggaggucgucuucggcgucgaccucaagaaggucgacuccaccaaggacuccuacguccucgucuccaagauggaccuccccaacaacggcaccgucacccgcggccgcggcuuccccaagaccggccuccuccucaaccuccucggcgucaucuucaugaagggcaacugcgccaccgaggagaagaucugggaguuccucaacaagaugcgcaucuacgacggcaagaagcacuucaucuucggcgagccccgcaagcucaucacccaggaccucgucaagcucaaguaccucgaguaccgccagguccccaacuccaaccccgcccgcuacgaguuccucuggggcccccgcgcccacgccgagaccuccaagaugaagguccucgaguucugggccaaggucaacaagaccguccccuccgccuuccaguucugguacgaggaggcccuccgcgacgaggaggagcgcguccaggccgccgccaugcucaacgacggcuccuccgccaugggccgcaagugcuccaaggccaaggccuccuccuccucccacgccuga

SEQ ID NO: 2320 - RNA, 1041 nt, Artificial Sequence
  derived and/or modified sequence opt3 from MAGE-B3__Homo_sapiens__AAD10636
augcccagaggccaaaagagcacccugcacgccagggagaaacggcaacagacacgcgggcagacucaggaccaucaaggagcucagaucacggcaaccaacaagaaaaagguguccuucucuucaccucucauucuuggugccacaauacagaaaaagagugcgggccgaagccguuccgcucugaagaaaccacagagagccuugucuacuaccacaucggucgauguuucauacaagaaaagcuauaagggggcaaauaguaaaaucgaaaagaagcaauccuuuucucagggauuaagcuccaccgugcagucaaggacugacccgcugauuaugaaaacaaacaugcuaguacaguuccucauggagauguacaagaugaaaaagcccaucaugaaagccgauaugcugaagauugugcagaaaagucacaagaauugcuuuccugaaauccuuaagaaagcuagcuucaacauggaggucguguuuggcguugaccugaagaaaguggauucuaccaaggacuccuaugucuuggugucaaaaauggaucucccaaauaacgguacgguaacucgggggcgcggauuccccaagaccggccugcugcucaauuuacugggcguuauauuuaugaaggggaacugugcaacagaagagaaaaucugggaguuccuuaauaagaugagaauuuacgacgguaaaaagcauuuuaucuucggagaaccuaggaaauugauuacucaggaucuggugaagcuaaaguaucucgaguaccggcaggucccaaacagcaaucccgcccgcuaugaauuucuguggggcccucgagcucacgccgagaccaguaaaaugaaggugcuugaguucugggcgaaagugaacaagacagucccaucugcauuucaauucugguacgaagaggcccugagagacgaagaggaaaggguucaggcugccgcaauguugaaugauggguccagcgcuaugggacggaaaugcucgaaggccaaggcgucuuccucaagucaugccuga

SEQ ID NO: 2321 - RNA, 1041 nt, Artificial Sequence
  derived and/or modified sequence opt4 from MAGE-B3__Homo_sapiens__AAD10636
augcccagaggccagaagagcacccugcacgccagagagaagagacagcagaccagaggccagacccaggaccaccagggcgcccagaucaccgccaccaacaagaagaaggugagcuucagcagcccccugauccugggcgccaccauccagaagaagagcgccggcagaagcagaagcgcccugaagaagccccagagagcccugagcaccaccaccagcguggacgugagcuacaagaagagcuacaagggcgccaacagcaagaucgagaagaagcagagcuucagccagggccugagcagcaccgugcagagcagaaccgacccccugaucaugaagaccaacaugcuggugcaguuccugauggagauguacaagaugaagaagcccaucaugaaggccgacaugcugaagaucgugcagaagagccacaagaacugcuuccccgagauccugaagaaggccagcuucaacauggaggugguguucggcguggaccugaagaagguggacagcaccaaggacagcuacgugcuggugagcaagauggaccugcccaacaacggcaccgugaccagaggcagaggcuuccccaagaccggccugcugcugaaccugcugggcgugaucuucaugaagggcaacugcgccaccgaggagaagaucugggaguuccugaacaagaugagaaucuacgacggcaagaagcacuucaucuucggcgagcccagaaagcugaucacccaggaccuggugaagcugaaguaccuggaguacagacaggugcccaacagcaaccccgccagauacgaguuccuguggggccccagagcccacgccgagaccagcaagaugaaggugcuggaguucugggccaaggugaacaagaccgugcccagcgccuuccaguucugguacgaggaggcccugagagacgaggaggagagagugcaggccgccgccaugcugaacgacggcagcagcgccaugggcagaaagugcagcaaggccaaggccagcagcagcagccacgccuga

SEQ ID NO: 2322 - RNA, 1041 nt, Artificial Sequence
  derived and/or modified sequence opt5 from MAGE-B3__Homo_sapiens__AAD10636
augcccagaggccaaaagagcacccugcacgcccgggagaaacgccaacagacaagagggcagacgcaggaccaucaaggagcucagaucaccgccacaaacaagaaaaagguguccuucucuagcccucucauucugggcgcgaccauccagaaaaaguccgcugggcggucucgcagcgcccuuaagaaaccgcagagagcccuguccacaaccacaucugucgauguuagcuacaagaaauccuauaagggagcuaauagcaaaauugaaaagaagcaaucuuuuucccagggccucagcucuaccgugcagucccggacggacccccugaucaugaaaaccaacaugcuugugcaguuccugauggagauguacaagaugaaaaagccuauuaugaaagccgauaugcucaagaucguccagaaaagccacaagaauugcuuucccgaaauccugaagaaagccucuuucaacauggaggugguuuuugggguggaccugaagaaagucgauuccacaaaggacagcuaugugcucguuuccaaaauggaucugccuaauaacggaaccgugacacgcggcagaggcuuccccaagaccgggcuucugcucaaucugcuuggagucauuuuuaugaagggcaacugugcuacggaagagaaaaucugggaguuccugaauaagaugcggauuuacgacgggaaaaagcauuuuaucuucggagaaccucgcaaacucauuacacaggaucuggugaagcugaaguaucucgaguacagacaggugccgaacucuaaucccgcgcgguaugaauuucuguggggcccucgcgcccacgcugagaccagcaaaaugaagguccuugaguucugggccaaaguuaacaagacagugcccuccgcuuuucaauucugguacgaagaggcccugagagacgaagaggaacgggugcaggcggccgcuaugcucaaugaugggagcucugccaugggacgcaaaugcuccaaggcuaaggccagcucuagcucccaugccuga

SEQ ID NO: 2323 - protein, 346 aa, Artificial Sequence
  MAGE-B4__Homo_sapiens__O15481
MPRGQKSKLRAREKRQRTRGQTQDLKVGQPTAAEKEESPSSSSSVLRDTASSSLAFGIPQEPQREPPTTSAAAAMSCTGSDKGDESQDEENASSSQASTSTERSLKDSLTRKTKMLVQFLLYKYKMKEPTTKAEMLKIISKKYKEHFPEIFRKVSQRTELVFGLALKEVNPTTHSYILVSMLGPNDGNQSSAWTLPRNGLLMPLLSVIFLNGNCAREEEIWEFLNMLGIYDGKRHLIFGEPRKLITQDLVQEKYLEYQQVPNSDPPRYQFLWGPRAHAETSKMKVLEFLAKVNDTTPNNFPLLYEEALRDEEERAGARPRVAARRGTTAMTSAYSRATSSSSSQPM

SEQ ID NO: 2324 - RNA, 1041 nt, Artificial Sequence
  MAGE-B4__Homo_sapiens__AAC23619
augccucggggucagaagaguaagcuccgugcccgugagaaacgccagcggacccguggucagacccaggaucucaagguuggucagccuacugcagcagagaaagaagagucuccuuccucuuccucaucuguuuugagggauacugccuccagcucccuugcuuuuggcauuccccaggagccucagagagagccacccaccaccucugcugcugcagcuaugucaugcacuggaucugauaaaggcgacgagagccaagaugaggaaaaugcaaguuccucccaggccucaacauccacugagagaucacucaaagauucucuaaccaggaagacgaagauguuagugcaguuccugcuguacaaguauaaaaugaaagagcccacuacaaaggcagaaaugcugaagaucaucagcaaaaaguacaaggagcacuucccugagaucuucaggaaagucucucagcgcacggagcuggucuuuggccuugccuugaaggaggucaaccccaccacucacuccuacauccucgucagcaugcuaggccccaacgauggaaaccagagcagugccuggacccuuccaaggaaugggcuucugaugccucuacugagugugaucuucuuaaauggcaacugugcccgugaagaggaaaucugggaauuccugaauaugcuggggaucuaugauggaaagaggcaccuuaucuuuggggaaccccgaaagcucaucacccaagaucuggugcaggaaaaauaucuggaauaccagcaggugcccaacagugaucccccacgcuaucaauuccugugggguccaagagcucaugcagaaaccagcaagaugaaaguccuggaguuuuuggccaaggugaaugacaccacccccaauaacuucccacuccuuuaugaagaggcuuugagagaugaagaagagagagcuggagcccggcccagaguugcagccaggcguggcacuacagccaugacuagugcguauuccagggccacauccaguagcucuucccaacccauguga

SEQ ID NO: 2325 - RNA, 1041 nt, Artificial Sequence
  derived and/or modified sequence opt1 from MAGE-B4__Homo_sapiens__AAC23619
augccccgcggccagaaguccaagcugcgggcccgcgagaagcggcagcgcacccgggggcagacccaggaccucaaggugggccagccgacggccgcggagaaggaggagagccccagcuccagcuccagcguccugcgcgacaccgccuccagcucccuggccuucgggaucccccaggagccccagcgggagccgcccaccaccagcgccgccgcggccauguccugcacgggcagcgacaagggggacgagucccaggacgaggagaacgccagcuccagccaggccuccaccagcaccgagcgcucccucaaggacagccugacccggaagacgaagaugcuggugcaguuccuccuguacaaguacaagaugaaggagcccaccaccaaggcggagaugcugaagaucaucagcaagaaguacaaggagcacuuccccgagaucuuccgcaaggugucccagcggaccgagcucgucuucggccuggcccugaaggaggugaacccgacgacccacagcuacauccucguguccaugcugggccccaacgacgggaaccagagcuccgccuggacccugccccgcaacggccuccugaugccccugcucagcgucaucuuccugaacgggaacugcgcccgggaggaggagaucugggaguuccugaacaugcucggcaucuacgacgggaagcgccaccugaucuucggcgagccgcggaagcugaucacccaggaccucgugcaggagaaguaccuggaguaccagcagguccccaacuccgacccgccccgcuaccaguuccuguggggcccccgggcccacgcggagacgagcaagaugaaggugcucgaguuccuggccaaggugaacgacaccacccccaacaacuucccccugcucuacgaggaggcccugcgcgacgaggaggagcgggccggggcccgcccccggguggcggcccgccgcggcaccacggccaugaccuccgccuacagccgggccaccuccagcuccagcucccagccgauguga

SEQ ID NO: 2326 - RNA, 1041 nt, Artificial Sequence
  derived and/or modified sequence opt2 from MAGE-B4__Homo_sapiens__AAC23619
augccccgcggccagaaguccaagcuccgcgcccgcgagaagcgccagcgcacccgcggccagacccaggaccucaaggucggccagcccaccgccgccgagaaggaggagucccccuccuccuccuccuccguccuccgcgacaccgccuccuccucccucgccuucggcaucccccaggagccccagcgcgagccccccaccaccuccgccgccgccgccauguccugcaccggcuccgacaagggcgacgagucccaggacgaggagaacgccuccuccucccaggccuccaccuccaccgagcgcucccucaaggacucccucacccgcaagaccaagaugcucguccaguuccuccucuacaaguacaagaugaaggagcccaccaccaaggccgagaugcucaagaucaucuccaagaaguacaaggagcacuuccccgagaucuuccgcaaggucucccagcgcaccgagcucgucuucggccucgcccucaaggaggucaaccccaccacccacuccuacauccucgucuccaugcucggccccaacgacggcaaccaguccuccgccuggacccucccccgcaacggccuccucaugccccuccucuccgucaucuuccucaacggcaacugcgcccgcgaggaggagaucugggaguuccucaacaugcucggcaucuacgacggcaagcgccaccucaucuucggcgagccccgcaagcucaucacccaggaccucguccaggagaaguaccucgaguaccagcagguccccaacuccgaccccccccgcuaccaguuccucuggggcccccgcgcccacgccgagaccuccaagaugaagguccucgaguuccucgccaaggucaacgacaccacccccaacaacuucccccuccucuacgaggaggcccuccgcgacgaggaggagcgcgccggcgcccgcccccgcgucgccgcccgccgcggcaccaccgccaugaccuccgccuacucccgcgccaccuccuccuccuccucccagcccauguga

SEQ ID NO: 2327 - RNA, 1041 nt, Artificial Sequence
  derived and/or modified sequence opt3 from MAGE-B4__Homo_sapiens__AAC23619
augcccagaggccaaaagagcaaacugagggcccgggagaagcgccagcgaacccgugggcagacacaggaccucaaagugggacagccuacugcugcagaaaaggaggaauccccaucuucaaguagcuccguccuuagagauacggccucuucgucacuggcguucgguaucccgcaagagccccagagggaaccuccaaccacaagcgcugccgcagccaugaguugcacuggcuccgacaaaggggaugagucucaggacgaggaaaacgcuagcuccucacaggcaaguaccagcacagagcggucuuugaaggauuccuuaacccgcaagacuaaaaugcugguucaauuucuacucuacaaguauaaaaugaaggaacccacaaccaaagccgagaugcugaagauuauaucaaagaaauacaaggagcacuucccugaaaucuuuagaaaagugagccagaggacggagcuuguauucggacuggcuuugaaggaagugaauccaacuacccauaguuauauucucgucucuaugcugggccccaacgacgguaaucaguccagcgccuggacacugccucggaacgggcucuuaaugccacugcuuucggugaucuuuuugaauggaaacugugcgcgcgaggaagagauuugggaguuccugaauaugcuaggcaucuacgauggcaaacgacaccucauauuuggggaaccgagaaagcugaucacucaggaccuuguucaagagaaauaucuggaauaccaacaggugcccaacucugauccuccaagguaucaguucuuguggggaccccgggcacaugccgagaccuccaagaugaagguccucgaauuucuggcuaaagugaaugacacaaccccuaacaauuucccauuacuguacgaggaggcccuccgugaugaagaggaacgcgcuggugcaagacccaggguagccgcgcggcgaggcacgacugccaugacaucagcauacagucgcgcuaccagcuccucuagcucacagccgauguga

SEQ ID NO: 2328 - RNA, 1041 nt, Artificial Sequence
  derived and/or modified sequence opt4 from MAGE-B4__Homo_sapiens__AAC23619
augcccagaggccagaagagcaagcugagagccagagagaagagacagagaaccagaggccagacccaggaccugaaggugggccagcccaccgccgccgagaaggaggagagccccagcagcagcagcagcgugcugagagacaccgccagcagcagccuggccuucggcaucccccaggagccccagagagagccccccaccaccagcgccgccgccgccaugagcugcaccggcagcgacaagggcgacgagagccaggacgaggagaacgccagcagcagccaggccagcaccagcaccgagagaagccugaaggacagccugaccagaaagaccaagaugcuggugcaguuccugcuguacaaguacaagaugaaggagcccaccaccaaggccgagaugcugaagaucaucagcaagaaguacaaggagcacuuccccgagaucuucagaaaggugagccagagaaccgagcugguguucggccuggcccugaaggaggugaaccccaccacccacagcuacauccuggugagcaugcugggccccaacgacggcaaccagagcagcgccuggacccugcccagaaacggccugcugaugccccugcugagcgugaucuuccugaacggcaacugcgccagagaggaggagaucugggaguuccugaacaugcugggcaucuacgacggcaagagacaccugaucuucggcgagcccagaaagcugaucacccaggaccuggugcaggagaaguaccuggaguaccagcaggugcccaacagcgacccccccagauaccaguuccuguggggccccagagcccacgccgagaccagcaagaugaaggugcuggaguuccuggccaaggugaacgacaccacccccaacaacuucccccugcuguacgaggaggcccugagagacgaggaggagagagccggcgccagacccagaguggccgccagaagaggcaccaccgccaugaccagcgccuacagcagagccaccagcagcagcagcagccagcccauguga

SEQ ID NO: 2329 - RNA, 1041 nt, Artificial Sequence
  derived and/or modified sequence opt5 from MAGE-B4__Homo_sapiens__AAC23619
augcccagaggccagaagucuaaacugcgggcccgcgagaagagacaacggacccgcgggcagacacaggaccucaaagugggacagccuacggcugccgaaaaggaggaauccccgucuagcuccucuagcguccugagagauaccgcguccucuagccuugcuuucggcaucccccaagagccucagcgggaacccccuacaaccuccgccgccgcugccaugagcugcacagggucugacaaaggagaugagucccaggacgaggaaaacgcuagcagcucccaggccagcaccucuacagagcgcucccugaaggauagccucaccagaaagacgaaaaugcugguucaauuucuucuguacaaguauaaaaugaaggaacccaccacaaaagcggagaugcucaagauuaucuccaagaaauacaaggagcacuucccugaaauuuuucggaaagugucucagcgcaccgagcugguguucggccuggcccucaaggaagucaauccgacaacccauagcuauauccugguguccaugcuugggcccaacgacggaaaucagagcucugcuuggacgcugccuagaaacggccuccugaugccccuucuguccguuauuuuucucaauggcaacugugcccgggaggaagagaucugggaguuccugaauaugcuggggaucuacgauggaaaacgccaccucauuuuuggcgaaccuagaaagcugaucacacaggaccuugugcaagagaaauaucuggaauaccagcagguccccaacagcgauccgccucgguaucaauuccucugggggccccgcgcucaugccgagaccucuaagaugaaggugcuggaauuucuugcgaaaguuaaugacacaaccccuaacaauuucccccugcucuacgaggaggcccugagagaugaagaggaacgggcuggagccagaccccgcguggcugcccggagaggcaccacagccaugacgagcgcuuacucccgcgcgaccucuagcuccagcucucagccuauguga

SEQ ID NO: 2330 - protein, 275 aa, Artificial Sequence
  MAGE-B5__Homo_sapiens__Q9BZ81
MTSAGVFNAGSDERANSRDEEYPCSSEVSPSTESSCSNFINIKVGLLEQFLLYKFKMKQRILKEDMLKIVNPRYQNQFAEIHRRASEHIEVVFAVDLKEVNPTCHLYDLVSKLKLPNNGRIHVGKVLPKTGLLMTFLVVIFLKGNCANKEDTWKFLDMMQIYDGKKYYIYGEPRKLITQDFVRLTYLEYHQVPCSYPAHYQFLWGPRAYTETSKMKVLEYLAKVNDIAPGAFSSQYEEALQDEEESPSQRCSRNWHYCSGQDCLRAKFSSFSQPY

SEQ ID NO: 2331 - RNA, 828 nt, Artificial Sequence
  MAGE-B5__Homo_sapiens__CCDS65233.1
augacuucugcagguguuuuuaaugcaggaucugacgaaagggcuaacaguagagaugaggaguacccauguuccucagaggucucacccuccacugagaguucaugcagcaauuucauaaauauuaagguggguuuguuggagcaguuccugcucuacaaguucaaaaugaaacagcguauuuugaaggaagauaugcugaagauugucaacccaagauaccaaaaccaguuugcugagauucacagaagagcuucugagcacauugagguugucuuugcaguugacuugaaggaagucaacccaacuugucacuuauaugaccuugucagcaagcugaaacuccccaacaaugggaggauucauguuggcaaaguguuacccaagacuggucuccucaugacuuuccugguugugaucuuccugaaaggcaacugugccaacaaggaagauaccuggaaauuucuggauaugaugcaaauauaugaugggaagaaguacuacaucuauggagagcccaggaagcucaucacucaggauuucgugaggcuaacguaccuggaguaccaccaggugcccugcaguuauccugcacacuaucaauuccuuugggguccaagagccuauacugaaaccagcaagaugaaaguccuggaauauuuggccaaggucaaugauauugcuccaggugccuucucaucacaauaugaagaggcuuugcaagaugaggaagagagcccaagccagagaugcagccgaaacuggcacuacugcaguggccaagacugucucagggcgaaguucagcagcuucucucaacccuauuga

SEQ ID NO: 2332 - RNA, 828 nt, Artificial Sequence
  derived and/or modified sequence opt1 from MAGE-B5__Homo_sapiens__CCDS65233.1
augaccagcgccggcguguucaacgccggguccgacgagcgcgcgaacagccgggacgaggaguaccccugcuccagcgaggucuccccgagcaccgaguccagcugcuccaacuucaucaacaucaaggugggccugcucgagcaguuccugcuguacaaguucaagaugaagcagcgcauccucaaggaggacaugcugaagaucgugaacccccgguaccagaaccaguucgccgagauccaccgccgggccagcgagcacaucgaggucguguucgccguggaccugaaggaggucaaccccacgugccaccucuacgaccugguguccaagcugaagcuccccaacaacgggcgcauccacgugggcaagguccugccgaagaccgggcugcucaugaccuuccugguggugaucuuccugaagggcaacugcgccaacaaggaggacaccuggaaguuccucgacaugaugcagaucuacgacggcaagaaguacuacaucuacggggagccccggaagcugaucacgcaggacuucguccgccugaccuaccucgaguaccaccaggugcccugcagcuaccccgcgcacuaccaguuccuguggggcccgcgggccuacaccgagaccuccaagaugaaggugcuggaguaccucgccaaggucaacgacaucgcccccggggcguucagcucccaguacgaggaggcccugcaggacgaggaggagagccccucccagcgcugcagccggaacuggcacuacugcuccggccaggacugccugcgcgccaaguucagcagcuucucccagcccuacuga

SEQ ID NO: 2333 - RNA, 828 nt, Artificial Sequence
  derived and/or modified sequence opt2 from MAGE-B5__Homo_sapiens__CCDS65233.1
augaccuccgccggcgucuucaacgccggcuccgacgagcgcgccaacucccgcgacgaggaguaccccugcuccuccgaggucucccccuccaccgaguccuccugcuccaacuucaucaacaucaaggucggccuccucgagcaguuccuccucuacaaguucaagaugaagcagcgcauccucaaggaggacaugcucaagaucgucaacccccgcuaccagaaccaguucgccgagauccaccgccgcgccuccgagcacaucgaggucgucuucgccgucgaccucaaggaggucaaccccaccugccaccucuacgaccucgucuccaagcucaagcuccccaacaacggccgcauccacgucggcaagguccuccccaagaccggccuccucaugaccuuccucgucgucaucuuccucaagggcaacugcgccaacaaggaggacaccuggaaguuccucgacaugaugcagaucuacgacggcaagaaguacuacaucuacggcgagccccgcaagcucaucacccaggacuucguccgccucaccuaccucgaguaccaccagguccccugcuccuaccccgcccacuaccaguuccucuggggcccccgcgccuacaccgagaccuccaagaugaagguccucgaguaccucgccaaggucaacgacaucgcccccggcgccuucuccucccaguacgaggaggcccuccaggacgaggaggagucccccucccagcgcugcucccgcaacuggcacuacugcuccggccaggacugccuccgcgccaaguucuccuccuucucccagcccuacuga

SEQ ID NO: 2334 - RNA, 828 nt, Artificial Sequence
  derived and/or modified sequence opt3 from MAGE-B5__Homo_sapiens__CCDS65233.1
augaccagcgccggcguguucaacgcuggguccgacgagagagcaaauucuagggaugaagaguaccccugcucaagugaagucagcccuuccacagagucuucguguucaaacuuuaucaauauuaagguuggacugcucgaacaguuccuucuguauaaauuuaagaugaaacaacggauauugaaggaggacauguuaaaaaucgugaacccacgcuaccagaaucaguucgccgagauucaccgacgugcgagcgaacauaucgagguaguguuugcugucgaucugaaggaagugaacccgacuugccaccuauaugaccucguuaguaagcugaaacuucccaauaacgguaggauucaugugggcaagguccugccuaaaacgggguugcucaugaccuuccuggugguaaucuuucugaagggaaauugugccaacaaagaggauacauggaaguuccucgacaugaugcagauauacgauggcaagaaauauuacaucuauggugagccaagaaaguuaauuacucaagacuuuguucggcugaccuaccuugaauaccaccaggugcccugcuccuauccugcacauuaccaguucuugugggggccacgcgccuauacagagaccucuaaaaugaagguccuggaauaccuagcuaaagugaaugauaucgcacccggagccuuuagcucccaguaugaggaagcucuccaagacgaggaggaaucaccuagucagagauguagcaggaacuggcacuacugcucuggccaggauugucugcgggccaaguucuccucauuuagccagccauauuga

SEQ ID NO: 2335 - RNA, 828 nt, Artificial Sequence
  derived and/or modified sequence opt4 from MAGE-B5__Homo_sapiens__CCDS65233.1
augaccagcgccggcguguucaacgccggcagcgacgagagagccaacagcagagacgaggaguaccccugcagcagcgaggugagccccagcaccgagagcagcugcagcaacuucaucaacaucaaggugggccugcuggagcaguuccugcuguacaaguucaagaugaagcagagaauccugaaggaggacaugcugaagaucgugaaccccagauaccagaaccaguucgccgagauccacagaagagccagcgagcacaucgaggugguguucgccguggaccugaaggaggugaaccccaccugccaccuguacgaccuggugagcaagcugaagcugcccaacaacggcagaauccacgugggcaaggugcugcccaagaccggccugcugaugaccuuccugguggugaucuuccugaagggcaacugcgccaacaaggaggacaccuggaaguuccuggacaugaugcagaucuacgacggcaagaaguacuacaucuacggcgagcccagaaagcugaucacccaggacuucgugagacugaccuaccuggaguaccaccaggugcccugcagcuaccccgcccacuaccaguuccuguggggccccagagccuacaccgagaccagcaagaugaaggugcuggaguaccuggccaaggugaacgacaucgcccccggcgccuucagcagccaguacgaggaggcccugcaggacgaggaggagagccccagccagagaugcagcagaaacuggcacuacugcagcggccaggacugccugagagccaaguucagcagcuucagccagcccuacuga

SEQ ID NO: 2336 - RNA, 828 nt, Artificial Sequence
  derived and/or modified sequence opt5 from MAGE-B5__Homo_sapiens__CCDS65233.1
augaccagcgccggcguguucaacgcuggguccgacgagagagccaauucucgggaugaagaguaccccugcagcuccgaagucucuccuagcacagaguccucuuguagcaacuuuaucaauauuaagguuggacugcucgaacaguuccugcuuuauaaauuuaagaugaaacaacgcauccugaaggaggacaugcucaaaauugugaacccgagauaccagaaucaguucgcggagauccaccggcgcgcuuccgaacauauugagguggucuuugccguggaucugaaggaaguuaaccccacgugccaccuuuaugaccuggugagcaagcucaaacugccuaauaacggcagaauccaugucgggaaggugcugcccaaaaccggacuccugaugacauuccuuguugugaucuuucugaagggcaauugugccaacaaagaggauaccuggaaguuccucgacaugaugcagauuuacgaugggaagaaauauuacaucuauggagagccucggaagcugauuacacaagacuuuguccgccuuaccuaccuggaauaccaccaggugcccugcucuuauccugcucauuaccaguuccucuggggcccgagagccuauacagagaccuccaaaaugaaggugcuggaauaccuggcuaaagucaaugauaucgcccccggcgcguuuagcucucaguaugaggaagcccuccaagacgaggaggaauccccuagccagcgguguucucgcaacuggcacuacugcuccgggcaggauugucugagagcuaaguucagcuccuuuucucagcccuauuga

SEQ ID NO: 2337 - protein, 407 aa, Artificial Sequence
  MAGE-B6__Homo_sapiens__Q8N7X4
MPRGHKSKLRTCEKRQETNGQPQGLTGPQATAEKQEESHSSSSSSRACLGDCRRSSDASIPQESQGVSPTGSPDAVVSYSKSDVAANGQDEKSPSTSRDASVPQESQGASPTGSPDAGVSGSKYDVAANGQDEKSPSTSHDVSVPQESQGASPTGSPDAGVSGSKYDVAAEGEDEESVSASQKAIIFKRLSKDAVKKKACTLAQFLQKKFEKKESILKADMLKCVRREYKPYFPQILNRTSQHLVVAFGVELKEMDSSGESYTLVSKLGLPSEGILSGDNALPKSGLLMSLLVVIFMNGNCATEEEVWEFLGLLGIYDGILHSIYGDARKIITEDLVQDKYVVYRQVCNSDPPCYEFLWGPRAYAETTKMRVLRVLADSSNTSPGLYPHLYEDALIDEVERALRLRA

SEQ ID NO: 2338 - RNA, 1224 nt, Artificial Sequence
  MAGE-B6__Homo_sapiens__AAH67286
augccucggggucacaagaguaagcuccguaccugugagaaacgccaagagaccaauggucagccacagggucucacggguccccaggccacugcagagaagcaggaagagucccacucuuccucauccucuucucgcgcuugucugggugauugucguaggucuucugaugccuccauuccucaggagucucagggagugucacccacugggucuccugaugcaguuguuucauauucaaaauccgauguggcugccaacggccaagaugagaaaaguccaagcaccucccgugaugccuccguuccucaggagucucagggagcuucacccacuggcucuccugaugcagguguuucaggcucaaaauaugauguggcugccaacggccaagaugagaaaaguccaagcacuucccaugaugucuccguuccucaggagucucagggagcuucacccacuggcucgccugaugcagguguuucaggcucaaaauaugauguggcugccgagggugaagaugaggaaaguguaagcgccucacagaaagccaucauuuuuaagcgcuuaagcaaagaugcuguaaagaagaaggcgugcacguuggcgcaauuccugcagaagaaguuugagaagaaagaguccauuuugaaggcagacaugcugaaguguguccgcagagaguacaagcccuacuucccucagauccucaacagaaccucccaacauuuggugguggccuuuggcguugaauugaaagaaauggauuccagcggcgaguccuacacccuugucagcaagcuaggccuccccagugaaggaauucugaguggugauaaugcgcugccgaagucgggucuccugaugucgcuccugguugugaucuucaugaacggcaacugugccacugaagaggaggucugggaguuccugggucuguuggggauauaugaugggauccugcauucaaucuauggggaugcucggaagaucauuacugaagauuuggugcaagauaaguacgugguuuaccggcaggugugcaacagugauccuccaugcuaugaguuccugugggguccacgagccuaugcugaaaccaccaagaugagaguccugcguguuuuggccgacagcaguaacaccagucccgguuuauacccacaucuguaugaagacgcuuugauagaugagguagagagagcauugagacugagagcuuaa

SEQ ID NO: 2339 - RNA, 1224 nt, Artificial Sequence
  derived and/or modified sequence opt1 from MAGE-B6__Homo_sapiens__AAH67286
augccccgcggccacaagagcaagcugcggaccugcgagaagcgccaggagaccaacgggcagccgcagggccucacggggccccaggccaccgccgagaagcaggaggagucccacagcuccagcuccagcucccgggcgugccugggcgacugccgccggagcuccgacgccagcaucccccaggagucccagggggugagccccaccggcuccccggacgccgucgugagcuacuccaagagcgacguggccgccaacggccaggacgagaagucccccagcaccucccgcgacgcgagcgucccccaggagagccagggggccucccccacgggcagcccggacgccgggguguccggcagcaaguacgacguggccgcgaacgggcaggacgagaagucccccagcaccucccacgacgucagcgugccccaggagucccagggcgccagccccaccggcuccccggacgccggggugagcggcuccaaguacgacgucgccgccgagggggaggacgaggagagcguguccgcgagccagaaggccaucaucuucaagcggcuguccaaggacgccgugaagaagaaggccugcacccucgcccaguuccugcagaagaaguucgagaagaaggagagcauccugaaggcggacaugcucaagugcguccgccgggaguacaagcccuacuucccccagauccugaaccgcacgucccagcaccuggugguggccuucggcgucgagcucaaggagauggacagcagcggcgaguccuacacccuggugagcaagcuggggcuccccuccgagggcauccugagcggggacaacgcccugccgaaguccggccuccugaugagccugcucguggucaucuucaugaacgggaacugcgccaccgaggaggaggugugggaguuccugggccugcucggcaucuacgacgggauccugcacuccaucuacggcgacgcccggaagaucaucaccgaggaccuggugcaggacaaguacgucguguaccgccaggugugcaacagcgacccgcccugcuacgaguuccucugggggccccgggcguacgccgagacgaccaagaugcgcguccugcgggugcuggccgacuccagcaacaccucccccggccucuacccccaccuguacgaggacgcccugaucgacgaggucgagcgcgcccuccggcugcgcgcguga

SEQ ID NO: 2340 - RNA, 1224 nt, Artificial Sequence
  derived and/or modified sequence opt2 from MAGE-B6__Homo_sapiens__AAH67286
augccccgcggccacaaguccaagcuccgcaccugcgagaagcgccaggagaccaacggccagccccagggccucaccggcccccaggccaccgccgagaagcaggaggagucccacuccuccuccuccuccucccgcgccugccucggcgacugccgccgcuccuccgacgccuccaucccccaggagucccagggcgucucccccaccggcucccccgacgccgucgucuccuacuccaaguccgacgucgccgccaacggccaggacgagaagucccccuccaccucccgcgacgccuccgucccccaggagucccagggcgccucccccaccggcucccccgacgccggcgucuccggcuccaaguacgacgucgccgccaacggccaggacgagaagucccccuccaccucccacgacgucuccgucccccaggagucccagggcgccucccccaccggcucccccgacgccggcgucuccggcuccaaguacgacgucgccgccgagggcgaggacgaggaguccgucuccgccucccagaaggccaucaucuucaagcgccucuccaaggacgccgucaagaagaaggccugcacccucgcccaguuccuccagaagaaguucgagaagaaggaguccauccucaaggccgacaugcucaagugcguccgccgcgaguacaagcccuacuucccccagauccucaaccgcaccucccagcaccucgucgucgccuucggcgucgagcucaaggagauggacuccuccggcgaguccuacacccucgucuccaagcucggccuccccuccgagggcauccucuccggcgacaacgcccuccccaaguccggccuccucaugucccuccucgucgucaucuucaugaacggcaacugcgccaccgaggaggaggucugggaguuccucggccuccucggcaucuacgacggcauccuccacuccaucuacggcgacgcccgcaagaucaucaccgaggaccucguccaggacaaguacgucgucuaccgccaggucugcaacuccgacccccccugcuacgaguuccucuggggcccccgcgccuacgccgagaccaccaagaugcgcguccuccgcguccucgccgacuccuccaacaccucccccggccucuacccccaccucuacgaggacgcccucaucgacgaggucgagcgcgcccuccgccuccgcgccuga

SEQ ID NO: 2341 - RNA, 1224 nt, Artificial Sequence
  derived and/or modified sequence opt3 from MAGE-B6__Homo_sapiens__AAH67286
augcccagaggccacaagagcaaacugaggaccugcgagaagcggcaggaaacaaacgggcaaccucagggacucacugguccacaggccacggcugagaaacaggaagagucccauucuucaaguagcuccucucgcgcaugucuuggcgacugccgacguucgucagaugccagcaucccgcaagaaagucagggggugucccccaccggaucuccugacgcggucguuagcuacuccaagucagauguggcugccaauggccaggacgagaaaaguccaagcacaucuagagaugcauccguaccccaggagucacaaggugccagcccuacugggaguccagacgcuggagugucuggcuccaaguaugaugucgcagccaacggccaggacgaaaagagccccucgaccucucacgauguguccguuccucaggagucacagggggcuaguccaacaggaagcccggacgccgguguguccggcucuaaauacgaugucgcggcagaaggggaggacgaggaaagcgugucagccagucaaaaggcuauuauauucaaaaggcuguccaaggaugccgugaaaaagaaggcauguaccuuggcucaguuuuuacagaaaaaguucgagaaaaaggaaagcauccugaaagccgacaugcuaaagugcguucggcgcgaguauaaacccuacuuuccucaaauucucaauagaacuucucagcaucugguggucgcguucggaguggaacuuaaggagauggacucaaguggcgagagcuauacacugguguccaaguugggucucccaucugaagggauccugucgggagauaacgcccugcccaaaagcggccucuuaaugucccugcuugucguuauuuuuaugaauggcaacugugcaaccgaggaagaggugugggaguucuuggggcugcuaggaaucuacgacgguauacuccacucaaucuauggcgaugcuaggaagauuaucacggaagaccugguacaggauaaauacguggucuaccggcagguaugcaauagugacccuccauguuaugaguuucuuugggggccccgcgccuacgcugaaacuaccaagaugcgaguucugagaguguuggccgauucuagcaacacauccccgggacucuauccucaucuguacgaggacgcauuaauugaugaagucgagagggcccugcggcuccgugcuuga

SEQ ID NO: 2342 - RNA, 1224 nt, Artificial Sequence
  derived and/or modified sequence opt4 from MAGE-B6__Homo_sapiens__AAH67286
augcccagaggccacaagagcaagcugagaaccugcgagaagagacaggagaccaacggccagccccagggccugaccggcccccaggccaccgccgagaagcaggaggagagccacagcagcagcagcagcagcagagccugccugggcgacugcagaagaagcagcgacgccagcaucccccaggagagccagggcgugagccccaccggcagccccgacgccguggugagcuacagcaagagcgacguggccgccaacggccaggacgagaagagccccagcaccagcagagacgccagcgugccccaggagagccagggcgccagccccaccggcagccccgacgccggcgugagcggcagcaaguacgacguggccgccaacggccaggacgagaagagccccagcaccagccacgacgugagcgugccccaggagagccagggcgccagccccaccggcagccccgacgccggcgugagcggcagcaaguacgacguggccgccgagggcgaggacgaggagagcgugagcgccagccagaaggccaucaucuucaagagacugagcaaggacgccgugaagaagaaggccugcacccuggcccaguuccugcagaagaaguucgagaagaaggagagcauccugaaggccgacaugcugaagugcgugagaagagaguacaagcccuacuucccccagauccugaacagaaccagccagcaccuggugguggccuucggcguggagcugaaggagauggacagcagcggcgagagcuacacccuggugagcaagcugggccugcccagcgagggcauccugagcggcgacaacgcccugcccaagagcggccugcugaugagccugcugguggugaucuucaugaacggcaacugcgccaccgaggaggaggugugggaguuccugggccugcugggcaucuacgacggcauccugcacagcaucuacggcgacgccagaaagaucaucaccgaggaccuggugcaggacaaguacgugguguacagacaggugugcaacagcgacccccccugcuacgaguuccuguggggccccagagccuacgccgagaccaccaagaugagagugcugagagugcuggccgacagcagcaacaccagccccggccuguacccccaccuguacgaggacgcccugaucgacgagguggagagagcccugagacugagagccuga

SEQ ID NO: 2343 - RNA, 1224 nt, Artificial Sequence
  derived and/or modified sequence opt5 from MAGE-B6__Homo_sapiens__AAH67286
augcccagaggccacaagagcaaacugcggaccugcgagaagcgccaggaaacaaacgggcaaccucagggacucacgggcccgcaggccaccgcugagaaacaggaagagucccauucuagcuccucuagcuccagagccugucugggggacugccggcgcucuagcgaugcguccaucccccaagaaagccagggagugucuccuacaggcucccccgacgcugucguuagcuacucuaaguccgauguggccgccaaugggcaggacgagaaaagcccuucuaccuccagagaugcuagcgugccccaggagucccaaggagccucuccuacaggcagcccggacgcuggcgucuccgggagcaaguaugauguggccgcgaacggacaggacgaaaagucucccuccaccagccacgauguuucugugccucaggagagccagggcgccucccccacagggucuccugacgcuggagucagcggcuccaaauacgauguggccgcugaaggggaggacgaggaaagcguuucugccucccaaaaggcgauuaucuucaaacggcuuagcaaggaugccgugaaaaagaaggcuuguacccuggcccaguuucuccagaaaaaguucgagaaaaaggaaucuauucugaaagcugacaugcuuaagugcguccgcagagaguauaaacccuacuuuccgcaaauccugaaucggacgucccagcaucucgugguggccuucggagucgaacugaaggagauggacagcuccggcgagucuuauacccugguuagcaagcucggccugccuuccgaagggauucuuucuggagauaacgcccugcccaaaagcggccuccugaugucccuucugguggugaucuuuaugaaugggaacugugcuacagaggaagaggucugggaguuccucggacugcugggcaucuacgacgggauucuccacagcaucuauggagaugcgcgcaagauuaucaccgaagaccuggugcaggauaaauacguuguguacagacaggucugcaauucugacccucccuguuaugaguuucuuuggggcccccgggccuacgcugaaacaaccaagaugcgcgugcugagaguucucgccgauuccagcaacacgucuccuggccuguauccgcaucuuuacgaggacgcccugauugaugaaguggagcgggcucuccgccugagagccuga

SEQ ID NO: 2344 - protein, 1142 aa, Artificial Sequence
  MAGE-C1__Homo_sapiens__O60732
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESTQSPFEGFPQSVLQIPVSAASSSTLVSIFQSSPESTQSPFEGFPQSPLQIPVSRSFSSTLLSIFQSSPERTQSTFEGFAQSPLQIPVSPSSSSTLLSLFQSFSERTQSTFEGFAQSSLQIPVSPSFSSTLVSLFQSSPERTQSTFEGFPQSPLQIPVSSSSSSTLLSLFQSSPERTHSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSPQGEDSLSPHYFPQSPPQGEDSMSPLYFPQSPLQGEEFQSSLQSPVSICSSSTPSSLPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 2345 - RNA, 3429 nt, Artificial Sequence
  MAGE-C1__Homo_sapiens__CCDS35417.1
augggggacaaggauaugccuacugcugggaugccgagucuucuccagaguuccucugagaguccucagaguuguccugagggggaggacucccagucuccucuccagauuccccagaguucuccugagagcgacgacacccuguauccucuccagaguccucagagucguucugagggggaggacuccucggauccucuccagagaccuccugaggggaaggacucccagucuccucuccagauuccccagaguucuccugagggcgacgacacccagucuccucuccagaauucucagaguucuccugaggggaaggacucccugucuccucuagagauuucucagagcccuccugagggugaggauguccagucuccucugcagaauccugcgaguuccuucuucuccucugcuuuauugaguauuuuccagaguuccccugagaguacucaaaguccuuuugaggguuuuccccagucuguucuccagauuccugugagcgccgccuccuccuccacuuuagugaguauuuuccagaguuccccugagaguacucaaaguccuuuugaggguuuuccccagucuccacuccagauuccugugagccgcuccuucuccuccacuuuauugaguauuuuccagaguuccccugagagaacucagaguacuuuugaggguuuugcccagucuccucuccagauuccugugagccccuccuccuccuccacuuuacugagucuuuuccagaguuucucugagagaacucagaguacuuuugaggguuuugcccagucuucucuccagauuccugugagccccuccuucuccuccacuuuagugagucuuuuccagaguuccccugagagaacucagaguacuuuugaggguuuuccccagucuccucuccagauuccugugagcuccuccuccuccuccacuuuauugagucuuuuccagaguuccccugagagaacucacaguacuuuugaggguuuuccccagucucuucuccagauuccuaugaccuccuccuucuccucuacuuuauugaguauuuuccagaguucuccugagagugcucaaaguacuuuugaggguuuuccccagucuccucuccagauuccugggagccccuccuucuccuccacuuuacugagucuuuuccagaguuccccugagagaacucacaguacuuuugaggguuuuccccagucuccucuccagauuccuaugaccuccuccuucuccucuacuuuauugaguauuuuacagaguucuccugagagugcucaaagugcuuuugaggguuuuccccagucuccucuccagauuccugugagcuccucuuucuccuacacuuuauugagucuuuuccagaguuccccugagagaacucacaguacuuuugaggguuuuccccagucuccucuccagauuccugugagcuccuccuccuccuccuccacuuuauugagucuuuuccagaguuccccugaguguacucaaaguacuuuugaggguuuuccccagucuccucuccagauuccucagaguccuccugaaggggagaauacccauucuccucuccagauuguuccaagucuuccugagugggaggacucccugucuccucacuacuuuccucagagcccuccucagggggaggacucccuaucuccucacuacuuuccucagagcccuccucagggggaggacucccugucuccucacuacuuuccucagagcccucagggggaggacucccugucuccucacuacuuuccucagagcccuccucagggggaggacuccaugucuccucucuacuuuccucagaguccucuucagggggaggaauuccagucuucucuccagagcccugugagcaucugcuccuccuccacuccauccagucuuccccagaguuucccugagaguucucagaguccuccugaggggccuguccagucuccucuccauaguccucagagcccuccugaggggaugcacucccaaucuccucuccagaguccugagagugcuccugagggggaggauucccugucuccucuccaaauuccucagaguccucuugagggagaggacucccugucuucucuccauuuuccucagaguccuccugagugggaggacucccucucuccucuccacuuuccucaguuuccuccucagggggaggacuuccagucuucucuccagaguccugugaguaucugcuccuccuccacuucuuugagucuuccccagaguuucccugagaguccucagaguccuccugaggggccugcucagucuccucuccagagaccugucagcuccuucuucuccuacacuuuagcgagucuucuccaaaguucccaugagaguccucagaguccuccugaggggccugcccagucuccucuccagaguccugugagcuccuuccccuccuccacuucaucgagucuuucccagaguucuccugugagcuccuuccccuccuccacuucaucgagucuuuccaagaguuccccugagaguccucuccagaguccugugaucuccuucuccuccuccacuucauugagcccauucagugaagaguccagcagcccaguagaugaauauacaaguuccucagacaccuugcuagagagugauuccuugacagacagcgaguccuugauagagagcgagcccuuguucacuuauacacuggaugaaaagguggacgaguuggcgcgguuucuucuccucaaauaucaagugaagcagccuaucacaaaggcagagaugcugacgaaugucaucagcagguacacgggcuacuuuccugugaucuucaggaaagcccgugaguucauagagauacuuuuuggcauuucccugagagaaguggacccugaugacuccuaugucuuuguaaacacauuagaccucaccucugaggggugucugagugaugagcagggcaugucccagaaccgccuccugauucuuauucugaguaucaucuucauaaagggcaccuaugccucugaggaggucaucugggaugugcugaguggaauaggggugcgugcugggagggagcacuuugccuuuggggagcccagggagcuccucacuaaaguuugggugcaggaacauuaccuagaguaccgggaggugcccaacucuucuccuccucguuacgaauuccugugggguccaagagcucauucagaagucauuaagaggaaaguaguagaguuuuuggccaugcuaaagaauaccgucccuauuaccuuuccauccucuuacaaggaugcuuugaaagauguggaagagagagcccaggccauaauugacaccacagaugauucgacugccacagaaagugcaagcuccagugucaugucccccagcuucucuucugaguga

SEQ ID NO: 2346 - RNA, 3429 nt, Artificial Sequence
  derived and/or modified sequence opt1 from MAGE-C1__Homo_sapiens__CCDS35417.1
augggcgacaaggacaugcccaccgccgggaugccgagccugcuccaguccagcuccgagagcccccaguccugccccgagggcgaggacagccagagcccccugcagaucccgcagagcucccccgagagcgacgacacccuguacccccuccagagcccccagucccgcuccgagggggaggacagcuccgacccgcugcagcggccgcccgagggcaaggacagccagagcccccugcagaucccccaguccucccccgagggggacgacacgcagagcccccuccagaacagccaguccagccccgagggcaaggacucccugagcccgcuggagaucucccagagcccgcccgagggcgaggacgugcagagcccccuccagaaccccgccuccuccuucuucagcuccgcgcugcugagcaucuuccaguccagccccgaguccacccagagccccuucgagggguucccccaguccguccuccagaucccggugagcgccgccuccagcagcacccugguguccaucuuccagagcucccccgagagcacccagucccccuucgagggcuucccccagagcccgcugcagauccccgucucccgcagcuucuccagcacgcuccuguccaucuuccagagcucccccgagcggacccagagcaccuucgagggguucgcccaguccccgcugcagauccccgugagccccuccagcagcuccacccuccugagccuguuccaguccuucagcgagcgcacgcaguccaccuucgagggcuucgcccagagcucccuccagauccccgugagcccguccuucagcuccacccuggucagccuguuccaguccagccccgagcggacccaguccacguucgagggguucccccagagcccccuccagaucccgguguccagcuccagcagcuccacccugcugagccucuuccaguccagccccgagcgcacccacuccaccuucgagggcuucccccagagccugcugcagauccccaugacguccagcuucuccagcacccuccuguccaucuuccagagcuccccggagagcgcgcaguccaccuucgagggcuucccccagagcccccugcagauccccggguccccgagcuucuccagcacccuccugagccuguuccaguccagccccgagcggacgcacuccaccuucgagggcuucccccagagcccccuccagaucccgaugaccuccagcuucuccagcacccugcuguccauccuccagagcucccccgagagcgcccaguccgccuucgagggguucccccagagcccccugcagaucccgguguccagcuccuucagcuacacgcugcucucccuguuccagagcagccccgagcgcacccacuccaccuucgagggcuucccccagagcccgcugcagauccccgucuccagcuccagcuccagcuccacccuccugagccuguuccaguccagccccgagugcacgcaguccaccuucgagggcuucccccagagcccgcuccagaucccccaguccccgcccgagggggagaacacccacagcccccugcagaucgugcccucccugcccgagugggaggacagccugagcccccacuacuucccgcaguccccgccccagggcgaggacagccucagcccccacuacuucccccaguccccgccccagggggaggacucccugagcccccacuacuucccccagagcccccagggcgaggacucccugagcccccacuacuucccccaguccccgccccagggggaggacuccaugagcccccucuacuucccccaguccccgcugcagggcgaggaguuccagagcucccugcagagccccguguccaucugcagcuccagcacccccuccagccucccgcagagcuuccccgaguccagccaguccccgcccgagggccccguccagagcccccugcacagcccccaguccccgcccgaggggaugcacucccagagcccccugcagucccccgaguccgcccccgagggcgaggacucccucagcccgcugcagaucccccagagcccccuggagggggaggacucccucuccagccugcacuucccccaguccccgcccgagugggaggacagccugagcccccuccacuucccccaguucccgccccagggcgaggacuuccaguccagccugcagucccccgugagcaucugcuccagcuccacgagccugucccucccccagagcuucccggagagcccccaguccccgcccgaggggcccgcgcagagcccccugcagcggcccguguccuccuucuucagcuacacccuggccucccuccugcagagcucccacgagagcccgcagagcccgcccgagggccccgcccagagcccccugcagucccccgucuccagcuuccccuccagcaccuccagcucccucagccaguccagccccguguccagcuucccguccagcaccuccagcucccugagcaagagcucccccgagagcccccugcagucccccgugaucagcuucuccagcuccacgagccucuccccguucagcgaggaguccagcucccccgucgacgaguacaccagcuccagcgacacccugcuggaguccgacagccucaccgacuccgagagccugaucgagagcgagccccuguucaccuacacgcucgacgagaagguggacgagcuggcccgcuuccugcuccugaaguaccaggugaagcagcccaucaccaaggccgagaugcugaccaacgucaucucccgguacaccggcuacuucccggugaucuuccgcaaggcgcgggaguucaucgagauccucuucgggaucagccugcgcgagguggaccccgacgacuccuacgucuucgugaacacgcuggaccucaccagcgagggcugccuguccgacgagcaggggaugagccagaaccggcugcucauccugauccuguccaucaucuucaucaagggcaccuacgccagcgaggaggucaucugggacgugcucuccgggaucggcgugcgcgccggccgggagcacuucgccuucggggagccccgcgagcugcugaccaaggucugggugcaggagcacuaccucgaguaccgggaggugcccaacagcuccccgccccgcuacgaguuccuguggggcccccgggcccacagcgaggucaucaagcgcaaggugguggaguuccuggcgaugcucaagaacacgguccccaucaccuucccguccagcuacaaggacgcccugaaggacguggaggagcgcgcccaggccaucaucgacaccaccgacgacuccacggccaccgagagcgcguccagcuccgugaugagccccagcuucuccagcgaguga

SEQ ID NO: 2347 - RNA, 3429 nt, Artificial Sequence
  derived and/or modified sequence opt2 from MAGE-C1__Homo_sapiens__CCDS35417.1
augggcgacaaggacaugcccaccgccggcaugcccucccuccuccaguccuccuccgaguccccccaguccugccccgagggcgaggacucccaguccccccuccagaucccccaguccucccccgaguccgacgacacccucuacccccuccaguccccccagucccgcuccgagggcgaggacuccuccgacccccuccagcgcccccccgagggcaaggacucccaguccccccuccagaucccccaguccucccccgagggcgacgacacccaguccccccuccagaacucccaguccucccccgagggcaaggacucccucuccccccucgagaucucccaguccccccccgagggcgaggacguccaguccccccuccagaaccccgccuccuccuucuucuccuccgcccuccucuccaucuuccaguccucccccgaguccacccagucccccuucgagggcuucccccaguccguccuccagauccccgucuccgccgccuccuccuccacccucgucuccaucuuccaguccucccccgaguccacccagucccccuucgagggcuucccccaguccccccuccagauccccgucucccgcuccuucuccuccacccuccucuccaucuuccaguccucccccgagcgcacccaguccaccuucgagggcuucgcccaguccccccuccagauccccgucucccccuccuccuccuccacccuccucucccucuuccaguccuucuccgagcgcacccaguccaccuucgagggcuucgcccaguccucccuccagauccccgucucccccuccuucuccuccacccucgucucccucuuccaguccucccccgagcgcacccaguccaccuucgagggcuucccccaguccccccuccagauccccgucuccuccuccuccuccuccacccuccucucccucuuccaguccucccccgagcgcacccacuccaccuucgagggcuucccccagucccuccuccagauccccaugaccuccuccuucuccuccacccuccucuccaucuuccaguccucccccgaguccgcccaguccaccuucgagggcuucccccaguccccccuccagauccccggcucccccuccuucuccuccacccuccucucccucuuccaguccucccccgagcgcacccacuccaccuucgagggcuucccccaguccccccuccagauccccaugaccuccuccuucuccuccacccuccucuccauccuccaguccucccccgaguccgcccaguccgccuucgagggcuucccccaguccccccuccagauccccgucuccuccuccuucuccuacacccuccucucccucuuccaguccucccccgagcgcacccacuccaccuucgagggcuucccccaguccccccuccagauccccgucuccuccuccuccuccuccuccacccuccucucccucuuccaguccucccccgagugcacccaguccaccuucgagggcuucccccaguccccccuccagaucccccaguccccccccgagggcgagaacacccacuccccccuccagaucguccccucccuccccgagugggaggacucccucuccccccacuacuucccccagucccccccccagggcgaggacucccucuccccccacuacuucccccagucccccccccagggcgaggacucccucuccccccacuacuucccccaguccccccagggcgaggacucccucuccccccacuacuucccccagucccccccccagggcgaggacuccauguccccccucuacuucccccaguccccccuccagggcgaggaguuccaguccucccuccagucccccgucuccaucugcuccuccuccacccccuccucccucccccaguccuuccccgaguccucccaguccccccccgagggccccguccaguccccccuccacuccccccaguccccccccgagggcaugcacucccaguccccccuccagucccccgaguccgcccccgagggcgaggacucccucuccccccuccagaucccccaguccccccucgagggcgaggacucccucuccucccuccacuucccccaguccccccccgagugggaggacucccucuccccccuccacuucccccaguuccccccccagggcgaggacuuccaguccucccuccagucccccgucuccaucugcuccuccuccaccucccucucccucccccaguccuuccccgaguccccccaguccccccccgagggccccgcccaguccccccuccagcgccccgucuccuccuucuucuccuacacccucgccucccuccuccaguccucccacgaguccccccaguccccccccgagggccccgcccaguccccccuccagucccccgucuccuccuuccccuccuccaccuccuccucccucucccaguccucccccgucuccuccuuccccuccuccaccuccuccucccucuccaaguccucccccgaguccccccuccagucccccgucaucuccuucuccuccuccaccucccucucccccuucuccgaggaguccuccucccccgucgacgaguacaccuccuccuccgacacccuccucgaguccgacucccucaccgacuccgagucccucaucgaguccgagccccucuucaccuacacccucgacgagaaggucgacgagcucgcccgcuuccuccuccucaaguaccaggucaagcagcccaucaccaaggccgagaugcucaccaacgucaucucccgcuacaccggcuacuuccccgucaucuuccgcaaggcccgcgaguucaucgagauccucuucggcaucucccuccgcgaggucgaccccgacgacuccuacgucuucgucaacacccucgaccucaccuccgagggcugccucuccgacgagcagggcaugucccagaaccgccuccucauccucauccucuccaucaucuucaucaagggcaccuacgccuccgaggaggucaucugggacguccucuccggcaucggcguccgcgccggccgcgagcacuucgccuucggcgagccccgcgagcuccucaccaaggucuggguccaggagcacuaccucgaguaccgcgagguccccaacuccucccccccccgcuacgaguuccucuggggcccccgcgcccacuccgaggucaucaagcgcaaggucgucgaguuccucgccaugcucaagaacaccguccccaucaccuuccccuccuccuacaaggacgcccucaaggacgucgaggagcgcgcccaggccaucaucgacaccaccgacgacuccaccgccaccgaguccgccuccuccuccgucaugucccccuccuucuccuccgaguga

SEQ ID NO: 2348 - RNA, 3429 nt, Artificial Sequence
  derived and/or modified sequence opt3 from MAGE-C1__Homo_sapiens__CCDS35417.1
augggcgacaaggauaugcccaccgccgggaugccuagccugcuccaguccucuucagagaguccacaaagcugcccggaaggagaggacucccagucuccccuucagaucccucagucgucaccagaaagcgaugacacacuguaccccuugcaaaguccucaguccagaucugagggugaagauagcuccgacccauuacagaggcccccugagggcaaagauucacagaguccacugcaaauuccgcagagcucucccgagggggacgauacucaguccccucuacagaacucacaaagcaguccagaaggaaaggacucucucuccccucuggagauaagccagucgcccccagaaggcgaggaugugcagucuccccuucaaaauccggcuuccucauucuuuaguagcgcacuguuguccaucuuccagucuagcccugagucaacgcagagucccuuugaagguuucccacaguccguccuccaaauuccuguuagcgccgcgucuucaaguacccuggugagcaucuuucaguccucucccgagucgacacagagcccauucgaaggguuuccccaguccccucugcaaauuccaguaucacggaguuucucuagcacucucuuauccaucuuucagucaagcccggagcgcacccagucuacauucgaaggauuugcucaguccccucugcaaauacccgugaguccauccucuuccucaacccuuuugagucuguuccagagcuuuucggagcgaacucaguccacauucgagggcuucgcccagucuagccuacaaauccccgucucaccuaguuuuuccucuacccucgugagccuguuccaguccucaccagaacguacgcagagcacuuuugagggcuucccccaaaguccgcuucagauuccuguuucuuccagcucgucaucuacccuguugagucucuuucaguccagcccagaaagaacacacucuacuuucgagggguuuccccagagccuguuacaaaucccuaugaccuccucauucaguagcacacugcucucuauuuuucaguccucacccgaaagugcacagagcaccuucgagggauuuccacaguccccucuucaaauccccgguucuccaucguucagcucaacgcuguugucccuauuucagaguucuccggagaggacucauagcacauucgaaggcuucccucaguccccacugcagauacccaugaccucaucuuuuagcaguacucuccuguccauucuucaaagcucucccgagucagcccaguccgcuuucgaaggguuuccucagaguccacugcaaauccccgugagcucgucuuucuccuauacauugcucagccuguuucagucaaguccugagcggacccacucuacguucgaaggauuuccgcaguccccauuacagauucccgucagcucaaguagcuccucuagcacccugcuaucccucuuccaaucaucuccugaguguacacagaguacuuuugagggcuucccacagucgccccugcagaucccucaaagcccgcccgaaggugagaacacccauuccccacuucagaucgugccuucuuugcccgaaugggaggacucacugagcccacacuacuuuccucaguccccaccccagggggaggauagucucucuccgcauuauuucccucaaucacccccacagggagaagacagccugagcccccacuacuuuccucagaguccacagggcgaggacagccuuucuccccacuauuucccucaauccccgccacagggcgaagauucaaugagcccccuguacuucccucagucgcccuugcaaggggaggaauuucagucuagucuccaguccccaguaagcauuugcucauccucuacaccuagcagucugccccaguccuucccagagagcucucaaucaccuccggagggacccguucagaguccauuacauuccccucagucucccccagaagguaugcacagccagucgccucugcaaucacccgagagcgcaccggaaggcgaggacucccuaaguccacuccagauaccucagucuccccuggaaggggaggauagccuuuccucauugcauuuuccacagagucccccugagugggaagacucucugagcccgcuccacuucccccaauuuccaccucagggagaggauuuccaguccucacugcaaagccccgugucuaucuguuccaguagcacuucguuaucccugccucagucuuuuccagaaucaccccagagcccuccagagggccccgcccagaguccgcuucaacgcccugucuccucuuucuuuagcuauaccuuggcuucacuccugcaguccagucacgaaagcccacagucucccccugaggguccagcccagucaccccuacaauccccggugagcucuuucccuaguucgacauccagcucacugucucagagcucccccgugaguucauuuccaucuagcaccuccaguagccucuccaaaucuucaccugagagcccccugcagucgccagucauuuccuucaguucuagcacuucacuuucccccuucucugaagagaguagcuccccuguugacgaauacacgucaagcucugauacauugcuggagagugacuccuuaaccgauagcgagucacucaucgaaucugagccacuguuuacuuacacccuugacgaaaagguggaugagcuggcgagauucuugcuccugaaauaucagguaaagcaaccgauaacaaaggcagaaaugcuaaccaaugugauuuccagguacacuggguauuuucccgucaucuuccggaaagcccgcgaguuuaucgagauucuguucggcaucucgcuccgagaaguggacccugacgauagcuacguuuuugugaacacacuggaccuuacgagugagggaugcuugucugaugaacagggcaugucccagaauagacuguuaauucucauacugagcaucauuuucaucaaggggaccuaugcuucagaggaagucaucugggacgugcuuaguggaauugguguaagggccggccgggagcauuuugcauucggggagccacgugaacugcuaacuaaaguuugggugcaggagcacuaccucgaauaucgcgagguccccaacuccagcccuccaagauacgaauuucuguggggacccagggcucauucugaggugauaaagcggaaagucguggaguucuuggccaugcugaagaauacaguuccuaucaccuuuccgucaagcuacaaggaugcguuaaaagacguggaggaacgagcccaagcaauuaucgauacaacugacgauuccaccgcuacggaaucugccaguucgagcguaauguccccaucauucucuagcgaguga

SEQ ID NO: 2349 - RNA, 3429 nt, Artificial Sequence
  derived and/or modified sequence opt4 from MAGE-C1__Homo_sapiens__CCDS35417.1
augggcgacaaggacaugcccaccgccggcaugcccagccugcugcagagcagcagcgagagcccccagagcugccccgagggcgaggacagccagagcccccugcagaucccccagagcagccccgagagcgacgacacccuguacccccugcagagcccccagagcagaagcgagggcgaggacagcagcgacccccugcagagaccccccgagggcaaggacagccagagcccccugcagaucccccagagcagccccgagggcgacgacacccagagcccccugcagaacagccagagcagccccgagggcaaggacagccugagcccccuggagaucagccagagcccccccgagggcgaggacgugcagagcccccugcagaaccccgccagcagcuucuucagcagcgcccugcugagcaucuuccagagcagccccgagagcacccagagccccuucgagggcuucccccagagcgugcugcagauccccgugagcgccgccagcagcagcacccuggugagcaucuuccagagcagccccgagagcacccagagccccuucgagggcuucccccagagcccccugcagauccccgugagcagaagcuucagcagcacccugcugagcaucuuccagagcagccccgagagaacccagagcaccuucgagggcuucgcccagagcccccugcagauccccgugagccccagcagcagcagcacccugcugagccuguuccagagcuucagcgagagaacccagagcaccuucgagggcuucgcccagagcagccugcagauccccgugagccccagcuucagcagcacccuggugagccuguuccagagcagccccgagagaacccagagcaccuucgagggcuucccccagagcccccugcagauccccgugagcagcagcagcagcagcacccugcugagccuguuccagagcagccccgagagaacccacagcaccuucgagggcuucccccagagccugcugcagauccccaugaccagcagcuucagcagcacccugcugagcaucuuccagagcagccccgagagcgcccagagcaccuucgagggcuucccccagagcccccugcagauccccggcagccccagcuucagcagcacccugcugagccuguuccagagcagccccgagagaacccacagcaccuucgagggcuucccccagagcccccugcagauccccaugaccagcagcuucagcagcacccugcugagcauccugcagagcagccccgagagcgcccagagcgccuucgagggcuucccccagagcccccugcagauccccgugagcagcagcuucagcuacacccugcugagccuguuccagagcagccccgagagaacccacagcaccuucgagggcuucccccagagcccccugcagauccccgugagcagcagcagcagcagcagcacccugcugagccuguuccagagcagccccgagugcacccagagcaccuucgagggcuucccccagagcccccugcagaucccccagagcccccccgagggcgagaacacccacagcccccugcagaucgugcccagccugcccgagugggaggacagccugagcccccacuacuucccccagagccccccccagggcgaggacagccugagcccccacuacuucccccagagccccccccagggcgaggacagccugagcccccacuacuucccccagagcccccagggcgaggacagccugagcccccacuacuucccccagagccccccccagggcgaggacagcaugagcccccuguacuucccccagagcccccugcagggcgaggaguuccagagcagccugcagagccccgugagcaucugcagcagcagcacccccagcagccugccccagagcuuccccgagagcagccagagcccccccgagggccccgugcagagcccccugcacagcccccagagcccccccgagggcaugcacagccagagcccccugcagagccccgagagcgcccccgagggcgaggacagccugagcccccugcagaucccccagagcccccuggagggcgaggacagccugagcagccugcacuucccccagagcccccccgagugggaggacagccugagcccccugcacuucccccaguuccccccccagggcgaggacuuccagagcagccugcagagccccgugagcaucugcagcagcagcaccagccugagccugccccagagcuuccccgagagcccccagagcccccccgagggccccgcccagagcccccugcagagacccgugagcagcuucuucagcuacacccuggccagccugcugcagagcagccacgagagcccccagagcccccccgagggccccgcccagagcccccugcagagccccgugagcagcuuccccagcagcaccagcagcagccugagccagagcagccccgugagcagcuuccccagcagcaccagcagcagccugagcaagagcagccccgagagcccccugcagagccccgugaucagcuucagcagcagcaccagccugagccccuucagcgaggagagcagcagccccguggacgaguacaccagcagcagcgacacccugcuggagagcgacagccugaccgacagcgagagccugaucgagagcgagccccuguucaccuacacccuggacgagaagguggacgagcuggccagauuccugcugcugaaguaccaggugaagcagcccaucaccaaggccgagaugcugaccaacgugaucagcagauacaccggcuacuuccccgugaucuucagaaaggccagagaguucaucgagauccuguucggcaucagccugagagagguggaccccgacgacagcuacguguucgugaacacccuggaccugaccagcgagggcugccugagcgacgagcagggcaugagccagaacagacugcugauccugauccugagcaucaucuucaucaagggcaccuacgccagcgaggaggugaucugggacgugcugagcggcaucggcgugagagccggcagagagcacuucgccuucggcgagcccagagagcugcugaccaaggugugggugcaggagcacuaccuggaguacagagaggugcccaacagcagcccccccagauacgaguuccuguggggccccagagcccacagcgaggugaucaagagaaaggugguggaguuccuggccaugcugaagaacaccgugcccaucaccuuccccagcagcuacaaggacgcccugaaggacguggaggagagagcccaggccaucaucgacaccaccgacgacagcaccgccaccgagagcgccagcagcagcgugaugagccccagcuucagcagcgaguga

SEQ ID NO: 2350 - RNA, 3429 nt, Artificial Sequence
  derived and/or modified sequence opt5 from MAGE-C1__Homo_sapiens__CCDS35417.1
augggcgacaaggauaugcccaccgccgggaugccuagccugcuccaguccucuagcgaguccccgcaaucuugccccgaaggagaggacagccaguccccucugcagaucccccagucuagcccugaauccgaugacacacuuuacccccugcaaagcccucagucuagauccgagggcgaagauagcucugacccgcuccagcggcccccugaggggaaagauucccagagcccccugcaaauuccucagucuucccccgagggagacgauacgcagagcccgcuucagaacucccaaucuagcccugaaggcaaggacucccugagcccccucgagaucucucaguccccucccgaaggggaggaugugcagagcccccugcaaaauccugcuucuagcuucuuuuccucugcccugcucagcauuuuccaguccagcccggagucuacccagucccccuuugaaggauucccucagagcguccugcaaauccccguuucugcggcuuccagcuccacacuugugucuauuuuucagagcuccccugagucuacccagagccccuucgaaggcuuuccgcaguccccucugcaaauccccgugagccgcucuuucuccagcacacuccugucuaucuuucaguccagcccugagagaacccagucuacauucgaaggcuuugcccagagcccccuucaaauuccugucucccccuccucuuccagcacccugcucucccuguuccagucuuuuagcgagcggacgcaguccaccuucgagggguucgcccagucuagccugcaaaucccgguguccccuucuuuuagcuccacacucguuagccuguuccagucuucccccgaacgcacccagagcacauuugagggauucccccaaucuccucuucagauuccgguguccuccucuuccagcuccacccugcucagccuguuucagucuagccccgaaagaacgcacuccacauucgagggcuuuccucagucucuucugcaaauccccaugaccagcuccuucucuagcacacuccuguccauuuuucagucuagcccugaauccgcucagagcaccuucgagggguuuccccagucuccucugcaaauccccggauccccgagcuucucuuccacccuccugagccuuuuucaguccucuccugagcggacacauagcacguucgaaggcuucccccaguccccucugcagauucccaugaccagcucuuuuuccagcacacuccugucuauccuucaaagcuccccggagucugcccagagcgcuuucgaaggguuuccucaguccccucugcaaauccccgucucuagcuccuucagcuauacccuccugucucuguuucaguccagccccgagcgcacacacuccaccuucgaaggauuuccccagucuccucuccagauuccggugagcuccucuagcuccagcucuacgcugcuuucccuguuccaaagcucucccgaguguacacaguccaccuuugagggcuucccucagagcccccuccagaucccucaaucucccccugaaggcgagaacacccauagcccgcugcagauuguucccucccugccugaaugggaggacucucuuagcccccacuacuuuccucaguccccgccccagggggaggauagccucuccccucauuauuucccccaaucucccccucagggagaagacagccuguccccucacuacuuuccccagucuccgcagggcgaggacagccuguccccucacuauuucccccaaucucccccucagggggaagauagcaugagcccccucuacuucccgcagagcccucugcaaggagaggaauuucagucuucccuucagagccccgugucuaucugcuccagcucuacaccuuccagccugccccaguccuucccugagagcucucaaagcccgcccgagggcccuguccagagcccccuccauucuccccagagcccuccggaagggaugcacucccagucuccccugcaaagcccugaguccgcccccgaaggagaggacucucugagcccucuucagauuccccaguccccucucgaaggcgaggauagccugucuucccugcauuuuccgcagagcccucccgagugggaagacucucucagcccccugcacuucccucaauuucccccgcagggcgaggauuuccaguccucccuucaaucuccugugagcaucuguuccagcucuaccucccugagccucccccagucuuuucccgaaagcccucaguccccucccgaggggccggcgcagucuccccugcaaagaccugugagcuccuucuuuucuuauacacuggccagccuucuccaguccagccacgaaucuccccaguccccucccgagggaccggcucagagcccucugcaaucccccgucucuagcuucccuuccucuacgagcuccagccugucucaguccagccccguuucuuccuuuccuagcucuaccuccagcucucucagcaaauccagccccgaguccccgcugcagucuccugugaucagcuucuccucuagcacaucccuuucucccuucagcgaagaguccagcucucccguggacgaauacaccuccagcucugauacacugcucgaguccgacagccugaccgauucugagucccugauugaaagcgagccucuuuuuacguacacccucgacgaaaaggucgaugagcuggcccgguuccugcuccugaaauaucaggugaagcaaccgaucacaaaggcugaaaugcuuaccaauguuauuucucgcuacacaggcuauuuucccgugaucuucagaaaagcccgggaguuuauugagauccuguucgggaucucccuccgcgaagucgacccugacgauagcuacguguuuguuaacacccuggaccugacgagcgagggaugccuuuccgaugaacagggcaugucucagaauagacugcucauucugauccucagcauuaucuucauuaaggggacauaugcguccgaggaagugaucugggacguccugucuggcauuggagugcgggccggccgcgagcauuuugcuuucggggagcccagagaacuucugaccaaagucugggugcaggagcacuaccucgaauaucgggagguuccuaacagcucucccccuagauacgaauuucuguggggaccccgcgcccauuccgaggugaucaagcggaaagucguggaguuccuggcuaugcuuaagaauacaguuccgaucaccuuuccuagcuccuacaaggaugcccugaaagacguggaagagagagcccaagcuauuaucgauaccacagacgauagcacggcgaccgaaucugccuccagcucugucaugucccccagcuucuccucugaguga

SEQ ID NO: 2351 - protein, 373 aa, Artificial Sequence
  MAGE-C2__Homo_sapiens__Q9UBF1
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 2352 - RNA, 1122 nt, Artificial Sequence
  MAGE-C2__Homo_sapiens__AAF07210
augccucccguuccaggcguuccauuccgcaacguugacaacgacuccccgaccucaguugaguuagaagacuggguagaugcacagcaucccacagaugaggaagaggaggaagccuccuccgccucuuccacuuuguacuuaguauuuucccccucuucuuucuccacauccucuucucugauucuuggugguccugaggaggaggaggugcccucuggugugauaccaaaucuuaccgagagcauucccaguaguccuccacaggguccuccacaggguccuucccagaguccucugagcuccugcugcuccucuuuuucauggagcucauucagugaggaguccagcagccagaaaggggaggauacaggcaccugucagggccugccagacagugaguccucuuucacauauacacuagaugaaaagguggccgaguuaguggaguuccugcuccucaaauacgaagcagaggagccuguaacagaggcagagaugcugaugauugucaucaaguacaaagauuacuuuccugugauacucaagagagcccgugaguucauggagcuucuuuuuggccuugcccugauagaagugggcccugaccacuucuguguguuugcaaacacaguaggccucaccgaugaggguagugaugaugagggcaugcccgagaacagccuccugauuauuauucugagugugaucuucauaaagggcaacugugccucugaggaggucaucugggaagugcugaaugcaguagggguauaugcugggagggagcacuucgucuauggggagccuagggagcuccucacuaaaguuugggugcagggacauuaccuggaguaucgggaggugccccacaguucuccuccauauuaugaauuccugugggguccaagagcccauucagaaagcaucaagaagaaaguacuagaguuuuuagccaagcugaacaacacuguuccuaguuccuuuccauccugguacaaggaugcuuugaaagauguggaagagagaguccaggccacaauugauaccgcagaugaugccacugucauggccagugaaagccucagugucauguccagcaacgucuccuuuucugaguga

SEQ ID NO: 2353 - RNA, 1122 nt, Artificial Sequence
  derived and/or modified sequence opt1 from MAGE-C2__Homo_sapiens__AAF07210
augccgcccgugcccggcguccccuuccgcaacguggacaacgacagccccaccuccguggagcuggaggacugggucgacgcccagcaccccaccgacgaggaggaggaggaggccagcuccgcgagcuccacgcucuaccugguguucagccccuccagcuucuccaccagcuccagccugauccucgggggccccgaggaggaggaggugcccuccggggucaucccgaaccugaccgagagcauccccuccagcccgccccagggcccgccccaggggcccucccagagcccccuguccagcugcugcagcuccuucagcugguccagcuucuccgaggagagcuccagccagaagggcgaggacaccggcacgugccaggggcucccggacuccgagagcuccuucaccuacacccuggacgagaagguggccgagcugguggaguuccuccugcugaaguacgaggccgaggagcccgucaccgaggccgagaugcucaugaucgugaucaaguacaaggacuacuuccccgugauccugaagcgggcccgcgaguucauggagcuccuguucggccuggcgcugaucgaggucgggcccgaccacuucugcguguucgccaacacggugggccucaccgacgaggggagcgacgacgagggcaugccggagaacucccugcugaucaucauccucagcgucaucuucaucaagggcaacugcgccuccgaggaggugaucugggaggugcugaacgccgucgggguguacgcgggccgggagcacuucguguacggggagccccgcgagcugcucaccaaggucugggugcagggccacuaccuggaguaccgggaggugccccacagcuccccgcccuacuacgaguuccuguggggcccccgcgcccacagcgaguccaucaagaagaagguccucgaguuccuggccaagcugaacaacaccgugcccagcagcuuccccuccugguacaaggacgcccucaaggacgucgaggagcgggugcaggccacgaucgacaccgcggacgacgccaccgugauggccagcgagucccugagcgucauguccagcaacguguccuucagcgaguga

SEQ ID NO: 2354 - RNA, 1122 nt, Artificial Sequence
  derived and/or modified sequence opt2 from MAGE-C2__Homo_sapiens__AAF07210
augccccccguccccggcguccccuuccgcaacgucgacaacgacucccccaccuccgucgagcucgaggacugggucgacgcccagcaccccaccgacgaggaggaggaggaggccuccuccgccuccuccacccucuaccucgucuucucccccuccuccuucuccaccuccuccucccucauccucggcggccccgaggaggaggagguccccuccggcgucauccccaaccucaccgaguccauccccuccucccccccccagggccccccccagggccccucccaguccccccucuccuccugcugcuccuccuucuccugguccuccuucuccgaggaguccuccucccagaagggcgaggacaccggcaccugccagggccuccccgacuccgaguccuccuucaccuacacccucgacgagaaggucgccgagcucgucgaguuccuccuccucaaguacgaggccgaggagcccgucaccgaggccgagaugcucaugaucgucaucaaguacaaggacuacuuccccgucauccucaagcgcgcccgcgaguucauggagcuccucuucggccucgcccucaucgaggucggccccgaccacuucugcgucuucgccaacaccgucggccucaccgacgagggcuccgacgacgagggcaugcccgagaacucccuccucaucaucauccucuccgucaucuucaucaagggcaacugcgccuccgaggaggucaucugggagguccucaacgccgucggcgucuacgccggccgcgagcacuucgucuacggcgagccccgcgagcuccucaccaaggucuggguccagggccacuaccucgaguaccgcgaggucccccacuccuccccccccuacuacgaguuccucuggggcccccgcgcccacuccgaguccaucaagaagaagguccucgaguuccucgccaagcucaacaacaccguccccuccuccuuccccuccugguacaaggacgcccucaaggacgucgaggagcgcguccaggccaccaucgacaccgccgacgacgccaccgucauggccuccgagucccucuccgucauguccuccaacgucuccuucuccgaguga

SEQ ID NO: 2355 - RNA, 1122 nt, Artificial Sequence
  derived and/or modified sequence opt3 from MAGE-C2__Homo_sapiens__AAF07210
augcccccugugccaggcgucccguucagaaacguugacaaugauagccccaccuccguggagcuggaagacuggguagaugcccagcacccuacagacgaggaagaggaagaggcuucuucagcaaguagcacucucuaccuuguguuuuccccaucuucguucucaacgagcaguucccugaucuuagggggacccgaggaagaggaagucccuucuggugugauuccaaacuugaccgagagcauacccuccucaccuccacaaggcccgccccaggggccuagucagagcccacugucuuccugcuguagcucauuuaguuggucuuccuucagcgaggaaucgucuucccagaagggagaggauacaggcacuugccaaggucuacccgacucagaaaguagcuuuaccuauacacucgaugagaaaguugccgaacugguggaguuccuucuguugaaguacgaggcggaagaaccugucaccgaagcugagaugcucaugaucgugauuaaauauaaggacuacuuuccaguaauccugaaaagggcccgggaguucauggagcugcucuuuggguuagcacugauugagguuggacccgaucauuucuguguguuugccaauacugucggccuuacagacgaaggcuccgaugacgaggggaugccggaaaacucuuugcugaucauaauccuaagcgugauuuucaucaagggaaauugcgcuucagaggaagugauuugggagguccucaacgcaguugguguguaugccggccgcgagcacuuuguauacggggaaccucgagagcugcuuaccaagguguggguccagggacauuaucuggaauaccgugaggugccccacaguuccccaccuuacuaugaguucuuguggggccccagagcucauagcgaaucuaucaaaaagaaaguucucgaguuccuggccaaguuaaauaacacggugccaucaaguuuucccagcugguacaaagaugcgcugaaggacgucgaagagagggugcaggcaacuauagacaccgccgaugacgcuacaguaauggccuccgaaucucucucgguuaugagcuccaaugugucauucagugaguga

SEQ ID NO: 2356 - RNA, 1122 nt, Artificial Sequence
  derived and/or modified sequence opt4 from MAGE-C2__Homo_sapiens__AAF07210
augccccccgugcccggcgugcccuucagaaacguggacaacgacagccccaccagcguggagcuggaggacuggguggacgcccagcaccccaccgacgaggaggaggaggaggccagcagcgccagcagcacccuguaccugguguucagccccagcagcuucagcaccagcagcagccugauccugggcggccccgaggaggaggaggugcccagcggcgugauccccaaccugaccgagagcauccccagcagccccccccagggccccccccagggccccagccagagcccccugagcagcugcugcagcagcuucagcuggagcagcuucagcgaggagagcagcagccagaagggcgaggacaccggcaccugccagggccugcccgacagcgagagcagcuucaccuacacccuggacgagaagguggccgagcugguggaguuccugcugcugaaguacgaggccgaggagcccgugaccgaggccgagaugcugaugaucgugaucaaguacaaggacuacuuccccgugauccugaagagagccagagaguucauggagcugcuguucggccuggcccugaucgaggugggccccgaccacuucugcguguucgccaacaccgugggccugaccgacgagggcagcgacgacgagggcaugcccgagaacagccugcugaucaucauccugagcgugaucuucaucaagggcaacugcgccagcgaggaggugaucugggaggugcugaacgccgugggcguguacgccggcagagagcacuucguguacggcgagcccagagagcugcugaccaaggugugggugcagggccacuaccuggaguacagagaggugccccacagcagcccccccuacuacgaguuccuguggggccccagagcccacagcgagagcaucaagaagaaggugcuggaguuccuggccaagcugaacaacaccgugcccagcagcuuccccagcugguacaaggacgcccugaaggacguggaggagagagugcaggccaccaucgacaccgccgacgacgccaccgugauggccagcgagagccugagcgugaugagcagcaacgugagcuucagcgaguga

SEQ ID NO: 2357 - RNA, 1122 nt, Artificial Sequence
  derived and/or modified sequence opt5 from MAGE-C2__Homo_sapiens__AAF07210
augcccccugugccgggcguccccuucagaaacguugacaaugauagcccuaccuccguggagcuggaagacuggguggaugcccagcaccccacagacgaggaagaggaagaggcuucuagcgccuccucuacgcucuaccuggucuuuagcccuuccucuuucagcaccuccagcucucuuauccucgggggacccgaggaagaggaagugccuuccggcguuauuccgaaccugacagagagcauccccucuuccccuccccaagggccuccccagggaccgagccagucuccucuguccagcugcuguuccucuuuuagcugguccagcuucucugaggaauccagcucucagaagggcgaggauaccgggacaugccaaggacuucccgacagcgaauccucuuuuaccuauacacuggaugagaaaguggcggaacucgucgaguuccugcugcucaaguacgaggcugaagaaccugugaccgaagccgagaugcugaugauuguuaucaaauauaaggacuacuuucccgugauucuuaaacgggcccgcgaguucauggagcugcucuuuggccuggcucuuaucgaggucggccccgaucauuucuguguguuugccaauacgguggggcugaccgacgaaggaagcgaugacgagggcaugccugaaaacucccuccugaucauuauccugagcgucauuuucaucaaggggaauugcgcuucugaggaaguuauuugggaggugcucaacgccgugggagucuaugcgggcagagagcacuuuguguacggggaaccgcgggagcugcuuacaaagguuugggugcagggacauuaucuggaauaccgcgaggucccccacuccagcccucccuacuaugaguuccucuggggcccuagagcccauucugaauccaucaaaaagaaagugcuggaguuccuugcuaagcugaauaacaccguucccagcuccuuuccgucuugguacaaagaugcccucaaggacguggaggaacggguccaggcuacaauugacaccgccgaugacgcgacggugauggccagcgaaucccugucugucaugagcuccaaugugagcuucucugaguga

SEQ ID NO: 2358 - protein, 643 aa, Artificial Sequence
  MAGE-C3__Homo_sapiens__Q8TD91
MLLPCHWVLDATFSDGSLGQWVKNTCATYALSPVVLPPQPQPRKKATDKDYSAFHLGHLREVRLFLRGGTSDQRMDSLVLCPTYFKLWRTLSGSPGLQLSDLHFGSQPEGKFSLRRAVSVKQREEPQDWPLNEKRTLWKDSDLPTWRRGTGYTLSLPAVSPGKRLWGEKAGSLPESEPLFTYTLDEKVDKLVQFLLLKYQAKEPLTRAEMQMNVINTYTGYFPMIFRKAREFIEILFGISLTEVDPDHFYVFVNTLDLTCEGSLSDEQGMPQNRLLILILSVIFIKGNCASEEVIWEVLNAIGPWSALAGFADVLSRLALWESEGPEAFCEESGLRSAEGSVLDLANPQGLAGHRQEDGRRGLTEASPQQKKGGEDEDMPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGPIQRPAREVLEFLSKLSSIIPSAFPSWYMDALKDMEDRAQAIIDTTDDATAMASASPSVMSTNFCPE

SEQ ID NO: 2359 - RNA, 1932 nt, Artificial Sequence
  MAGE-C3__Homo_sapiens__AAM08355
augcugcugcccugccacuggguguuggaugccaccuucagugauggcagucuaggccagugggugaaaaacacaugugccacauaugccuuauccccaguggugcucccaccucagccccagccccggaaaaaggccacagauaaggacuauucugccuuucaucuugggcaucugagggaggugaggcuuuuucugagggguggaacuucagaucagcgaauggauagucuuguccucugccccacauacuucaagcucuggaggacccuaucaggguccccagguuuacaacuuucugacuugcauuuugggagucagccggaggggaaguuuucucugaggagggcaguuucaguuaagcagagggaggaaccccaggacuggccacucaacgagaagagaacucuguggaaggacagugaccuuccaacauggaggagaggcacaggcuacacccuuucccuuccugccgucagcccuggaaaaagguuguggggggagaaagcggggagcuugccagagagcgagcccuuguucacuuauacacuggaugaaaagguggacaaguuggugcaguuucuucuccucaaauaucaagcaaaagagccucucacaagagcagagaugcagaugaaugucaucaacacauacacgggcuacuuuccuaugaucuucaggaaagcccgugaguucauagagauucuuuuuggcauuucccugacagaaguggaccccgaccauuucuaugucuuuguaaacacauuagaccucaccugugaggggagucugagugaugagcagggcaugccccagaaccgccuccugauucuuauucugagugugaucuucauaaagggcaacugugcaucugaggaggucaucugggaagugcugaaugcaauagggcccuggucagccuuggcaggguucgcggaugugcuuucccgacuugcacugugggagucugaaggaccugaagcauuuugcgaggagucuggacucaggucagcagagggaagcgucuuagaccuggccaauccucaaggacuugcaggccacagacaggaagauggccgccgagggcugaccgaggcguccccacaacagaagaagggaggagaagaugaggauaugccugcugcugggaugccaccucuuccccagaguccuccugagauuccuccccaggguccucccaagaucucuccccaggguccuccgcagaguccuccccagaguccucuagacuccugcucauccccucuuuuguggacccgauuggaugaggaguccagcagugaagaggaggauacagcuacuuggcaugccuugccagaaagugaauccuugcccagguaugcccuggaugaaaagguggcugaguuggugcaguuucuucuccucaaauaucaaacaaaagagccugucacaaaggcagagaugcugacgacugucaucaagaaguauaaggacuauuuucccaugaucuucgggaaagcccaugaguucauagagcuaauuuuuggcauugcccugacugauauggaccccgacaaccacuccuauuucuuugaagacacauuagaccucaccuaugagggaagccugauugaugaccagggcaugcccaagaacugucuccugauucuuauucucaguaugaucuucauaaagggcagcuguguccccgaggaggucaucugggaaguguugagugcaauagggcccauucagaggccagcaagagaagucuuagaguuuuuauccaagcuauccaguaucaucccuagugccuuuccauccugguacauggaugcuuugaaagauauggaagacagagcccaggccauaauugacaccacagaugaugcuacugccauggccagugcaagccccagugucauguccaccaacuucuguccugaguga

SEQ ID NO: 2360 - RNA, 1932 nt, Artificial Sequence
  derived and/or modified sequence opt1 from MAGE-C3__Homo_sapiens__AAM08355
augcugcuccccugccacugggugcuggacgccaccuucagcgacggcucccuggggcagugggucaagaacaccugcgccacguacgcgcucagcccgguggugcugcccccccagccccagccgcgcaagaaggccaccgacaaggacuacuccgccuuccaccugggccaccuccgggagguccgccuguuccugcgggggggcaccagcgaccagcgcauggacucccucgugcugugccccaccuacuucaagcuguggcggacgcucagcgggucccccggccugcagcugagcgaccuccacuucggcucccagcccgaggggaaguucagccugcgccgggccguguccgucaagcagcgcgaggagccgcaggacuggccccugaacgagaagcggacccucuggaaggacagcgaccugcccaccuggcgccggggcaccggguacacgcugucccuccccgccgugagcccgggcaagcgccuguggggggagaaggcgggcucccugcccgagagcgagccccucuucaccuacacccuggacgagaagguggacaagcugguccaguuccuccugcugaaguaccaggccaaggagccccucacccgggccgagaugcagaugaacgugaucaacacguacaccggcuacuucccgaugaucuuccgcaaggcccgggaguucaucgagauccuguucgggaucucccugaccgagguggaccccgaccacuucuacgucuucgugaacacccucgaccugacgugcgagggcagccuguccgacgagcaggggaugccccagaaccgccuccugauccugauccucagcgugaucuucaucaagggcaacugcgcgagcgaggaggucaucugggaggugcugaacgccaucggccccugguccgcccuggccggguucgccgacgugcucagccggcuggcgcugugggaguccgagggcccggaggccuucugcgaggagagcgggcuccgcuccgccgagggcagcguccuggaccuggccaacccccaggggcucgccggccaccggcaggaggacggccgccgggggcugaccgaggcguccccccagcagaagaagggcggggaggacgaggacaugcccgccgccggcaugccgccccugccccagagccccccggagauccccccccaggggccgcccaagaucuccccccagggccccccgcagagccccccccaguccccccuggacagcugcuccagcccgcuccuguggacccgccuggacgaggaguccagcuccgaggaggaggacaccgccacguggcacgcccuccccgagagcgagucccugccccgcuacgcgcuggacgagaagguggccgagcucgugcaguuccugcugcucaaguaccagaccaaggagcccgucaccaaggccgagaugcugaccacggugaucaagaaguacaaggacuacuucccgaugaucuucggcaaggcccacgaguucaucgagcugaucuucgggaucgcccucaccgacauggaccccgacaaccacagcuacuucuucgaggacacccuggaccugaccuacgagggcagccucaucgacgaccaggggaugcccaagaacugccugcugauccucauccuguccaugaucuucaucaagggcagcugcgugcccgaggaggucaucugggaggugcuguccgcgaucgggccgauccagcggcccgcccgcgagguccucgaguuccugagcaagcuguccagcaucauccccuccgccuuccccagcugguacauggacgcccucaaggacauggaggaccgggcgcaggccaucaucgacacgaccgacgacgccaccgccauggccuccgcgagcccguccgugaugagcaccaacuucugccccgaguga

SEQ ID NO: 2361 - RNA, 1932 nt, Artificial Sequence
  derived and/or modified sequence opt2 from MAGE-C3__Homo_sapiens__AAM08355
augcuccuccccugccacuggguccucgacgccaccuucuccgacggcucccucggccagugggucaagaacaccugcgccaccuacgcccucucccccgucguccuccccccccagccccagccccgcaagaaggccaccgacaaggacuacuccgccuuccaccucggccaccuccgcgagguccgccucuuccuccgcggcggcaccuccgaccagcgcauggacucccucguccucugccccaccuacuucaagcucuggcgcacccucuccggcucccccggccuccagcucuccgaccuccacuucggcucccagcccgagggcaaguucucccuccgccgcgccgucuccgucaagcagcgcgaggagccccaggacuggccccucaacgagaagcgcacccucuggaaggacuccgaccuccccaccuggcgccgcggcaccggcuacacccucucccuccccgccgucucccccggcaagcgccucuggggcgagaaggccggcucccuccccgaguccgagccccucuucaccuacacccucgacgagaaggucgacaagcucguccaguuccuccuccucaaguaccaggccaaggagccccucacccgcgccgagaugcagaugaacgucaucaacaccuacaccggcuacuuccccaugaucuuccgcaaggcccgcgaguucaucgagauccucuucggcaucucccucaccgaggucgaccccgaccacuucuacgucuucgucaacacccucgaccucaccugcgagggcucccucuccgacgagcagggcaugccccagaaccgccuccucauccucauccucuccgucaucuucaucaagggcaacugcgccuccgaggaggucaucugggagguccucaacgccaucggccccugguccgcccucgccggcuucgccgacguccucucccgccucgcccucugggaguccgagggccccgaggccuucugcgaggaguccggccuccgcuccgccgagggcuccguccucgaccucgccaacccccagggccucgccggccaccgccaggaggacggccgccgcggccucaccgaggccuccccccagcagaagaagggcggcgaggacgaggacaugcccgccgccggcaugcccccccucccccaguccccccccgagauccccccccagggcccccccaagaucuccccccagggccccccccagucccccccccaguccccccucgacuccugcuccuccccccuccucuggacccgccucgacgaggaguccuccuccgaggaggaggacaccgccaccuggcacgcccuccccgaguccgagucccucccccgcuacgcccucgacgagaaggucgccgagcucguccaguuccuccuccucaaguaccagaccaaggagcccgucaccaaggccgagaugcucaccaccgucaucaagaaguacaaggacuacuuccccaugaucuucggcaaggcccacgaguucaucgagcucaucuucggcaucgcccucaccgacauggaccccgacaaccacuccuacuucuucgaggacacccucgaccucaccuacgagggcucccucaucgacgaccagggcaugcccaagaacugccuccucauccucauccucuccaugaucuucaucaagggcuccugcguccccgaggaggucaucugggagguccucuccgccaucggccccauccagcgccccgcccgcgagguccucgaguuccucuccaagcucuccuccaucauccccuccgccuuccccuccugguacauggacgcccucaaggacauggaggaccgcgcccaggccaucaucgacaccaccgacgacgccaccgccauggccuccgccucccccuccgucauguccaccaacuucugccccgaguga

SEQ ID NO: 2362 - RNA, 1932 nt, Artificial Sequence
  derived and/or modified sequence opt3 from MAGE-C3__Homo_sapiens__AAM08355
augcugcuccccugccacugggugcuugacgccaccuucagcgauggcucccuggggcagugggucaagaacacaugugcuacuuacgcauugucuccuguuguguuaccaccgcaaccccagccucggaaaaaggccacggacaaagauuauucagcguuucaucugggacaccuaagggagguaagacucuuccugcgcgguggcaccagugaccagcgaauggauagccuugugcugugcccaacauacuuuaaguuguggcguacucucuccgggucucccggacugcagcugucggaccuccauuucggcucacaaccugaagguaaauuuagcuuaagaagggcugucagugugaagcagcgggaggaaccacaggauuggccccugaaugagaagcgcacccuuuggaaagacuccgauuugccuacauggagaagggggaccggauauacucugucucuaccagccguuagcccgggcaagcggcucuggggcgaaaaagcagggucccugcccgagucagagccucuuuucacauacacccuggacgaaaagguggauaaauugguccaguuucuccuguuaaaguaucaagccaaggagccacugacgcgcgcugaaaugcagaugaacgugaucaauacuuacaccggauauuuccccaugauuuuucgaaaagcaagagaguucauagagauccucuuugguauuagucuuacagaaguagacccugaucacuucuacguuuuugugaacacucuggacuugaccugugagggcagccuaucugacgaacaggggaugccacagaauaggcugcucauccugauucuuuccgucaucuucauaaagggaaacugcgccucagaggaagugaucugggaggugcugaaugcuauuggccccuggagcgccuuggcggguuucgcagauguccucagucggcuggccuuaugggagucugaagggccggaggcuuuuugugaagaguccggacugcguagcgccgaaggcucgguucuagaccucgcaaacccucaaggccuggcugggcaucgccaggaggauggaagaaggggucuuacagaggccucuccccagcagaaaaagggcggggaagacgaggauaugccagcggccggaaugccucccuugccacaaucacccccugaaaucccaccgcagggcccucccaaaauuuccccacagggucccccucaaaguccaccccagagcccgcuggacuccugcucuagcccucuccuguggacccggcuugaugaggaaucaaguuccgaggaggaagacacggcaacuuggcacgcucugccagagagcgaaucuuugccccgauacgcccucgaugagaagguggcugagcugguacaguucuuacugcuaaaauaucagacaaaggaaccugugaccaaggccgagaugcucacuacagucaucaaaaaguacaaagacuauuuucccaugauauucgggaaggcacacgaauuuauugagcugaucuucggcauugcccuuaccgauauggacccagacaaucauucauacuuuuucgaagauacguuggaccugaccuaugagggaagucucaucgaugaccaaggcaugccuaaaaacugucuguuaauccugauucuuagcaugauauuuaucaagggguccugcgugcccgaggaaguuauuugggagguguugucugcuaucggaccaauacagcgcccggcgagagaaguccucgaguuccugucgaagcuaagcuccauuaucccuucagcauuucccaguugguacauggaugcccugaaagacauggaagauagggcucaggccaucauugacacaacugaugacgcaaccgccauggcuucugccagcccauccgugaugucaacaaauuucugucccgaguga

SEQ ID NO: 2363 - RNA, 1932 nt, Artificial Sequence
  derived and/or modified sequence opt4 from MAGE-C3__Homo_sapiens__AAM08355
augcugcugcccugccacugggugcuggacgccaccuucagcgacggcagccugggccagugggugaagaacaccugcgccaccuacgcccugagccccguggugcugcccccccagccccagcccagaaagaaggccaccgacaaggacuacagcgccuuccaccugggccaccugagagaggugagacuguuccugagaggcggcaccagcgaccagagaauggacagccuggugcugugccccaccuacuucaagcuguggagaacccugagcggcagccccggccugcagcugagcgaccugcacuucggcagccagcccgagggcaaguucagccugagaagagccgugagcgugaagcagagagaggagccccaggacuggccccugaacgagaagagaacccuguggaaggacagcgaccugcccaccuggagaagaggcaccggcuacacccugagccugcccgccgugagccccggcaagagacuguggggcgagaaggccggcagccugcccgagagcgagccccuguucaccuacacccuggacgagaagguggacaagcuggugcaguuccugcugcugaaguaccaggccaaggagccccugaccagagccgagaugcagaugaacgugaucaacaccuacaccggcuacuuccccaugaucuucagaaaggccagagaguucaucgagauccuguucggcaucagccugaccgagguggaccccgaccacuucuacguguucgugaacacccuggaccugaccugcgagggcagccugagcgacgagcagggcaugccccagaacagacugcugauccugauccugagcgugaucuucaucaagggcaacugcgccagcgaggaggugaucugggaggugcugaacgccaucggccccuggagcgcccuggccggcuucgccgacgugcugagcagacuggcccugugggagagcgagggccccgaggccuucugcgaggagagcggccugagaagcgccgagggcagcgugcuggaccuggccaacccccagggccuggccggccacagacaggaggacggcagaagaggccugaccgaggccagcccccagcagaagaagggcggcgaggacgaggacaugcccgccgccggcaugcccccccugccccagagcccccccgagauccccccccagggcccccccaagaucagcccccagggccccccccagagccccccccagagcccccuggacagcugcagcagcccccugcuguggaccagacuggacgaggagagcagcagcgaggaggaggacaccgccaccuggcacgcccugcccgagagcgagagccugcccagauacgcccuggacgagaagguggccgagcuggugcaguuccugcugcugaaguaccagaccaaggagcccgugaccaaggccgagaugcugaccaccgugaucaagaaguacaaggacuacuuccccaugaucuucggcaaggcccacgaguucaucgagcugaucuucggcaucgcccugaccgacauggaccccgacaaccacagcuacuucuucgaggacacccuggaccugaccuacgagggcagccugaucgacgaccagggcaugcccaagaacugccugcugauccugauccugagcaugaucuucaucaagggcagcugcgugcccgaggaggugaucugggaggugcugagcgccaucggccccauccagagacccgccagagaggugcuggaguuccugagcaagcugagcagcaucauccccagcgccuuccccagcugguacauggacgcccugaaggacauggaggacagagcccaggccaucaucgacaccaccgacgacgccaccgccauggccagcgccagccccagcgugaugagcaccaacuucugccccgaguga

SEQ ID NO: 2364 - RNA, 1932 nt, Artificial Sequence
  derived and/or modified sequence opt5 from MAGE-C3__Homo_sapiens__AAM08355
augcugcuccccugccacugggugcuggacgccaccuucagcgauggcucccuugggcagugggucaagaacacaugugcuacguacgcccugucuccuguugugcucccgccccaaccucagccccggaaaaaggcgaccgacaaagauuauagcgcuuuucaucugggacaccuuagagaggugcgccuguuccucagaggcgggacauccgaccagcggauggauucucugguccugugcccuaccuacuuuaagcucuggcgcacacugagcggaucccccggccuucagcugucugaccuccauuucgggagccaaccugaaggaaaauuuucccugagacgggccgugagcguuaagcagcgcgaggaaccgcaggauuggccccuuaaugagaagagaacccuguggaaagacucugaucucccuacauggcggcgcggcaccggcuauacgcugucccugcccgccgugagcccugggaagagacucuggggagaaaaagcuggcucucugcccgaguccgagccgcuuuucaccuacacacuggacgaaaaggucgauaaacucgugcaguuucugcuucugaaguaucaagccaaggagccucucacccgggcugaaaugcagaugaacguuaucaauacauacaccggguauuuccccaugauuuuucgcaaagccagagaguucaucgagauucuguuuggaaucagccugacggaaguggacccugaucacuucuacgucuuugugaacacacucgaccugaccugugagggcucucuuuccgacgaacaggggaugccccagaaucggcugcucauucugauccuuagcgugaucuucauuaagggaaacugcgcguccgaggaagucaucugggagguucugaaugccauuggccccuggucugcucucgccggcuucgcugaugugcugagccgccuggcccucugggaguccgaagggccugaggcguuuugugaagagagcggacugagaucugccgaaggcuccgugcuugaccuggcuaacccgcaagggcucgccggacaucggcaggaggauggcagacgcgggcugacagaggcuagcccccagcagaaaaagggaggcgaagacgaggauaugccugccgccggcaugcccccucugccccaaucuccgccugaaauucccccucaggggcccccuaaaaucagcccccagggaccgccucaauccccuccccagucuccccuugacagcugcuccagcccgcuccuguggacccggcuggaugaggaaucuuccagcgaggaggaagacaccgcuacauggcacgcgcuccccgagucugaaucccugccuagauacgcccuugaugagaaggucgcugagcuggugcaguuccuccugcugaaauaucagacgaaggaacccguuaccaaggccgagaugcuuacaaccgugaucaaaaaguacaaagacuauuuuccuaugauuuucggcaaggcccacgaauuuaucgagcucaucuucgggauugcucugacagauauggaccccgacaaucauagcuacuuuuucgaagauacccuggaccucacguaugagggaucccugaucgaugaccaaggcaugccuaaaaacugucuucugauucucauccugucuaugauuuuuaucaaggggagcugcguccccgaggaagugaucugggagguucuguccgccauuggcccgauccagcgcccugcgcgggaagugcuugaguuccucucuaagcugagcuccauuauccccagcgcuuuuccuucuugguacauggaugcccugaaagacauggaagauagagcccaggcuauuaucgacacaaccgaugacgccaccgcuauggccuccgcgagccccucugucauguccacaaauuucuguccggaguga

SEQ ID NO: 2365 - protein, 778 aa, Artificial Sequence
  MAGE-D1__Homo_sapiens__Q9Y5V3
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 2366 - RNA, 2337 nt, Artificial Sequence
  MAGE-D1__Homo_sapiens__AAG23757
auggcucagaaaauggacuguggugcgggccuccucggcuuccaggcugaggccuccguagaagacagcgccuugcuuaugcagaccuugauggaggccauccagaucucagaggcuccaccuacuaaccaggccaccgcagcugcuaguccccagaguucacagcccccaacugccaaugagauggcugacauucagguuucagcagcugccgcuaggccuaagucagccuuuaaaguccagaaugccaccacaaaaggcccaaauggugucuaugauuucucucaggcucauaaugccaaggaugugcccaacacgcagcccaaggcagccuuuaagucccaaaaugcuaccccaaaggguccaaaugcugccuaugauuuuucccaggcagcaaccacuggugaguuagcugcuaacaagucugagauggccuucaaggcccagaaugccacuacuaaagugggcccaaaugccaccuacaauuucucucagucucucaaugccaaugaccuggccaacagcaggccuaagaccccuuucaaggcuuggaaugauaccacuaaggccccaacagcugauacccagacccagaauguaaaucaggccaaaauggccacuucccaggcugacauagagaccgacccagguaucucugaaccugacggugcaacugcacagacaucagcagaugguucccaggcucagaaucuggagucccggacaauaauucggggcaagaggacccgcaagauuaauaacuugaauguugaagagaacagcaguggggaucagaggcgggccccacuggcugcagggaccuggaggucugcaccaguuccagugaccacucagaacccaccuggcgcaccccccaaugugcucuggcagacgccauuggcuuggcagaaccccucaggcuggcaaaaccagacagccaggcagaccccaccagcacgucagagcccuccagcuaggcagaccccaccagccuggcagaacccagucgcuuggcagaacccagugauuuggccaaacccaguaaucuggcagaacccagugaucuggccaaaccccauugucuggcccggcccuguugucuggccgaauccacuggccuggcagaauccaccuggauggcagacuccaccuggauggcagaccccaccgggcuggcaggguccuccagacuggcaagguccuccugacuggccgcuaccacccgacuggccacugccaccugauuggccacuucccacugacuggccacuaccaccugacuggauccccgcugauuggccaauuccaccugacuggcagaaccugcgccccucgccuaaccugcgcccuucucccaacucgcgugccucacagaacccaggugcugcacagccccgagauguggcccuucuucaggaaagagcaaauaaguuggucaaguacuugaugcuuaaggacuacacaaaggugcccaucaagcgcucagaaaugcugagagauaucauccgugaauacacugauguuuauccagaaaucauugaacgugcaugcuuuguccuagagaagaaauuugggauucaacugaaagaaauugacaaagaagaacaccuguauauucucaucaguacccccgagucccuggcuggcauacugggaacgaccaaagacacacccaagcucggucuccucuuggugauucugggugucaucuucaugaauggcaaccgugccagugaggcuguccucugggaggcacuacgcaagaugggacugcguccuggggugagacauccccuccuuggagaucuaaggaaacuucucaccuaugaguuuguaaagcagaaauaccuggacuacagacgagugcccaacagcaaccccccggaguaugaguuccucuggggccuccguuccuaccaugagacuagcaagaugaaagugcugagauucauugcagagguucagaaaagagacccucgugacuggacugcacaguucauggaggcugcagaugaggccuuggaugcucuggaugcugcugcagcugaggccgaagccagggcugaagcaagaacccgcaugggaauuggagaugaggcugugucugggcccuggagcugggaugacauugaguuugagcugcugaccugggaugaggaaggagauuuuggagaucccugguccagaauuccauuuaccuucugggccagauaccaccagaaugcccgcuccagauucccucagaccuuugccggucccauuauugguccuggugguacagccagugccaacuucgcugccaacuuuggugccauugguuucuucuggguugaguga

SEQ ID NO: 2367 - RNA, 2337 nt, Artificial Sequence
  derived and/or modified sequence opt1 from MAGE-D1__Homo_sapiens__AAG23757
auggcccagaagauggacugcggcgccgggcugcucggcuuccaggcggaggccagcguggaggacuccgcccugcugaugcagacccucauggaggccauccagaucagcgaggcccccccgaccaaccaggcgacggccgccgccuccccccagagcucccagccccccaccgcgaacgagauggccgacauccaggucagcgccgccgccgcgcgcccgaaguccgccuucaaggugcagaacgccaccaccaaggggcccaacggcguguacgacuucagccaggcccacaacgccaaggacguccccaacacgcagcccaaggcggccuucaagucccagaacgccaccccgaaggggcccaacgccgccuacgacuucagccaggcggccaccaccggcgagcuggccgccaacaaguccgagauggccuucaaggcgcagaacgccacgaccaaggugggccccaacgccaccuacaacuucagccagucccugaacgccaacgaccucgcgaacagccggcccaagaccccguucaaggccuggaacgacacgaccaaggcccccaccgccgacacccagacgcagaacgugaaccaggccaagauggcgaccucccaggccgacaucgagaccgaccccgggaucagcgagcccgacggcgccaccgcccagacguccgccgacgggagccaggcgcagaaccuggagucccgcaccaucauccggggcaagcgcacccggaagaucaacaaccugaacgucgaggagaacagcagcggggaccagcgccgggccccgcucgccgccggcaccuggcgcuccgcccccgugcccgugacgacccagaaccccccgggcgcgccccccaacguccuguggcagaccccccuggccuggcagaacccgagcggguggcagaaccagaccgcccggcagacgccccccgcccgccagucccccccggcgcggcagaccccccccgccuggcagaacccgguggccuggcagaaccccgugaucuggcccaaccccgucaucuggcagaacccggugaucuggcccaaccccaucguguggcccggcccggucguguggcccaacccccucgccuggcagaaccccccgggguggcagaccccccccggcuggcagacccccccgggcuggcaggggccccccgacuggcagggccccccggacuggccccugccccccgacuggccgcugccccccgacuggccgcuccccacggacuggccccugcccccggacuggauccccgccgacuggcccauccccccggacuggcagaaccugcgccccagccccaaccuccggcccuccccgaacagccgcgcgucccagaaccccggggccgcccagccccgggacguggcccugcugcaggagcgcgccaacaagcucgucaaguaccugaugcugaaggacuacaccaaggugcccaucaagcggagcgagaugcuccgcgacaucauccgggaguacaccgacguguacccggagaucaucgagcgcgcgugcuucguccuggagaagaaguucggcauccagcugaaggagaucgacaaggaggagcaccucuacauccugaucuccacccccgagagccuggccgggauccucggcacgaccaaggacacccccaagcugggccugcuccuggugauccugggggugaucuucaugaacggcaaccgggccuccgaggccguccucugggaggcccugcgcaagauggggcugcgccccggcgugcggcacccgcuccugggggaccugcgcaagcuccugaccuacgaguucgucaagcagaaguaccuggacuaccggcgcgugcccaacagcaacccccccgaguacgaguuccucuggggccugcgguccuaccacgagaccagcaagaugaaggugcugcgcuucaucgcggagguccagaagcgggacccgcgcgacuggacggcccaguucauggaggccgccgacgaggcgcucgacgcccuggacgccgccgccgcggaggccgaggcccgggccgaggcccgcacccggaugggcaucggggacgaggcgguguccggccccuggagcugggacgacaucgaguucgagcugcugaccugggacgaggagggggacuucggcgaccccuggucccgcauccccuucaccuucugggcccgguaccaccagaacgcccgcagccgguucccgcagacguucgccgggcccaucaucggccccggcgggaccgccuccgcgaacuucgccgccaacuucggcgccaucggguucuucuggguggaguga

SEQ ID NO: 2368 - RNA, 2337 nt, Artificial Sequence
  derived and/or modified sequence opt2 from MAGE-D1__Homo_sapiens__AAG23757
auggcccagaagauggacugcggcgccggccuccucggcuuccaggccgaggccuccgucgaggacuccgcccuccucaugcagacccucauggaggccauccagaucuccgaggccccccccaccaaccaggccaccgccgccgccuccccccaguccucccagccccccaccgccaacgagauggccgacauccaggucuccgccgccgccgcccgccccaaguccgccuucaagguccagaacgccaccaccaagggccccaacggcgucuacgacuucucccaggcccacaacgccaaggacguccccaacacccagcccaaggccgccuucaagucccagaacgccacccccaagggccccaacgccgccuacgacuucucccaggccgccaccaccggcgagcucgccgccaacaaguccgagauggccuucaaggcccagaacgccaccaccaaggucggccccaacgccaccuacaacuucucccagucccucaacgccaacgaccucgccaacucccgccccaagacccccuucaaggccuggaacgacaccaccaaggcccccaccgccgacacccagacccagaacgucaaccaggccaagauggccaccucccaggccgacaucgagaccgaccccggcaucuccgagcccgacggcgccaccgcccagaccuccgccgacggcucccaggcccagaaccucgagucccgcaccaucauccgcggcaagcgcacccgcaagaucaacaaccucaacgucgaggagaacuccuccggcgaccagcgccgcgccccccucgccgccggcaccuggcgcuccgcccccguccccgucaccacccagaacccccccggcgccccccccaacguccucuggcagaccccccucgccuggcagaaccccuccggcuggcagaaccagaccgcccgccagaccccccccgcccgccaguccccccccgcccgccagaccccccccgccuggcagaaccccgucgccuggcagaaccccgucaucuggcccaaccccgucaucuggcagaaccccgucaucuggcccaaccccaucgucuggcccggccccgucgucuggcccaacccccucgccuggcagaacccccccggcuggcagaccccccccggcuggcagaccccccccggcuggcagggcccccccgacuggcagggcccccccgacuggccccucccccccgacuggccccucccccccgacuggccccuccccaccgacuggccccucccccccgacuggauccccgccgacuggcccaucccccccgacuggcagaaccuccgccccucccccaaccuccgccccucccccaacucccgcgccucccagaaccccggcgccgcccagccccgcgacgucgcccuccuccaggagcgcgccaacaagcucgucaaguaccucaugcucaaggacuacaccaagguccccaucaagcgcuccgagaugcuccgcgacaucauccgcgaguacaccgacgucuaccccgagaucaucgagcgcgccugcuucguccucgagaagaaguucggcauccagcucaaggagaucgacaaggaggagcaccucuacauccucaucuccacccccgagucccucgccggcauccucggcaccaccaaggacacccccaagcucggccuccuccucgucauccucggcgucaucuucaugaacggcaaccgcgccuccgaggccguccucugggaggcccuccgcaagaugggccuccgccccggcguccgccacccccuccucggcgaccuccgcaagcuccucaccuacgaguucgucaagcagaaguaccucgacuaccgccgcguccccaacuccaacccccccgaguacgaguuccucuggggccuccgcuccuaccacgagaccuccaagaugaagguccuccgcuucaucgccgagguccagaagcgcgacccccgcgacuggaccgcccaguucauggaggccgccgacgaggcccucgacgcccucgacgccgccgccgccgaggccgaggcccgcgccgaggcccgcacccgcaugggcaucggcgacgaggccgucuccggccccugguccugggacgacaucgaguucgagcuccucaccugggacgaggagggcgacuucggcgaccccuggucccgcauccccuucaccuucugggcccgcuaccaccagaacgcccgcucccgcuucccccagaccuucgccggccccaucaucggccccggcggcaccgccuccgccaacuucgccgccaacuucggcgccaucggcuucuucugggucgaguga

SEQ ID NO: 2369 - RNA, 2337 nt, Artificial Sequence
  derived and/or modified sequence opt3 from MAGE-D1__Homo_sapiens__AAG23757
auggcccagaagauggacugcggcgcugggcugcucggauuccaagcagaggccagcguggaagauuccgcgcuucugaugcagaccuugauggaggcuauccagauuucugaagcacccccuacaaaccaggccacugccgcugcaucaccacaaaguagccagccgcccacggccaaugagauggcugacauacaggucuccgccgcggcagccagaccuaaaucugcuuuuaagguucagaacgccaccacaaaagguccaaauggcguguacgauuucucgcaagcacacaacgcuaaggacguacccaauacucagccuaaagccgcguuuaagucacagaacgccaccccaaaggggcccaaugcagcuuaugauuucagccaggccgcuacaaccggagaauuagccgcaaacaaaagugagauggccuuuaaggcucaaaaugcgacuacaaaagugggcccuaacgcaaccuacaauuucucccagucucugaacgccaaugaccuagcuaacagcaggccaaagacgccguuuaaagccuggaaugauacuaccaaggcacccacagccgacacucagacccaaaacgucaaccaggcuaagauggccacaucccaggcagauaucgagaccgacccugguauuucagaaccagauggggcgacggcucagacaagugccgacggaagccaagcacagaaucucgagucucggacuaucauucgcggcaaacgaacccguaagaucaacaaucugaacguggaagaaaauuccucaggcgaucagagaagggcuccccuugccgccgggacuuggcggagcgcaccuguuccagugacaacccagaaucccccgggagcuccucccaacguccuguggcaaacgccauuggccuggcagaacccuagugguuggcagaaucagaccgcgcgccaaacacccccagccagacagucucccccugcuaggcagacuccaccggcauggcagaaccccguggccuggcaaaauccuguaauauggccaaaccccguuaucuggcagaauccugugauuuggccaaaccccaucgucuggccgggcccugugguguggccaaauccccucgcuuggcagaacccucccggguggcaaaccccaccuggauggcagacacccccaggcuggcaggguccgccugacuggcaggggcccccagacuggccccugccuccagauuggccccugccuccggacuggccacuccccacugauuggccuuuaccacccgacuggauuccugccgauuggccgauacccccagacuggcaaaaccugcggccuucccccaaucuucgcccaagcccuaacucgcgagcaucucagaaucccggagcggcccagccaagagaugucgcuuugcugcaggagagggccaacaagcuaguuaaauaucucaugcugaaagacuacaccaaggugccgaucaaacgguccgagaugcuucgugauauuauccgcgaguauacagacguauacccugaaauuaucgagagagcauguuucgugcuggaaaagaaguuuggcauccaauugaaagagauugauaaggaggaacaucucuauauacugaucucaacccccgagaguuuagcuggcauucuggggacuacgaaagacacaccaaagcucggacuucuguuggucauccuaggugugauauucaugaauggcaacagggccagcgaagcaguucugugggaggcccuccggaaaauggggcugcgacccggagugcgccacccucuucugggcgacuugagaaagcuccugaccuacgaauuugucaagcagaaauacuuagauuauaggcgggugccaaauuccaaucccccugaguacgaguuccuguggggucuacgcucuuaucaugaaacuagcaagaugaaaguacucagauuuauugcugagguucagaagagggacccgcgugauuggaccgcgcaguucauggaagccgcagacgaggcucuggaugcccuugacgccgcugcagccgaagcggaggcucgggccgaggcacgaacaagaauggggaucggcgaugaagccgugucaggaccauggaguugggacgauaucgaguucgaauugcugaccugggacgaggagggcgauuuuggggaccccugguccaggauuccuuucacuuuuugggcucgcuaccaccaaaacgcacggagcagauucccccagacauuugccggaccaaucauugguccuggcgggacggcgucugcuaacuucgccgcaaauuuuggagccauaggcuucuuuugggucgaauga

SEQ ID NO: 2370 - RNA, 2337 nt, Artificial Sequence
  derived and/or modified sequence opt4 from MAGE-D1__Homo_sapiens__AAG23757
auggcccagaagauggacugcggcgccggccugcugggcuuccaggccgaggccagcguggaggacagcgcccugcugaugcagacccugauggaggccauccagaucagcgaggccccccccaccaaccaggccaccgccgccgccagcccccagagcagccagccccccaccgccaacgagauggccgacauccaggugagcgccgccgccgccagacccaagagcgccuucaaggugcagaacgccaccaccaagggccccaacggcguguacgacuucagccaggcccacaacgccaaggacgugcccaacacccagcccaaggccgccuucaagagccagaacgccacccccaagggccccaacgccgccuacgacuucagccaggccgccaccaccggcgagcuggccgccaacaagagcgagauggccuucaaggcccagaacgccaccaccaaggugggccccaacgccaccuacaacuucagccagagccugaacgccaacgaccuggccaacagcagacccaagacccccuucaaggccuggaacgacaccaccaaggcccccaccgccgacacccagacccagaacgugaaccaggccaagauggccaccagccaggccgacaucgagaccgaccccggcaucagcgagcccgacggcgccaccgcccagaccagcgccgacggcagccaggcccagaaccuggagagcagaaccaucaucagaggcaagagaaccagaaagaucaacaaccugaacguggaggagaacagcagcggcgaccagagaagagccccccuggccgccggcaccuggagaagcgcccccgugcccgugaccacccagaacccccccggcgccccccccaacgugcuguggcagaccccccuggccuggcagaaccccagcggcuggcagaaccagaccgccagacagaccccccccgccagacagagcccccccgccagacagaccccccccgccuggcagaaccccguggccuggcagaaccccgugaucuggcccaaccccgugaucuggcagaaccccgugaucuggcccaaccccaucguguggcccggccccgugguguggcccaacccccuggccuggcagaacccccccggcuggcagaccccccccggcuggcagaccccccccggcuggcagggcccccccgacuggcagggcccccccgacuggccccugccccccgacuggccccugccccccgacuggccccugcccaccgacuggccccugccccccgacuggauccccgccgacuggcccaucccccccgacuggcagaaccugagacccagccccaaccugagacccagccccaacagcagagccagccagaaccccggcgccgcccagcccagagacguggcccugcugcaggagagagccaacaagcuggugaaguaccugaugcugaaggacuacaccaaggugcccaucaagagaagcgagaugcugagagacaucaucagagaguacaccgacguguaccccgagaucaucgagagagccugcuucgugcuggagaagaaguucggcauccagcugaaggagaucgacaaggaggagcaccuguacauccugaucagcacccccgagagccuggccggcauccugggcaccaccaaggacacccccaagcugggccugcugcuggugauccugggcgugaucuucaugaacggcaacagagccagcgaggccgugcugugggaggcccugagaaagaugggccugagacccggcgugagacacccccugcugggcgaccugagaaagcugcugaccuacgaguucgugaagcagaaguaccuggacuacagaagagugcccaacagcaacccccccgaguacgaguuccuguggggccugagaagcuaccacgagaccagcaagaugaaggugcugagauucaucgccgaggugcagaagagagaccccagagacuggaccgcccaguucauggaggccgccgacgaggcccuggacgcccuggacgccgccgccgccgaggccgaggccagagccgaggccagaaccagaaugggcaucggcgacgaggccgugagcggccccuggagcugggacgacaucgaguucgagcugcugaccugggacgaggagggcgacuucggcgaccccuggagcagaauccccuucaccuucugggccagauaccaccagaacgccagaagcagauucccccagaccuucgccggccccaucaucggccccggcggcaccgccagcgccaacuucgccgccaacuucggcgccaucggcuucuucuggguggaguga

SEQ ID NO: 2371 - RNA, 2337 nt, Artificial Sequence
  derived and/or modified sequence opt5 from MAGE-D1__Homo_sapiens__AAG23757
auggcccagaagauggacugcggcgcugggcugcucggauuccaagccgaggcgagcguggaagauuccgcucugcuuaugcagacccugauggaggccauccagauuucugaagcucccccuacaaaccaggcuacggccgcugccagcccgcaauccucucagcccccuaccgcgaaugagauggccgacauccaggucagcgcugccgcugccagacccaaauccgcguuuaagguucagaacgccacaaccaaaggcccuaaugggguguacgauuucucucaagcucacaacgccaaggacgugcccaauacacagccuaaagcugccuuuaagagccagaacgccaccccgaagggacccaaugcugcguaugauuucucccaggccgcuacaaccggcgaacucgccgccaacaaaagcgagauggcuuuuaaggcccaaaaugcgacgaccaaagucgggccuaacgcuacauacaauuucucucagucccugaacgccaaugaccuugccaacagccggcccaagaccccuuuuaaagccuggaaugauacaaccaaggcccccacggcugacacacagacccaaaacgugaaccaggccaagauggcgacaucucaggccgauauugagaccgacccgggaaucuccgaaccugauggcgcuaccgcccagacaagcgcugacggcucucaagcccagaaucuggagucccgcacgauuaucagagggaaacggacccgcaagaucaacaaucucaacguugaagagaauagcuccggagaucagagacgggcgccccuggccgcuggcacauggcgcucugccccugugcccgucaccacacagaaucccccuggggcuccgcccaacgugcuguggcaaaccccucucgccuggcagaaccccagcggauggcagaaucagacggccagacaaacaccucccgcucggcaguccccgccugcgcgccagaccccucccgccuggcagaaccccguugcuuggcaaaauccugugauuuggcccaacccggucaucuggcagaauccugugauuuggcccaaccccaucguguggccuggcccggucguuuggcccaauccucuggccuggcagaaucccccuggguggcaaaccccucccggauggcagacacccccgggcuggcagggcccucccgacuggcaggggccucccgacuggccgcuuccucccgauuggccucugccucccgacuggccccucccgaccgauuggccccugccucccgacuggauuccugccgauuggcccaucccuccggacuggcaaaaccuuagacccagcccuaaccugcggcccucuccuaacucccgcgcuagccagaaucccggagccgcgcagccgagagauguggcucuccugcaggagcgggccaacaaacuggugaaguaucucaugcugaaagacuacacaaaggucccuauuaaacgcucugaaaugcuuagagauaucauccgggaguauacggacguguaccccgaaauuaucgagagagccuguuucguucuggaaaagaaguuuggcauucaacucaaagagaucgauaaggaggaacaucuguauauucuuaucagcacccccgagucccuggcugggauccucggaacaaccaaagacacaccuaagcugggccugcuccuggugauucuuggggucaucuucaugaauggaaaccgcgccucugaagcggugcugugggaggcucuccggaaaaugggccugagacccggcguucgccacccucuucugggggaccuccggaagcugcugaccuacgaauuugugaagcagaaauaccucgauuauagacgcgucccgaauagcaaucccccugaguacgaguuccuguggggacuucgguccuaucaugaaacgagcaagaugaaagugcugagauuuauugccgagguccagaagcgcgacccccgggauuggaccgcccaguucauggaagcugccgacgaggcucucgaugcccuggacgcggccgcugccgaagcugaggccagagccgaggcucgcacacggaugggcaucggggaugaagcggugucuggaccuugguccugggacgauauugaguucgaacugcuuaccugggacgaggagggcgauuuuggggaccccuggagcagaaucccguucacauuuugggcccgguaccaccaaaacgcucgcucuagauucccucagaccuuugccggccccaucauuggaccuggcgggacggccuccgcuaacuucgccgcgaauuuuggagcuaucggcuucuuuuggguugaauga

SEQ ID NO: 2372 - protein, 606 aa, Artificial Sequence
  MAGE-D2__Homo_sapiens__Q9UNF1
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 2373 - RNA, 1821 nt, Artificial Sequence
  MAGE-D2__Homo_sapiens__AAD28598
augucugacacaagcgagaguggugcaggucuaacucgcuuccaggcugaagcuucagaaaaggacaguagcucgaugaugcagacucuguugacagugacccagaauguggaggucccagagacaccgaaggccucaaaggcacuggaggucucagaggaugugaaggucucaaaagccucuggggucucaaaggccacagaggucucaaagaccccagaggcucgggaggcaccugccacccaggccucgucuacuacucagcugacugauacccagguucuggcagcugaaaacaagagucuagcagcugacaccaagaaacagaaugcugacccgcaggcugugacaaugccugccacugagaccaaaaaggucagccauguggcugauacgaaggucaauacaaaggcucaggagacugaggcugcacccucucaggccccagcagaugaaccugagccugagagugcagcugcccagucucaggagaaucaggauacucggcccaaggucaaagccaagaaagcccgaaaggugaagcaucuggauggggaagaggauggcagcagugaucagagucaggcuucuggaaccacagguggccgaagggucucaaaggcucuaauggccucaauggcccgcagggcuucaaggggucccauagccuuuugggcccgcagggcaucaaggacucgguuggcugcuugggcccggagagccuugcucucccugagaucaccuaaagcccguaggggcaaggcucgccguagagcugccaagcuccagucaucccaagagccugaagcaccaccaccucgggauguggcccuuuugcaagggagggcaaaugauuuggugaaguaccuuuuggcuaaagaccagacgaagauucccaucaagcgcucggacaugcugaaggacaucaucaaagaauacacugauguguaccccgaaaucauugaacgagcaggcuauucuuuggagaagguauuugggauucaauugaaggaaauugauaagaaugaccacuuguacauucuucucagcaccuuagagcccacugaugcaggcauacugggaacgacuaaggacucacccaagcugggucugcucauggugcuucuuagcaucaucuucaugaauggaaaucgguccagugaggcugucaucugggaggugcugcgcaaguuggggcugcgcccugggauacaucauucacucuuuggggacgugaagaagcucaucacugaugaguuugugaagcagaaguaccuggacuaugccagaguccccaauagcaaucccccugaauaugaguucuucuggggccugcgcucuuacuaugagaccagcaagaugaaaguccucaaguuugccugcaagguacaaaagaaggaucccaaggaaugggcagcucaguaccgagaggcgauggaagcggauuugaaggcugcagcugaggcugcagcugaagccaaggcuagggccgagauuagagcucgaaugggcauugggcucggcucggagaaugcugccgggcccugcaacugggacgaagcugauaucggacccugggccaaagcccggauccaggcgggagcagaagcuaaagccaaagcccaagagaguggcagugccagcacuggugccaguaccaguaccaauaacagugccagugccagugccagcaccagugguggcuucagugcuggugccagccugaccgccacucucacauuugggcucuucgcuggccuugguggagcuggugccagcaccaguggcagcucuggugccugugguuucuccuacaaguga

SEQ ID NO: 2374 - RNA, 1821 nt, Artificial Sequence
  derived and/or modified sequence opt1 from MAGE-D2__Homo_sapiens__AAD28598
augagcgacaccuccgagagcggcgccgggcugacccgcuuccaggccgaggcguccgagaaggacagcuccagcaugaugcagacgcugcugaccgugacccagaacgucgaggugcccgagaccccgaaggccuccaaggcccuggaggugagcgaggacgucaagguguccaaggccagcggcguguccaaggccacggaggucagcaagacccccgaggcgcgggaggcccccgccacccaggccuccagcaccacgcagcucaccgacacccaggugcuggcggccgagaacaagucccuggccgccgacaccaagaagcagaacgccgacccccaggcggugacgaugccggccaccgagaccaagaaggucagccacguggccgacaccaaggugaacacgaaggcccaggagaccgaggccgcgcccucccaggcccccgccgacgagcccgagccggagagcgccgccgcgcagucccaggagaaccaggacacccgccccaaggucaaggccaagaaggcccggaaggugaagcaccucgacggggaggaggacggcagcagcgaccagucccaggccagcgggaccacgggcggccgccggguguccaaggcccugauggcgagcauggcccgccgggccucccgcgggcccaucgccuucugggcgcggcgcgccagccggacccgccuggccgccugggcccggcgcgcgcuccugucccugcggagccccaaggcccgccggggcaaggcccgccggcgcgccgccaagcuccaguccagccaggagccggaggcgcccccgccccgggacgucgcccugcugcaggggcgcgccaacgaccucgugaaguaccugcuggccaaggaccagaccaagauccccaucaagcgcuccgacaugcucaaggacaucaucaaggaguacaccgacguguaccccgagaucaucgagcgggccggcuacagccuggagaaggucuucgggauccagcugaaggagaucgacaagaacgaccaccucuacauccugcuguccacgcucgagcccaccgacgcgggcauccugggcaccaccaaggacagccccaagcuggggcuccugauggugcugcucuccaucaucuucaugaacggcaaccgcagcuccgaggccgugaucugggagguccugcggaagcuggggcuccgcccgggcauccaccacagccuguucggcgacgugaagaagcugaucacggacgaguucgugaagcagaaguaccucgacuacgcccggguccccaacuccaacccgcccgaguacgaguucuucugggggcugcgcagcuacuacgagaccagcaagaugaaggugcugaaguucgccugcaagguccagaagaaggaccccaaggagugggcggcccaguaccgggaggccauggaggccgaccucaaggccgcggccgaggccgccgccgaggcgaaggcccgcgccgagauccgggcccgcaugggcaucgggcugggcuccgagaacgccgcggggcccugcaacugggacgaggccgacaucggccccugggccaaggcccggauccaggcgggcgccgaggccaaggccaaggcccaggagagcggguccgcgagcaccggcgccuccaccagcacgaacaacuccgccagcgccuccgccagcaccuccgggggcuucagcgcgggggccucccugaccgccacccucacguucggccuguucgccggccucgggggcgccggggcgagcaccuccggcagcuccggggccugcggcuucagcuacaaguga

SEQ ID NO: 2375 - RNA, 1821 nt, Artificial Sequence
  derived and/or modified sequence opt2 from MAGE-D2__Homo_sapiens__AAD28598
auguccgacaccuccgaguccggcgccggccucacccgcuuccaggccgaggccuccgagaaggacuccuccuccaugaugcagacccuccucaccgucacccagaacgucgagguccccgagacccccaaggccuccaaggcccucgaggucuccgaggacgucaaggucuccaaggccuccggcgucuccaaggccaccgaggucuccaagacccccgaggcccgcgaggcccccgccacccaggccuccuccaccacccagcucaccgacacccagguccucgccgccgagaacaagucccucgccgccgacaccaagaagcagaacgccgacccccaggccgucaccaugcccgccaccgagaccaagaaggucucccacgucgccgacaccaaggucaacaccaaggcccaggagaccgaggccgcccccucccaggcccccgccgacgagcccgagcccgaguccgccgccgcccagucccaggagaaccaggacacccgccccaaggucaaggccaagaaggcccgcaaggucaagcaccucgacggcgaggaggacggcuccuccgaccagucccaggccuccggcaccaccggcggccgccgcgucuccaaggcccucauggccuccauggcccgccgcgccucccgcggccccaucgccuucugggcccgccgcgccucccgcacccgccucgccgccugggcccgccgcgcccuccucucccuccgcucccccaaggcccgccgcggcaaggcccgccgccgcgccgccaagcuccaguccucccaggagcccgaggccccccccccccgcgacgucgcccuccuccagggccgcgccaacgaccucgucaaguaccuccucgccaaggaccagaccaagauccccaucaagcgcuccgacaugcucaaggacaucaucaaggaguacaccgacgucuaccccgagaucaucgagcgcgccggcuacucccucgagaaggucuucggcauccagcucaaggagaucgacaagaacgaccaccucuacauccuccucuccacccucgagcccaccgacgccggcauccucggcaccaccaaggacucccccaagcucggccuccucaugguccuccucuccaucaucuucaugaacggcaaccgcuccuccgaggccgucaucugggagguccuccgcaagcucggccuccgccccggcauccaccacucccucuucggcgacgucaagaagcucaucaccgacgaguucgucaagcagaaguaccucgacuacgcccgcguccccaacuccaacccccccgaguacgaguucuucuggggccuccgcuccuacuacgagaccuccaagaugaagguccucaaguucgccugcaagguccagaagaaggaccccaaggagugggccgcccaguaccgcgaggccauggaggccgaccucaaggccgccgccgaggccgccgccgaggccaaggcccgcgccgagauccgcgcccgcaugggcaucggccucggcuccgagaacgccgccggccccugcaacugggacgaggccgacaucggccccugggccaaggcccgcauccaggccggcgccgaggccaaggccaaggcccaggaguccggcuccgccuccaccggcgccuccaccuccaccaacaacuccgccuccgccuccgccuccaccuccggcggcuucuccgccggcgccucccucaccgccacccucaccuucggccucuucgccggccucggcggcgccggcgccuccaccuccggcuccuccggcgccugcggcuucuccuacaaguga

SEQ ID NO: 2376 - RNA, 1821 nt, Artificial Sequence
  derived and/or modified sequence opt3 from MAGE-D2__Homo_sapiens__AAD28598
augagcgacaccuccgagucuggcgccgggcugacaagauuccaggcugaagcaucagagaaggauaguagcuccaugaugcaaacucuccuuacggugacccagaacgucgaaguucccgagacaccuaaagccucuaaggcgcuggaagugucggaggacguaaaagugucaaaggcuagcggagucaguaaagccacugagguguccaagaccccagaagcaagggaggccccggcuacacaggcaucuagcaccacucaguugacagauacccaaguuuuagccgcugaaaauaagucccuggccgcggacacgaaaaagcagaacgcagauccccaggccgugacuaugccugcuaccgagacuaaaaaggucucacacguggccgacacuaaaguaaauaccaaggcacaggagacagaagcugccccaagucaagcgcccgccgaugagccugaaccagagagcgcagcugcccagucucaggaaaaccaggacacccggcccaagguuaaagcuaagaaagcccgcaaggugaaacaucuagauggugaggaggacggcuccucagaucaaagccaggcaagugggacgacuggaggccgacgugucucuaaggcccucauggcuuccauggcgagaagggcaagccgggguccuaucgccuuuugggcucgcagagccucgaggacacggcuggcagccugggcucgccgagcccuucugucuuugagauccccaaaagcaaggcgggggaaggcgcgucgcagagcugccaagcuccagucaagucaagaaccggaggcacccccuccaagggacguggcccugcugcagggacgggcuaaugaucucgugaaauacuuacuggccaaggaccagaccaaaauucccauaaagcgaagcgacaugcuuaaagauaucauuaaggaauauacugacgucuacccugagaucauugaacgcgcaggcuauuccuuggagaagguuuucggcauccagcugaaagagauagauaagaacgaccaccuauacauccuccugucuacacuugaaccaaccgaugcugggauucugggaacgaccaaagacagccccaaguugggucuccugaugguguuacugucaaucauuuuuaugaauggcaacagaaguuccgaggccguaaucugggaagugcucaggaaacuugggcugcggccgggaauacaucacagcuuguucggcgaugucaagaagcuaauuacagacgaguuugugaaacaaaaguaucuggauuacgcgcgcguuccuaauucuaaucccccagaauaugaguucuuuuggggucucagaucauacuacgagacaaguaaaaugaaggugcugaaauucgccugcaagguccagaagaaagacccuaaggaaugggcugcacaguauagggaggccauggaagcugaucuuaaagccgcagcggaggccgcugccgaggcaaaggcucgugccgaaauccgggcacgaauggggauuggacugggcagcgagaacgccgcuggccccuguaacugggacgaagcggacaucgggccaugggccaaagcaagaauccaggcuggagccgaggccaaggcuaaagcacaagaauccgguucugccucgaccggcgcgagcacauccacuaauaacucagcuagugccucugcaagcaccuccgggggauuuucagccggcgcuagcuugacagcaacccucacuuucggucuguuugccggguuaggcggagcgggcgcuucuacguccgggaguagcggagccugcgguuucucuuacaaguga

SEQ ID NO: 2377 - RNA, 1821 nt, Artificial Sequence
  derived and/or modified sequence opt4 from MAGE-D2__Homo_sapiens__AAD28598
augagcgacaccagcgagagcggcgccggccugaccagauuccaggccgaggccagcgagaaggacagcagcagcaugaugcagacccugcugaccgugacccagaacguggaggugcccgagacccccaaggccagcaaggcccuggaggugagcgaggacgugaaggugagcaaggccagcggcgugagcaaggccaccgaggugagcaagacccccgaggccagagaggcccccgccacccaggccagcagcaccacccagcugaccgacacccaggugcuggccgccgagaacaagagccuggccgccgacaccaagaagcagaacgccgacccccaggccgugaccaugcccgccaccgagaccaagaaggugagccacguggccgacaccaaggugaacaccaaggcccaggagaccgaggccgcccccagccaggcccccgccgacgagcccgagcccgagagcgccgccgcccagagccaggagaaccaggacaccagacccaaggugaaggccaagaaggccagaaaggugaagcaccuggacggcgaggaggacggcagcagcgaccagagccaggccagcggcaccaccggcggcagaagagugagcaaggcccugauggccagcauggccagaagagccagcagaggccccaucgccuucugggccagaagagccagcagaaccagacuggccgccugggccagaagagcccugcugagccugagaagccccaaggccagaagaggcaaggccagaagaagagccgccaagcugcagagcagccaggagcccgaggcccccccccccagagacguggcccugcugcagggcagagccaacgaccuggugaaguaccugcuggccaaggaccagaccaagauccccaucaagagaagcgacaugcugaaggacaucaucaaggaguacaccgacguguaccccgagaucaucgagagagccggcuacagccuggagaagguguucggcauccagcugaaggagaucgacaagaacgaccaccuguacauccugcugagcacccuggagcccaccgacgccggcauccugggcaccaccaaggacagccccaagcugggccugcugauggugcugcugagcaucaucuucaugaacggcaacagaagcagcgaggccgugaucugggaggugcugagaaagcugggccugagacccggcauccaccacagccuguucggcgacgugaagaagcugaucaccgacgaguucgugaagcagaaguaccuggacuacgccagagugcccaacagcaacccccccgaguacgaguucuucuggggccugagaagcuacuacgagaccagcaagaugaaggugcugaaguucgccugcaaggugcagaagaaggaccccaaggagugggccgcccaguacagagaggccauggaggccgaccugaaggccgccgccgaggccgccgccgaggccaaggccagagccgagaucagagccagaaugggcaucggccugggcagcgagaacgccgccggccccugcaacugggacgaggccgacaucggccccugggccaaggccagaauccaggccggcgccgaggccaaggccaaggcccaggagagcggcagcgccagcaccggcgccagcaccagcaccaacaacagcgccagcgccagcgccagcaccagcggcggcuucagcgccggcgccagccugaccgccacccugaccuucggccuguucgccggccugggcggcgccggcgccagcaccagcggcagcagcggcgccugcggcuucagcuacaaguga

SEQ ID NO: 2378 - RNA, 1821 nt, Artificial Sequence
  derived and/or modified sequence opt5 from MAGE-D2__Homo_sapiens__AAD28598
augagcgacaccuccgagucuggcgccgggcugacaagauuccaggcugaagccagcgagaaggauuccucuagcaugaugcaaacgcuccugaccgugacacagaacgucgaaguucccgagaccccuaaagcguccaaggcucuugaagugucugaggacgugaaagucagcaaggccuccggagugagcaaagccacagagguuucuaagaccccggaagcucgggaggcccccgcuacacaggccuccagcaccacgcagcugaccgauacacaagugcucgcggccgaaaauaagucucuggcugccgacaccaaaaagcagaacgcugauccucaggccgucacaaugcccgcgaccgagacgaaaaaggugucccacguugccgacacaaaagugaauaccaaggcucaggagacagaagccgcuccuagccaagcccccgccgaugagccugaaccggagucugcugcggcccagucccaggaaaaccaggacacccgccccaaggucaaagcuaagaaagccagaaaggugaaacaucuugauggcgaggaggacgggagcuccgaucaaucucaggccagcggaaccacaggcgggcggcgcguguccaaggcucugauggccagcauggcgagacgggcuucucgcggaccuaucgccuuuugggccagacgggcuucccgcacgagacucgccgcuugggcccggcgcgcgcugcugagccucagaucucccaaagcccggcgcggcaaggcuagacggagagccgcuaagcugcagagcucccaagaaccugaggccccgccgccucgcgacgucgcgcuucugcagggccgggccaaugaucucguuaaauaccugcuugcuaaggaccagaccaaaauucccaucaagagaucugacaugcugaaagauauuaucaaggaauauacagacguguacccugagauuaucgaacgcgccggguauagccucgagaagguguucggaauccagcugaaagagauugauaagaacgaccaccuguacauccuccuguccacccuugaacccacagaugcuggcauucuggggaccacgaaagacagccccaagcucggacugcuuaugguccugcucucuaucauuuuuaugaauggcaaccgguccagcgaggccgugaucugggaaguucugagaaaacuggggcuccgcccuggcauucaucacucucuguucggagaugugaagaaacuuaucacagacgaguuugucaagcaaaaguaucuggauuacgcccgggugcccaauuccaaucccccugaauaugaguucuuuuggggccucagaagcuacuacgagaccuccaaaaugaagguucugaaauucgcuugcaaggugcagaagaaagaccccaaggaaugggcggcccaguaucgcgaggcuauggaagccgaucuuaaagccgcugccgaggcggcugccgaggccaaggcucgggccgaaaucagagcgcgcauggggauuggacugggcucugagaacgcugccgggccuuguaacugggacgaagccgacaucggacccugggcuaaagcccggauucaggcuggcgccgaggcgaaggccaaagcucaagaaagcggguccgccucuaccggagcuagcacauccaccaauaacagcgccucugccuccgcuagcacaucuggcggcuuuuccgcgggggccagccucacggcuacccugacauucggacuguuugccggccucgggggagccggcgcuucuaccagcggguccagcggcgccugcggauucucuuacaaguga

SEQ ID NO: 2379 - protein, 741 aa, Artificial Sequence
  MAGE-D4__Homo_sapiens__Q96JG8
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 2380 - RNA, 2226 nt, Artificial Sequence
  MAGE-D4__Homo_sapiens__AAH63838
auggcugagggaagcuucagcgugcaaucggaaagcuacaguguugaagacauggaugaggguagcgacgaagucggggaggaagagaugguugaaggcaacgacuaugaagaauucggugcguuugguggcuauggcacccucaccagcuuugacauccauauccucagagccuucggaagcuuggguccaggccuucgcaucuuaucgaaugagcccugggaacuggaaaacccugugcuggcccagacccugguggaggcauugcagcuggauccggaaacacuugccaaugagacggccgcccgugcugccaacguagcccgcgccgccgccuccaaccgugcggcucgggccgcugccgccgcugcccguaccgccuucagucagguggucgcuagccaccggguggccacgccgcaggucucaggagaggauacccagcccacgaccuacgccgccgaggcucaggggcccaccccugagccaccccuugcuucuccgcagaccucccagauguuagucaccaguaagauggcugcccccgaggcuccggcaaccuccgcacagucccagacaggcuccccggcccaggaggcugcuacugagggcccuaguagcgccugugcuuucucucaggcuccgugugccagggagguggacgccaaccggcccagcacagccuuccugggccagaaugaugucuucgauuucacucagccggcaggugucaguggcauggccuucccgcgccccaagagaccugccccagcccaagaggcugccacagagggccccagugcugccucuggugugccccagacgggaccuggcagggagguggcagccacccggcccaagaccaccaagucggggaaggcgcuggccaagacucgguggguggagccucagaauguuguggcagcagcugcugccaaggccaagauggccacgagcaucccugagccggagggugcagcugcugccacugcucagcacagugcugagcccugggccaggaugggaggcaagaggaccaagaaguccaagcaccuggaugaugaguaugagagcagcgaggaggagagagagacucccgcggucccacccaccuggagagcaucacagcccucauugacggugcgggcucaguuggccccucggcccccgauggccccgaggucccagauacccucaaggcacguacugugccugcccccccgcaacgugacccuucugcaggagagggcaaauaaguuggugaaauaccugaugauuaaggacuacaagaagauccccaucaagcgcgcagacaugcugaaggaugucaucagagaauaugaugaacauuucccugagaucauugaacgagcaacguacacccuggaaaagaaguuugggauccaccugaaggagaucgacaaggaagaacaccuguauauucuugucugcacacgggacuccucagcucgccuccuuggaaaaaccaaggacacucccaggcugagucuccucuuggugauucugggcgucaucuucaugaauggcaaccgugccagcgaggcuguccucugggaggcacuacgcaagaugggacugcgcccuggggugaggcacccauuccucggcgaucugaggaagcucaucacagaugacuuugugaagcagaaguaccuggaauacaagaagauccccaacagcaacccaccugaguaugaauuccucuggggccugcgagcccgccaugagaccagcaagaugaggguccugagauucaucgcccagaaucagaaccgagacccccgggaauggaaggcucauuucuuggaggcuguggaugaugcuuucaagacaauggauguggauauggccgaggaacaugccagggcccagaugagggcccagaugaauaucggggaugaagcgcugauuggacgguggagcugggaugacauacaagucgagcuccugaccugggaugaggacggagauuuuggcgaugccugggccaggauccccuuugcuuucugggccagauaccaucaguacauucugaauagcaaccgugccaacaggagggccacguggagagcuggcgucagcaguggcaccaauggaggggccagcaccagcguccuagauggccccagcaccagcuccaccauccggaccagaaaugcugccagagcuggcgccagcuucuucuccuggauccagcaccguuga

SEQ ID NO: 2381 - RNA, 2226 nt, Artificial Sequence
  derived and/or modified sequence opt1 from MAGE-D4__Homo_sapiens__AAH63838
auggccgagggcagcuucuccgugcagagcgaguccuacagcgucgaggacauggacgagggguccgacgaggugggcgaggaggagaugguggaggggaacgacuacgaggaguucggcgccuucgggggcuacggcacccugaccagcuucgacauccacauccuccgcgcguucgggucccugggccccgggcugcggauccucagcaacgagccgugggagcuggagaaccccguccuggcccagacgcucguggaggcccugcagcuggaccccgagacccucgccaacgagaccgccgcgcgcgccgccaacguggcccgggcggccgccuccaaccgcgccgcccgggcggccgccgccgccgcgcgcaccgccuucagccaggucguggccucccaccggguggccacgccccaggucagcggcgaggacacccagccgaccaccuacgccgcggaggcccaggggcccacgcccgagcccccgcuggccagcccccagaccagccagaugcuggugaccuccaagauggccgcccccgaggcgcccgccaccagcgcccagucccagacgggcagcccggcccaggaggcggccaccgagggccccuccagcgccugcgccuucagccaggcccccugcgcgcgcgagguggacgccaaccggcccuccaccgccuuccucgggcagaacgacgucuucgacuucacccagccggccggcgugagcgggauggccuucccccgccccaagcggcccgcgccggcccaggaggccgccacggagggccccuccgccgcgagcggcgugccccagaccgggcccggccgcgaggucgccgccacccggccgaagaccacgaaguccgggaaggcccuggcgaagacccgcuggguggagccccagaacguggucgccgccgccgccgcgaaggccaagauggccaccagcauccccgagcccgagggcgccgccgcggccaccgcccagcacuccgccgagccgugggcccggaugggcgggaagcgcacgaagaaguccaagcaccuggacgacgaguacgaguccagcgaggaggagcgggagacccccgcggugcccccgaccuggcgcgccucccagcccagccucaccgugcgggcccagcuggccccgcgcccgcccauggcgccccggucccagauccccagccgccacguccugugccucccgccccgcaacgugacgcugcugcaggagcgggccaacaagcucgugaaguaccugaugaucaaggacuacaagaagauccccaucaagcgcgccgacaugcugaaggacgucauccgggaguacgacgagcacuuccccgagaucaucgagcgcgccaccuacacccucgagaagaaguucggcauccaccugaaggagaucgacaaggaggagcaccuguacauccucgugugcacccgggacuccagcgcccgccugcuggggaagacgaaggacacgccccggcucucccugcugcucgucauccugggcgugaucuucaugaacgggaaccgcgcgagcgaggccgugcugugggaggcccuccggaagaugggccugcgccccgggguccggcaccccuuccugggcgaccuccgcaagcugaucaccgacgacuucgugaagcagaaguaccuggaguacaagaagauccccaacuccaacccgcccgaguacgaguuccucuggggccugcgggcccgccacgagaccagcaagaugcgggugcugcgcuucaucgcccagaaccagaaccgggacccccgcgaguggaaggcgcacuuccucgaggccgucgacgacgccuucaagaccauggacguggacauggccgaggagcacgcccgggcgcagaugcgcgcccagaugaacaucggggacgaggcccugaucggccgcuggagcugggacgacauccagguggagcugcucaccugggacgaggacggggacuucggcgacgccugggcccggauccccuucgcguucugggcccgcuaccaccaguacauccugaacuccaaccgggccaaccgccgggccaccuggcgcgcgggggucagcuccggcaccaacggcggggccagcaccuccgugcuggacggccccagcacguccagcaccauccggacccgcaacgccgcccgggccggggcguccuucuucagcuggauccagcaccgcuga

SEQ ID NO: 2382 - RNA, 2226 nt, Artificial Sequence
  derived and/or modified sequence opt2 from MAGE-D4__Homo_sapiens__AAH63838
auggccgagggcuccuucuccguccaguccgaguccuacuccgucgaggacauggacgagggcuccgacgaggucggcgaggaggagauggucgagggcaacgacuacgaggaguucggcgccuucggcggcuacggcacccucaccuccuucgacauccacauccuccgcgccuucggcucccucggccccggccuccgcauccucuccaacgagcccugggagcucgagaaccccguccucgcccagacccucgucgaggcccuccagcucgaccccgagacccucgccaacgagaccgccgcccgcgccgccaacgucgcccgcgccgccgccuccaaccgcgccgcccgcgccgccgccgccgccgcccgcaccgccuucucccaggucgucgccucccaccgcgucgccaccccccaggucuccggcgaggacacccagcccaccaccuacgccgccgaggcccagggccccacccccgagcccccccucgccuccccccagaccucccagaugcucgucaccuccaagauggccgcccccgaggcccccgccaccuccgcccagucccagaccggcucccccgcccaggaggccgccaccgagggccccuccuccgccugcgccuucucccaggcccccugcgcccgcgaggucgacgccaaccgccccuccaccgccuuccucggccagaacgacgucuucgacuucacccagcccgccggcgucuccggcauggccuucccccgccccaagcgccccgcccccgcccaggaggccgccaccgagggccccuccgccgccuccggcgucccccagaccggccccggccgcgaggucgccgccacccgccccaagaccaccaaguccggcaaggcccucgccaagacccgcugggucgagccccagaacgucgucgccgccgccgccgccaaggccaagauggccaccuccauccccgagcccgagggcgccgccgccgccaccgcccagcacuccgccgagcccugggcccgcaugggcggcaagcgcaccaagaaguccaagcaccucgacgacgaguacgaguccuccgaggaggagcgcgagacccccgccgucccccccaccuggcgcgccucccagcccucccucaccguccgcgcccagcucgccccccgcccccccauggccccccgcucccagauccccucccgccacguccucugccuccccccccgcaacgucacccuccuccaggagcgcgccaacaagcucgucaaguaccucaugaucaaggacuacaagaagauccccaucaagcgcgccgacaugcucaaggacgucauccgcgaguacgacgagcacuuccccgagaucaucgagcgcgccaccuacacccucgagaagaaguucggcauccaccucaaggagaucgacaaggaggagcaccucuacauccucgucugcacccgcgacuccuccgcccgccuccucggcaagaccaaggacaccccccgccucucccuccuccucgucauccucggcgucaucuucaugaacggcaaccgcgccuccgaggccguccucugggaggcccuccgcaagaugggccuccgccccggcguccgccaccccuuccucggcgaccuccgcaagcucaucaccgacgacuucgucaagcagaaguaccucgaguacaagaagauccccaacuccaacccccccgaguacgaguuccucuggggccuccgcgcccgccacgagaccuccaagaugcgcguccuccgcuucaucgcccagaaccagaaccgcgacccccgcgaguggaaggcccacuuccucgaggccgucgacgacgccuucaagaccauggacgucgacauggccgaggagcacgcccgcgcccagaugcgcgcccagaugaacaucggcgacgaggcccucaucggccgcugguccugggacgacauccaggucgagcuccucaccugggacgaggacggcgacuucggcgacgccugggcccgcauccccuucgccuucugggcccgcuaccaccaguacauccucaacuccaaccgcgccaaccgccgcgccaccuggcgcgccggcgucuccuccggcaccaacggcggcgccuccaccuccguccucgacggccccuccaccuccuccaccauccgcacccgcaacgccgcccgcgccggcgccuccuucuucuccuggauccagcaccgcuga

SEQ ID NO: 2383 - RNA, 2226 nt, Artificial Sequence
  derived and/or modified sequence opt3 from MAGE-D4__Homo_sapiens__AAH63838
auggccgagggcagcuucuccgugcagucugaaucauacagugucgaggacauggaugaagggagcgacgagguuggagaagaggagaugguggaagguaacgauuaugaggaauuuggcgcuuucgggggauacggcacccugacauccuuugacauccacauucucagagcauucgguucucuugggcccggacugaggauauugucgaaugagccuugggaguuagaaaacccaguacuggcccaaacucuaguggaggcgcuccagcuggauccggaaacgcuugcuaaugagaccgccgcacgggccgcuaacgucgcacgcgccgcugccucaaaucgagcggcacgugccgcugccgcagcugccagaacagcguuuagccaggugguugccagucauaggguggcaacuccccaggucuccggcgaagacacccaaccuacaaccuaugcugccgaggcucagggcccaacucccgagccuccacuggccucuccccagacaagccagauguuggugaccuccaagauggcagccccugaagcuccagcgacgucagcacaaagucagacugggagcccggcccaggaggcugccaccgaaggacccucuuccgcaugcgccuucucacaggcuccuugugcccgggagguagaugcaaaccgcccaagcacagcguuucucggucaaaaugacguuuucgauuuuacucagcccgcuggcgugagugggauggccuucccuagaccaaaaaggcccgcaccggcccaggaagcugccaccgagggaccuucugcagcuuccggcgucccccaaacagguccagggcgggagguggccgcgacccgcccuaagacgacuaaaagcggaaaggcccuggcuaaaacacgauggguggaaccccagaacgucguugcagccgcugccgcaaaggcgaagauggccaccucgaucccagagcccgaaggcgcugccgcagcuacugcccagcacucugcagagccuugggccagaaugggcgggaaaaggacaaagaaauccaagcaucuggacgaugaauacgagucaagugaggaggaacgggaaaccccagcugugccgcccacguggcgugcgagccagccuucccucaccguacgcgcccaauuagcaccaagacccccuauggcuccaaggucucagauucccagccggcacgugcugugccuuccgccucgaaaugucacauugcugcaggagcgcgccaacaagcuagugaaauaucucaugaucaaggacuacaaaaagauuccaaucaaaagagccgauaugcugaaggacguuauaagggaguaugacgaacauuuucccgagaucauugaacgggcuacuuacacccuugagaaaaaguucggaauccaccugaaagaaauugauaaggaggagcacuuguacauccucguguguacacgcgacucaagugcaagacuguuagguaagacuaaagauaccccuaggcugucccuccuucuggucauauugggcgugauuuuuaugaaugggaaccgugccagcgaagcgguacuaugggaggcucugcggaagaugggacuccgacccggcguuagacauccauuccugggugaccuuaggaaacugaucacagaugacuucgugaagcagaaauauuuggaauacaagaagauuccuaauucuaaucccccagaguaugaauuucucugggggcugcgcgcccggcacgagaccucaaaaaugagagucuuaagguucaucgcacaaaaccagaaccgcgauccgcgagaguggaaggcccauuuucuggaagcuguggacgaugcauucaaaacuauggacgucgauauggccgaggaacacgcgcgggcucagaugcgugcccagaugaacaucggcgacgaggcacuaauuggaagauggaguugggacgauauacaaguggaacuccugacgugggacgaggauggcgacuuuggggaugccugggcuaggaucccuuucgccuuuugggcacgcuaccaccaguauauucuuaauagcaaccgggcuaauagaagggccacauggcgagcgggaguuuccucugguaccaacggcggggccucgacuagcguguuggacggacccuccaccucaaguacaauccgcacccggaaugcagcuagagccggcgcuucuuucuuuagcuggauacagcauagguga

SEQ ID NO: 2384 - RNA, 2226 nt, Artificial Sequence
  derived and/or modified sequence opt4 from MAGE-D4__Homo_sapiens__AAH63838
auggccgagggcagcuucagcgugcagagcgagagcuacagcguggaggacauggacgagggcagcgacgaggugggcgaggaggagaugguggagggcaacgacuacgaggaguucggcgccuucggcggcuacggcacccugaccagcuucgacauccacauccugagagccuucggcagccugggccccggccugagaauccugagcaacgagcccugggagcuggagaaccccgugcuggcccagacccugguggaggcccugcagcuggaccccgagacccuggccaacgagaccgccgccagagccgccaacguggccagagccgccgccagcaacagagccgccagagccgccgccgccgccgccagaaccgccuucagccaggugguggccagccacagaguggccaccccccaggugagcggcgaggacacccagcccaccaccuacgccgccgaggcccagggccccacccccgagcccccccuggccagcccccagaccagccagaugcuggugaccagcaagauggccgcccccgaggcccccgccaccagcgcccagagccagaccggcagccccgcccaggaggccgccaccgagggccccagcagcgccugcgccuucagccaggcccccugcgccagagagguggacgccaacagacccagcaccgccuuccugggccagaacgacguguucgacuucacccagcccgccggcgugagcggcauggccuuccccagacccaagagacccgcccccgcccaggaggccgccaccgagggccccagcgccgccagcggcgugccccagaccggccccggcagagagguggccgccaccagacccaagaccaccaagagcggcaaggcccuggccaagaccagauggguggagccccagaacgugguggccgccgccgccgccaaggccaagauggccaccagcauccccgagcccgagggcgccgccgccgccaccgcccagcacagcgccgagcccugggccagaaugggcggcaagagaaccaagaagagcaagcaccuggacgacgaguacgagagcagcgaggaggagagagagacccccgccgugccccccaccuggagagccagccagcccagccugaccgugagagcccagcuggcccccagaccccccauggcccccagaagccagauccccagcagacacgugcugugccugccccccagaaacgugacccugcugcaggagagagccaacaagcuggugaaguaccugaugaucaaggacuacaagaagauccccaucaagagagccgacaugcugaaggacgugaucagagaguacgacgagcacuuccccgagaucaucgagagagccaccuacacccuggagaagaaguucggcauccaccugaaggagaucgacaaggaggagcaccuguacauccuggugugcaccagagacagcagcgccagacugcugggcaagaccaaggacacccccagacugagccugcugcuggugauccugggcgugaucuucaugaacggcaacagagccagcgaggccgugcugugggaggcccugagaaagaugggccugagacccggcgugagacaccccuuccugggcgaccugagaaagcugaucaccgacgacuucgugaagcagaaguaccuggaguacaagaagauccccaacagcaacccccccgaguacgaguuccuguggggccugagagccagacacgagaccagcaagaugagagugcugagauucaucgcccagaaccagaacagagaccccagagaguggaaggcccacuuccuggaggccguggacgacgccuucaagaccauggacguggacauggccgaggagcacgccagagcccagaugagagcccagaugaacaucggcgacgaggcccugaucggcagauggagcugggacgacauccagguggagcugcugaccugggacgaggacggcgacuucggcgacgccugggccagaauccccuucgccuucugggccagauaccaccaguacauccugaacagcaacagagccaacagaagagccaccuggagagccggcgugagcagcggcaccaacggcggcgccagcaccagcgugcuggacggccccagcaccagcagcaccaucagaaccagaaacgccgccagagccggcgccagcuucuucagcuggauccagcacagauga

SEQ ID NO: 2385 - RNA, 2226 nt, Artificial Sequence
  derived and/or modified sequence opt5 from MAGE-D4__Homo_sapiens__AAH63838
auggccgagggcagcuucuccgugcagucugaaagcuacuccgucgaggacauggaugaagggucugacgagguuggagaagaggagaugguggaaggcaacgauuaugaggaauuuggggcuuucggaggcuacgggacccugacauccuuugacauccacauucucagagccuucggaucccugggccccggccuucggauccugucuaaugagccuugggagcucgaaaacccggugcuggcgcaaacgcuugucgaggcucugcagcucgaucccgaaacccuggccaaugagacagccgcucgcgccgcuaacguggccagagcggccgcuagcaaucgggccgcucgcgccgcggccgcugccgcuagaaccgccuuuucccagguuguggccagccaucgggucgcuacaccucaggugucuggggaagacacccaacccacaaccuaugcggccgaggcucagggaccuacgcccgagccuccgcuggccagcccccagaccagccagaugcucguuacaucuaagauggccgcuccugaagcccccgcgaccuccgcucaaagccagacaggcucuccugcccaggaggccgcuaccgaagggcccuccagcgccugcgcuuucucccaggccccgugugcgcgcgagguggaugccaacagaccuucuacggcuuuucugggacaaaaugacgucuucgauuuuacacagcccgccggcgugagcgggauggcuuucccucggcccaaacgccccgccccugcgcaggaagccgcuaccgagggaccguccgccgcuagcggcgugccccaaacaggcccugggagagaggucgccgccacccggcccaagaccacaaaaucuggaaaggcucuugcgaaaacgcgcuggguugaaccucagaacgugguggccgcugccgccgcuaaggccaagauggcgaccuccauucccgagccggaaggcgcugccgccgcuacagcccagcacagcgcggagccuugggcuagaaugggagggaaacggaccaagaaaucuaagcaucuggacgaugaauacgagagcuccgaggaggaacgcgaaacacccgccgucccucccaccuggagagccucucagccuagccucacggugcgggcucaacuggcccccagaccgccuauggcuccccgcucccagauccccagccggcacguucuuugccugccuccgagaaaugugacacuccugcaggagcgcgccaacaaacuggucaaguaucucaugauuaaggacuacaaaaagauccccaucaaacgggcggauaugcugaaggacgugauuagagaguaugacgaacauuuuccugagaucauugaacgcgccaccuacacccuugagaaaaaguucggcauccaccugaaagaaauugauaaggaggagcaccucuacauccugguuuguacacgggacucuuccgcuagacuucuggggaagaccaaagauacaccccgccucagccugcugcucgugauucugggagucaucuuuaugaauggcaaccgggccucugaagcugugcuuugggaggcccugagaaagaugggccuccgcccugggguccggcaucccuuccugggagaccuuagaaaacugaucacggaugacuucgugaagcagaaauaucucgaauacaagaagauuccuaauuccaaucccccggaguaugaauuucuguggggccugcgggcccgccacgagaccagcaaaaugagaguucuccgguucaucgcucaaaaucagaacagagauccucgcgaguggaaggcgcauuuucuggaagccguggacgaugcuuucaaaacaauggacgucgauauggccgaggaacacgcccgggcucagaugagagcccagaugaacauuggggacgaggcgcuuaucggacgcugguccugggacgauauucaaguggaacugcucaccugggacgaggauggcgacuuuggggaugcuugggccagaauccccuucgccuuuugggcucgguaccaccaguauauccugaacucuaaccgcgccaauagacgggcgacauggcgcgcuggcguuagcuccggaaccaacggcggggccucuacgagcgugcuggacggaccuuccaccagcucuacaauuagaacccggaaugccgcucgcgccggcgcuuccuucuuuagcuggauccagcauagauga

SEQ ID NO: 2386 - protein, 373 aa, Artificial Sequence [sequence omitted]

SEQ ID NO: 2387 - RNA, 1122 nt, Artificial Sequence
  MAGE-_E1__Homo_sapiens__CAG33449
augccucccguuccaggcguuccauuccgcaacguugacaacgacuccccgaccucaguugaguuagaagacuggguagaugcacagcaucccacagaugaggaagaggaggaagccuccuccgccucuuccacuuuguacuuaguauuuucccccucuucuuucuccacauccucuucucugauucuuggugguccugaggaggaggaggugcccucuggugugauaccaaaucuuaccgagagcauucccaguaguccuccacaggguccuccacaggguccuucccagaguccucugagcuccugcugcuccucuuuuucauggagcucauucagugaggaguccagcagccagaaaggggaggauacaggcaccugucagggccugccagacagugaguccucuuucacauauacacuagaugaaaagguggccgaguuaguggaguuccugcuccucaaauacgaagcagaggagccuguaacagaggcagagaugcugaugauugucaucaaguacaaagauuacuuuccugugauacucaagagagcccgugaguucauggagcuucuuuuuggccuugcccugauagaagugggcccugaccacuucuguguguuugcaaacacaguaggccucaccgaugaggguagugaugaugagggcaugcccgagaacagccuccugauuauuauucugagugugaucuucauaaagggcaacugugccucugaggaggucaucugggaagugcugaaugcaguagggguauaugcugggagggagcacuucgucuauggggagccuagggagcuccucacuaaaguuugggugcagggacauuaccuggaguaucgggaggugccccacaguucuccuccauauuaugaauuccugugggguccaagagcccauucagaaagcaucaagaagaaaguacuagaguuuuuagccaagcugaacaacacuguuccuaguuccuuuccauccugguacaaggaugcuuugaaagauguggaagagagaguccaggccacaauugauaccgcagaugaugccacugucauggccagugaaagccucagugucauguccagcaacgucuccuuuucugauuaa

SEQ ID NO: 2388 - RNA, 1122 nt, Artificial Sequence
  derived and/or modified sequence opt1 from MAGE-_E1__Homo_sapiens__CAG33449
augccgcccgugcccggcguccccuuccgcaacguggacaacgacagccccaccuccguggagcuggaggacugggucgacgcccagcaccccaccgacgaggaggaggaggaggccagcuccgcgagcuccacgcucuaccugguguucagccccuccagcuucuccaccagcuccagccugauccucgggggccccgaggaggaggaggugcccuccggggucaucccgaaccugaccgagagcauccccuccagcccgccccagggcccgccccaggggcccucccagagcccccuguccagcugcugcagcuccuucagcugguccagcuucuccgaggagagcuccagccagaagggcgaggacaccggcacgugccaggggcucccggacuccgagagcuccuucaccuacacccuggacgagaagguggccgagcugguggaguuccuccugcugaaguacgaggccgaggagcccgucaccgaggccgagaugcucaugaucgugaucaaguacaaggacuacuuccccgugauccugaagcgggcccgcgaguucauggagcuccuguucggccuggcgcugaucgaggucgggcccgaccacuucugcguguucgccaacacggugggccucaccgacgaggggagcgacgacgagggcaugccggagaacucccugcugaucaucauccucagcgucaucuucaucaagggcaacugcgccuccgaggaggugaucugggaggugcugaacgccgucgggguguacgcgggccgggagcacuucguguacggggagccccgcgagcugcucaccaaggucugggugcagggccacuaccuggaguaccgggaggugccccacagcuccccgcccuacuacgaguuccuguggggcccccgcgcccacagcgaguccaucaagaagaagguccucgaguuccuggccaagcugaacaacaccgugcccagcagcuuccccuccugguacaaggacgcccucaaggacgucgaggagcgggugcaggccacgaucgacaccgcggacgacgccaccgugauggccagcgagucccugagcgucauguccagcaacguguccuucagcgacuga

SEQ ID NO: 2389 - RNA, 1122 nt, Artificial Sequence
  derived and/or modified sequence opt2 from MAGE-_E1__Homo_sapiens__CAG33449
augccccccguccccggcguccccuuccgcaacgucgacaacgacucccccaccuccgucgagcucgaggacugggucgacgcccagcaccccaccgacgaggaggaggaggaggccuccuccgccuccuccacccucuaccucgucuucucccccuccuccuucuccaccuccuccucccucauccucggcggccccgaggaggaggagguccccuccggcgucauccccaaccucaccgaguccauccccuccucccccccccagggccccccccagggccccucccaguccccccucuccuccugcugcuccuccuucuccugguccuccuucuccgaggaguccuccucccagaagggcgaggacaccggcaccugccagggccuccccgacuccgaguccuccuucaccuacacccucgacgagaaggucgccgagcucgucgaguuccuccuccucaaguacgaggccgaggagcccgucaccgaggccgagaugcucaugaucgucaucaaguacaaggacuacuuccccgucauccucaagcgcgcccgcgaguucauggagcuccucuucggccucgcccucaucgaggucggccccgaccacuucugcgucuucgccaacaccgucggccucaccgacgagggcuccgacgacgagggcaugcccgagaacucccuccucaucaucauccucuccgucaucuucaucaagggcaacugcgccuccgaggaggucaucugggagguccucaacgccgucggcgucuacgccggccgcgagcacuucgucuacggcgagccccgcgagcuccucaccaaggucuggguccagggccacuaccucgaguaccgcgaggucccccacuccuccccccccuacuacgaguuccucuggggcccccgcgcccacuccgaguccaucaagaagaagguccucgaguuccucgccaagcucaacaacaccguccccuccuccuuccccuccugguacaaggacgcccucaaggacgucgaggagcgcguccaggccaccaucgacaccgccgacgacgccaccgucauggccuccgagucccucuccgucauguccuccaacgucuccuucuccgacuga

SEQ ID NO: 2390 - RNA, 1122 nt, Artificial Sequence
  derived and/or modified sequence opt3 from MAGE-_E1__Homo_sapiens__CAG33449
augcccccugugccaggcgucccguucagaaacguugacaaugauagccccaccuccguggagcuggaagacuggguagaugcccagcacccuacagacgaggaagaggaagaggcuucuucagcaaguagcacucucuaccuuguguuuuccccaucuucguucucaacgagcaguucccugaucuuagggggacccgaggaagaggaagucccuucuggugugauuccaaacuugaccgagagcauacccuccucaccuccacaaggcccgccccaggggccuagucagagcccacugucuuccugcuguagcucauuuaguuggucuuccuucagcgaggaaucgucuucccagaagggagaggauacaggcacuugccaaggucuacccgacucagaaaguagcuuuaccuauacacucgaugagaaaguugccgaacugguggaguuccuucuguugaaguacgaggcggaagaaccugucaccgaagcugagaugcucaugaucgugauuaaauauaaggacuacuuuccaguaauccugaaaagggcccgggaguucauggagcugcucuuuggguuagcacugauugagguuggacccgaucauuucuguguguuugccaauacugucggccuuacagacgaaggcuccgaugacgaggggaugccggaaaacucuuugcugaucauaauccuaagcgugauuuucaucaagggaaauugcgcuucagaggaagugauuugggagguccucaacgcaguugguguguaugccggccgcgagcacuuuguauacggggaaccucgagagcugcuuaccaagguguggguccagggacauuaucuggaauaccgugaggugccccacaguuccccaccuuacuaugaguucuuguggggccccagagcucauagcgaaucuaucaaaaagaaaguucucgaguuccuggccaaguuaaauaacacggugccaucaaguuuucccagcugguacaaagaugcgcugaaggacgucgaagagagggugcaggcaacuauagacaccgccgaugacgcuacaguaauggccuccgaaucucucucgguuaugagcuccaaugugucauucagugauuga

SEQ ID NO: 2391 - RNA, 1122 nt, Artificial Sequence
  derived and/or modified sequence opt4 from MAGE-_E1__Homo_sapiens__CAG33449
augccccccgugcccggcgugcccuucagaaacguggacaacgacagccccaccagcguggagcuggaggacuggguggacgcccagcaccccaccgacgaggaggaggaggaggccagcagcgccagcagcacccuguaccugguguucagccccagcagcuucagcaccagcagcagccugauccugggcggccccgaggaggaggaggugcccagcggcgugauccccaaccugaccgagagcauccccagcagccccccccagggccccccccagggccccagccagagcccccugagcagcugcugcagcagcuucagcuggagcagcuucagcgaggagagcagcagccagaagggcgaggacaccggcaccugccagggccugcccgacagcgagagcagcuucaccuacacccuggacgagaagguggccgagcugguggaguuccugcugcugaaguacgaggccgaggagcccgugaccgaggccgagaugcugaugaucgugaucaaguacaaggacuacuuccccgugauccugaagagagccagagaguucauggagcugcuguucggccuggcccugaucgaggugggccccgaccacuucugcguguucgccaacaccgugggccugaccgacgagggcagcgacgacgagggcaugcccgagaacagccugcugaucaucauccugagcgugaucuucaucaagggcaacugcgccagcgaggaggugaucugggaggugcugaacgccgugggcguguacgccggcagagagcacuucguguacggcgagcccagagagcugcugaccaaggugugggugcagggccacuaccuggaguacagagaggugccccacagcagcccccccuacuacgaguuccuguggggccccagagcccacagcgagagcaucaagaagaaggugcuggaguuccuggccaagcugaacaacaccgugcccagcagcuuccccagcugguacaaggacgcccugaaggacguggaggagagagugcaggccaccaucgacaccgccgacgacgccaccgugauggccagcgagagccugagcgugaugagcagcaacgugagcuucagcgacuga

SEQ ID NO: 2392 - RNA, 1122 nt, Artificial Sequence
  derived and/or modified sequence opt5 from MAGE-_E1__Homo_sapiens__CAG33449
augcccccugugccgggcguccccuucagaaacguugacaaugauagcccuaccuccguggagcuggaagacuggguggaugcccagcaccccacagacgaggaagaggaagaggcuucuagcgccuccucuacgcucuaccuggucuuuagcccuuccucuuucagcaccuccagcucucuuauccucgggggacccgaggaagaggaagugccuuccggcguuauuccgaaccugacagagagcauccccucuuccccuccccaagggccuccccagggaccgagccagucuccucuguccagcugcuguuccucuuuuagcugguccagcuucucugaggaauccagcucucagaagggcgaggauaccgggacaugccaaggacuucccgacagcgaauccucuuuuaccuauacacuggaugagaaaguggcggaacucgucgaguuccugcugcucaaguacgaggcugaagaaccugugaccgaagccgagaugcugaugauuguuaucaaauauaaggacuacuuucccgugauucuuaaacgggcccgcgaguucauggagcugcucuuuggccuggcucuuaucgaggucggccccgaucauuucuguguguuugccaauacgguggggcugaccgacgaaggaagcgaugacgagggcaugccugaaaacucccuccugaucauuauccugagcgucauuuucaucaaggggaauugcgcuucugaggaaguuauuugggaggugcucaacgccgugggagucuaugcgggcagagagcacuuuguguacggggaaccgcgggagcugcuuacaaagguuugggugcagggacauuaucuggaauaccgcgaggucccccacuccagcccucccuacuaugaguuccucuggggcccuagagcccauucugaauccaucaaaaagaaagugcuggaguuccuugcuaagcugaauaacaccguucccagcuccuuuccgucuugguacaaagaugcccucaaggacguggaggaacggguccaggcuacaauugacaccgccgaugacgcgacggugauggccagcgaaucccugucugucaugagcuccaaugugagcuucucugauuga

SEQ ID NO: 2393 - protein, 957 aa, Artificial Sequence
  MAGE-E1_(MAGE1)__Homo_sapiens__Q9HCI5
MSLVSQNSRRRRRRVAKATAHNSSWGEMQAPNAPGLPADVPGSDVPQGPSDSQILQGLCASEGPSTSVLPTSAEGPSTFVPPTISEASSASGQPTISEGPGTSVLPTPSEGLSTSGPPTISKGLCTSVTLAASEGRNTSRPPTSSEEPSTSVPPTASEVPSTSLPPTPGEGTSTSVPPTAYEGPSTSVVPTPDEGPSTSVLPTPGEGPGTSVPLAATEGLSTSVQATPDEGPSTSVPPTATEGLSTPVPPTRDEGPSTSVPATPGEGPSTSVLPAASDGQSISLVPTRGKGSSTSVPPTATEGLSTSVQPTAGEGSSTSVPPTPGGGLSTSVPPTATEELSTSVPPTPGEGPSTSVLPIPGEGLSTSVPPTASDGSDTSVPPTPGEGASTLVQPTAPDGPGSSVLPNPGEGPSTLFSSSASVDRNPSKCSLVLPSPRVTKASVDSDSEGPKGAEGPIEFEVLRDCESPNSISIMGLNTSRVAITLKPQDPMEQNVAELLQFLLVKDQSKYPIRESEMREYIVKEYRNQFPEILRRAAAHLECIFRFELRELDPEAHTYILLNKLGPVPFEGLEESPNGPKMGLLMMILGQIFLNGNQAKEAEIWEMLWRMGVQRERRLSIFGNPKRLLSVEFVWQRYLDYRPVTDCKPVEYEFFWGPRSHLETTKMKILKFMAKIYNKDPMDWPEKYNEALEEDAARAFAEGWQALPHFRRPFFEEAAAEVPSPDSEVSSYSSKYAPHSWPESRLESKARKLVQLFLLMDSTKLPIPKKGILYYIGRECSKVFPDLLNRAARTLNHVYGTELVVLDPRNHSYTLYNRREMEETEEIVDSPNRPGNNFLMQVLSFIFIMGNHARESAVWAFLRGLGVQAGRKHVITCRYLSQRYIDSLRVPDSDPVQYEFVWGPRARLETSKMKALRYVARIHRKEPQDWPQQYREAMEDEANRADVGHRQIFVHNFR

SEQ ID NO: 2394 - RNA, 2874 nt, Artificial Sequence
  MAGE-E1_(MAGE1)__Homo_sapiens__AAM08354
augucucugguaagccagaauucgcgccgccgccgccgccgcguugcaaaggcuacugcgcacaacagcagcuggggcgaaaugcaggccccuaaugcccccggucuccccgcugaugugccaggcucagacgucccccagggucccagcgauucccagauccuccagggccucugcgccucugagggcccaagcaccuccguucugcccaccuccgcugagggcccaagcaccuuugugccgcccaccaucucugaggccucaagcgccuccgggcagcccaccaucucugagggaccuggcaccuccgugcugcccacccccagugagggccuaagcaccuccgggccucccaccaucucuaaggggcugugcaccucugugacgcuugccgccucugagggccggaacaccuccaggccgcccacuuccucugaggaaccuagcaccuccgugccgcccaccgccucugagguaccgagcaccucccugccgcccaccccuggugagggaacgagcaccuccgugccgcccacagccuaugagggaccaagcaccuccguggugcccaccccugaugagggaccaagcaccuccgugcugccuacaccuggugagggaccaggcaccuccgugccgcucgccgccacugagggccugagcaccuccgugcaggccacuccugaugagggaccgagcaccuccgugccgcccaccgccacugagggccuaagcacccccgugccacccacccgugaugagggaccgagcaccuccgugccggccacuccuggugagggaccgagcaccuccgugcugcccgccgccucugacggacaaagcaucuccuuggugcccacccgcgguaagggaucaagcaccuccgugccccccaccgccaccgagggccugagcaccuccgugcagcccacugcuggugagggaucgagcaccuccgugccgcccaccccuggugggggacugagcaccuccgugccgcccaccgccacugaggaguugagcaccuccgugccgcccacucccggugagggaccaagcacuuccguacugccaauccccggugagggacugagcaccucugugccgcccaccgccucugauggaucggacaccuccgugccgcccacuccuggugagggcgcaagcaccuuagugcagcccaccgccccugacggaccgggaagcuccgugcugccuaacccuggugagggcccgagcacauuguuuagcucuagugcuucuguggaccggaaccccuccaaguguucccuuguuuugccaagcccuaggguaaccaaggccuccguggacucagauucugaggguccuaagggugcagaaggcccuauagaauucgagguccugagagacugugagagccccaacuccauuaguauuaugggccucaauacuucccggguugcaauuacccugaagccccaagacccuauggaacagaacguagcugagcuguugcaguuccugcuggugaaggaucagagcaaguacccuauccgggagucugaaaugcgggaauauauuguuaaagaauaucgcaaccaguuuccugagauacucaggcgagcagcagcccaccuggagugcauuuuuagguuugaauugagagaacuugacccugaggcacacaccuacauucuguuaaacaaacugggaccugugcccuuugaaggguuagaagagagcccaaaugggccaaagaugggccuccugaugaugauucuaggccaaauauuccugaauggcaaccaagccaaggaggcugagauuugggaaaugcucuggaggaugggggugcagcgggaaaggaggcuuuccauuuuugggaacccaaagagacuucugucuguggaguuuguauggcagcguuacuuagacuacaggccaguaacugacuguaaaccaguggaguaugaguuuuucuggggcccaagaucccaccuagaaaccaccaagaugaaaauucugaaguucauggcgaaaauauauaacaaagauccuauggauuggccagagaaauacaacgaagcucuggaagaagaugcugccagagccuuugcugaggguuggcaggcucucccucacuuuaggaggcccuuuuuugaggaagcugcugcagagguaccauccccugauucagagguuuccagcuauuccucaaaauaugccccacauucauggccugagucaagauuggagagcaaggcaaggaagcuggugcaguuauuucugcuuauggauucaacuaagcugccuauaccaaagaaaggaauucuguacuacauuggccgagagugcagcaaaguguucccugaccuccugaaucgugcugcccgcacccugaaccaugucuaugggacagaacuagugguacuugaucccaggaaucacuccuauacucuguacaaccgaagggagauggaagaaacugaggagaucguagacaguccaaacaggccuggcaacaacuuuuugaugcagguccuaagcuucaucuuuauuaugggcaaccaugccagggagucugcagucugggccuuucugcggggcuuagggguucaagcugggagaaagcaugugauuaccugcagauacuugagucagcgcuauauagacaguuuacggguuccugacagugauccagugcaauaugaguuuguaugggguccuagagcccguuuggaaaccucuaagaugaaagccuugcgauauguggccagaauccacagaaaggaaccacaggacuggccacagcaguacagggaggcaauggaagaugaggccaauagagcugauguugggcacaggcaaaucuuuguucacaacuucagguag

SEQ ID NO: 2395 - RNA, 2874 nt, Artificial Sequence
  derived and/or modified sequence opt1 from MAGE-E1_(MAGE1)__Homo_sapiens__AAM08354
augagccuggugucccagaacagccgccggcgccggcgccgggucgccaaggccaccgcgcacaacuccagcuggggcgagaugcaggcccccaacgccccggggcuccccgccgacgugcccggcuccgacgugccccaggggccgagcgacucccagauccugcagggccugugcgccagcgaggggcccuccaccagcguccuccccacguccgcggagggccccagcaccuucgugccgcccaccaucuccgaggccagcuccgccagcggccagcccaccaucuccgaggggcccggcacgagcgugcugccgacccccuccgaggggcugagcaccagcggcccgcccaccaucuccaaggggcucugcacgagcgucacccuggccgcguccgagggccgcaacaccagccggccgcccaccuccagcgaggagcccuccacgagcgugccgcccaccgccuccgaggugcccagcaccucccugccgcccacccccggcgaggggacgagcaccuccgucccgcccaccgccuacgagggccccagcaccuccguggugcccacgcccgacgaggggcccagcaccuccguccuccccacccccggcgagggccccgggaccagcgugccccuggccgccacggagggccuguccaccagcgugcaggcgaccccggacgaggggcccagcaccuccgucccgcccacggccaccgagggccucagcacccccgugccgcccacccgcgacgaggggcccuccacgagcgugcccgccacccccggcgagggccccuccaccagcguccugcccgccgccuccgacgggcagagcaucucccuggugccgacccggggcaaggggagcuccacgagcgugccgcccaccgcgaccgagggccucuccaccagcguccagcccaccgccggggagggcuccagcacguccgugccgcccacccccggcgggggccugagcaccagcgugccgcccaccgccacggaggagcuguccaccagcgucccgcccacccccggggagggccccuccaccagcgugcuccccauccccggggagggccuguccacgagcgucccgcccaccgccuccgacggcagcgacaccuccgugccgcccacccccggggagggcgccagcacgcuggugcagcccaccgcgcccgacgggcccggcuccagcguccuccccaaccccggcgaggggcccuccacccuguucagcuccagcgccuccguggaccgcaaccccagcaagugcucccuggugcucccgagcccccgggucaccaaggccagcguggacuccgacagcgagggccccaagggggccgagggccccaucgaguucgaggugcugcgcgacugcgaguccccgaacagcaucuccaucauggggcugaacacgagccgggucgccaucacccucaagccccaggaccccauggagcagaacguggcggagcugcugcaguuccuccuggugaaggaccaguccaaguaccccauccgcgagagcgagaugcgggaguacaucgucaaggaguaccgcaaccaguucccggagauccugcggcgcgccgccgcccaccucgagugcaucuuccgguucgagcugcgcgagcuggaccccgaggcgcacaccuacauccuccugaacaagcugggccccgugcccuucgagggccucgaggaguccccgaacgggcccaagaugggccugcugaugaugauccucgggcagaucuuccugaacggcaaccaggccaaggaggccgagaucugggagaugcuguggcggaugggggugcagcgcgagcgccggcucagcaucuucggcaaccccaagcgccugcuguccgucgaguucguguggcagcgguaccucgacuaccgcccggugaccgacugcaagcccgucgaguacgaguucuucuggggcccccggagccaccuggagacgaccaagaugaagauccugaaguucauggccaagaucuacaacaaggaccccauggacuggccggagaaguacaacgaggcccuggaggaggacgcggcccgcgccuucgccgagggguggcaggcccucccccacuuccggcgccccuucuucgaggaggcggccgccgaggugcccuccccggacagcgagguguccagcuacuccagcaaguacgcgccccacuccuggcccgagagccggcuggagagcaaggcccgcaagcugguccagcuguuccuccugauggacuccaccaagcuccccaucccgaagaagggcauccuguacuacaucgggcgggagugcagcaagguguuccccgaccugcucaaccgcgccgcccggacccugaaccacguguacggcacggagcuggucgugcucgacccccgcaaccacuccuacacccuguacaaccggcgcgagauggaggagaccgaggagaucguggacagccccaaccggccggggaacaacuuccugaugcagguccucuccuucaucuucaucaugggcaaccacgcccgcgagagcgccgugugggcguuccugcggggccugggggugcaggccggccgcaagcacgucaucacgugccgcuaccucucccagcgguacaucgacagccugcgcgugcccgacuccgaccccgugcaguacgaguucgucugggggccccgggcccgccuggagaccagcaagaugaaggcccuccgguacguggcccgcauccaccggaaggagccgcaggacuggccccagcaguaccgcgaggcgauggaggacgaggccaaccgggccgacgugggccaccgccagaucuucguccacaacuuccgguga

SEQ ID NO: 2396 - RNA, 2874 nt, Artificial Sequence
  derived and/or modified sequence opt2 from MAGE-E1_(MAGE1)__Homo_sapiens__AAM08354
augucccucgucucccagaacucccgccgccgccgccgccgcgucgccaaggccaccgcccacaacuccuccuggggcgagaugcaggcccccaacgcccccggccuccccgccgacguccccggcuccgacgucccccagggccccuccgacucccagauccuccagggccucugcgccuccgagggccccuccaccuccguccuccccaccuccgccgagggccccuccaccuucgucccccccaccaucuccgaggccuccuccgccuccggccagcccaccaucuccgagggccccggcaccuccguccuccccacccccuccgagggccucuccaccuccggcccccccaccaucuccaagggccucugcaccuccgucacccucgccgccuccgagggccgcaacaccucccgcccccccaccuccuccgaggagcccuccaccuccgucccccccaccgccuccgagguccccuccaccucccucccccccacccccggcgagggcaccuccaccuccgucccccccaccgccuacgagggccccuccaccuccgucguccccacccccgacgagggccccuccaccuccguccuccccacccccggcgagggccccggcaccuccgucccccucgccgccaccgagggccucuccaccuccguccaggccacccccgacgagggccccuccaccuccgucccccccaccgccaccgagggccucuccacccccgucccccccacccgcgacgagggccccuccaccuccguccccgccacccccggcgagggccccuccaccuccguccuccccgccgccuccgacggccaguccaucucccucguccccacccgcggcaagggcuccuccaccuccgucccccccaccgccaccgagggccucuccaccuccguccagcccaccgccggcgagggcuccuccaccuccgucccccccacccccggcggcggccucuccaccuccgucccccccaccgccaccgaggagcucuccaccuccgucccccccacccccggcgagggccccuccaccuccguccuccccauccccggcgagggccucuccaccuccgucccccccaccgccuccgacggcuccgacaccuccgucccccccacccccggcgagggcgccuccacccucguccagcccaccgcccccgacggccccggcuccuccguccuccccaaccccggcgagggccccuccacccucuucuccuccuccgccuccgucgaccgcaaccccuccaagugcucccucguccuccccuccccccgcgucaccaaggccuccgucgacuccgacuccgagggccccaagggcgccgagggccccaucgaguucgagguccuccgcgacugcgagucccccaacuccaucuccaucaugggccucaacaccucccgcgucgccaucacccucaagccccaggaccccauggagcagaacgucgccgagcuccuccaguuccuccucgucaaggaccaguccaaguaccccauccgcgaguccgagaugcgcgaguacaucgucaaggaguaccgcaaccaguuccccgagauccuccgccgcgccgccgcccaccucgagugcaucuuccgcuucgagcuccgcgagcucgaccccgaggcccacaccuacauccuccucaacaagcucggccccguccccuucgagggccucgaggagucccccaacggccccaagaugggccuccucaugaugauccucggccagaucuuccucaacggcaaccaggccaaggaggccgagaucugggagaugcucuggcgcaugggcguccagcgcgagcgccgccucuccaucuucggcaaccccaagcgccuccucuccgucgaguucgucuggcagcgcuaccucgacuaccgccccgucaccgacugcaagcccgucgaguacgaguucuucuggggcccccgcucccaccucgagaccaccaagaugaagauccucaaguucauggccaagaucuacaacaaggaccccauggacuggcccgagaaguacaacgaggcccucgaggaggacgccgcccgcgccuucgccgagggcuggcaggcccucccccacuuccgccgccccuucuucgaggaggccgccgccgagguccccucccccgacuccgaggucuccuccuacuccuccaaguacgccccccacuccuggcccgagucccgccucgaguccaaggcccgcaagcucguccagcucuuccuccucauggacuccaccaagcuccccauccccaagaagggcauccucuacuacaucggccgcgagugcuccaaggucuuccccgaccuccucaaccgcgccgcccgcacccucaaccacgucuacggcaccgagcucgucguccucgacccccgcaaccacuccuacacccucuacaaccgccgcgagauggaggagaccgaggagaucgucgacucccccaaccgccccggcaacaacuuccucaugcagguccucuccuucaucuucaucaugggcaaccacgcccgcgaguccgccgucugggccuuccuccgcggccucggcguccaggccggccgcaagcacgucaucaccugccgcuaccucucccagcgcuacaucgacucccuccgcguccccgacuccgaccccguccaguacgaguucgucuggggcccccgcgcccgccucgagaccuccaagaugaaggcccuccgcuacgucgcccgcauccaccgcaaggagccccaggacuggccccagcaguaccgcgaggccauggaggacgaggccaaccgcgccgacgucggccaccgccagaucuucguccacaacuuccgcuga

SEQ ID NO: 2397 - RNA, 2874 nt, Artificial Sequence
  derived and/or modified sequence opt3 from MAGE-E1_(MAGE1)__Homo_sapiens__AAM08354
augagccuggugucccagaacucuagaaggcggcgccgacgugucgccaaggcuaccgcacacaauucaaguuggggcgagaugcaagcccccaacgcgccugggcucccagcugacguuccgggaagcgaugugccccaggguccuuccgacucucagauccuucagggccugugcgccucggaagggccaucaacaagcguauugcccacgagugcagagggaccuuccacuuucgugccacccaccauuucugaagccagcuccgcuucaggccaaccuacaauaagugaggguccagggacuagcgucuuaccgacccccucugaaggacuguccacaucaggcccuccaaccaucagcaaaggccuauguacaagugugacucucgcagccucugaggggagaaauaccuccaggcccccuacgagcucggaggaaccaucuacuuccguucccccgaccgcuucagaggugccuaguacaagccugcccccaacuccuggagaagguaccuccacaucugucccuccaaccgccuacgagggccccagcacgucagugguaccuacuccagaugaggggccgaguacauccguucuucccaccccuggagaaggcccagguacuagcgugccccuggcggcaacagagggguugucuaccucaguccaggccacgccugacgaaggaccaaguaccagcgugcccccgacagcuacugagggccucuccaccccugugccacccacacgggaugaaggcccuucuacuucgguccccgccaccccaggggagggaccuagcacauccguucugcccgcagcuucagacggucagaguauuucucuggugccaacccgcggcaaggggagcuccacuucaguaccgccuacggccacagagggacucagcaccucugugcagcccacugcgggcgaagguuccaguaccagcgucccacccacaccugggggcggauuaucuaccuccgugccacccacugccacagaggaacugucaacgaguguuccuccgaccccaggcgaggggcccagcacuucggugcuuccuaucccaggagaagguuuguccacaucugugcccccuaccgcaagcgauggcucagacacaagugucccgcccacuccaggggagggagcuuccacccugguacaaccuacggcccccgauggcccagguucuagcguucuaccuaaccccggggagggcccauccacccucuuuucaagcagugcuucuguggacagaaauccguccaaaugcagccugguccuuccuucgcccagggugacaaaggccucagucgauucugacagugaaggaccaaaaggcgcagaggggcccauugaguucgaagugcugcgggauugugaauccccuaacagcaucucuauaaugggauugaauacuagccgcguugccaucacccucaagccacaggaccccauggagcagaacguggcugagcuguuacaguuucugcucguaaaggaccaauccaaauauccuauucgagaaucagagaugagagaauacaucgucaaggaguauaggaaucaguucccggagauucuucggcgugcggcagcccaucuggaaugcaucuuucgcuucgaguugagagaacuagauccagaggcucacacauacauacugcucaacaaacugggucccgugccuuuugaaggccuugaggagagucccaaugggccaaagaugggacuguugaugaugauucucggccagaucuuccugaacgguaaucaagccaaagaagcagagauuugggaaauguuauggaggauggggguucagcgggagcgacgccugagcaucuuuggcaacccuaagagacuacucucuguggaguucgucuggcagagguaucuggacuaccggcccgugacugauuguaagccaguagaauaugaguuuuucuggggaccucgcucccaucuugaaaccacgaaaaugaagaucuugaaauuuauggccaagauuuacaauaaagacccgauggauuggcccgagaaguacaacgaagcucuggaggaagacgccgcaagagcguucgcugagggcuggcaggcccucccacacuucaggcgucccuuuuucgaggaagcagccgcugaggugcccucaccagauagugaaguuagcuccuauucuucgaaauacgccccucauagcuggcccgagucacggcuggaguccaaggcacgaaaacuuguccaacuguuuuugcucauggacaguacaaagcugccgauaccaaagaaagggaucuuauauuacauuggaagagaaugcucuaagguguucccugaucugcuaaacagggcugcccgcacccucaaucacguguauggcacugagcuggucguucuugacccccggaaccacagcuacacauuguauaauagaagggaaauggaggaaaccgaggagaucguggauuccccaaaccgccccgguaauaacuuucugaugcaagugcucucauucauauuuauuauggggaaucaugcgcgagaaucugccguaugggcuuuccugcggggauuaggcguccaggcaggucguaaacacgugaucacuuguagauaccugagccagagguacaucgacagucuucgcguuccugacuccgauccggugcaguaugaguuugucuggggcccccgggccagauuggaaaccagcaagaugaaggcucucagguacguggcccgcauucaucgaaaagagccacaggacuggccucagcaguaucgggaagcaauggaggaugaggcgaacagagccgacguugggcacaggcaaaucuucgugcacaauuuucguuga

SEQ ID NO: 2398 - RNA, 2874 nt, Artificial Sequence
  derived and/or modified sequence opt4 from MAGE-E1_(MAGE1)__Homo_sapiens__AAM08354
augagccuggugagccagaacagcagaagaagaagaagaagaguggccaaggccaccgcccacaacagcagcuggggcgagaugcaggcccccaacgcccccggccugcccgccgacgugcccggcagcgacgugccccagggccccagcgacagccagauccugcagggccugugcgccagcgagggccccagcaccagcgugcugcccaccagcgccgagggccccagcaccuucgugccccccaccaucagcgaggccagcagcgccagcggccagcccaccaucagcgagggccccggcaccagcgugcugcccacccccagcgagggccugagcaccagcggcccccccaccaucagcaagggccugugcaccagcgugacccuggccgccagcgagggcagaaacaccagcagaccccccaccagcagcgaggagcccagcaccagcgugccccccaccgccagcgaggugcccagcaccagccugccccccacccccggcgagggcaccagcaccagcgugccccccaccgccuacgagggccccagcaccagcguggugcccacccccgacgagggccccagcaccagcgugcugcccacccccggcgagggccccggcaccagcgugccccuggccgccaccgagggccugagcaccagcgugcaggccacccccgacgagggccccagcaccagcgugccccccaccgccaccgagggccugagcacccccgugccccccaccagagacgagggccccagcaccagcgugcccgccacccccggcgagggccccagcaccagcgugcugcccgccgccagcgacggccagagcaucagccuggugcccaccagaggcaagggcagcagcaccagcgugccccccaccgccaccgagggccugagcaccagcgugcagcccaccgccggcgagggcagcagcaccagcgugccccccacccccggcggcggccugagcaccagcgugccccccaccgccaccgaggagcugagcaccagcgugccccccacccccggcgagggccccagcaccagcgugcugcccauccccggcgagggccugagcaccagcgugccccccaccgccagcgacggcagcgacaccagcgugccccccacccccggcgagggcgccagcacccuggugcagcccaccgcccccgacggccccggcagcagcgugcugcccaaccccggcgagggccccagcacccuguucagcagcagcgccagcguggacagaaaccccagcaagugcagccuggugcugcccagccccagagugaccaaggccagcguggacagcgacagcgagggccccaagggcgccgagggccccaucgaguucgaggugcugagagacugcgagagccccaacagcaucagcaucaugggccugaacaccagcagaguggccaucacccugaagccccaggaccccauggagcagaacguggccgagcugcugcaguuccugcuggugaaggaccagagcaaguaccccaucagagagagcgagaugagagaguacaucgugaaggaguacagaaaccaguuccccgagauccugagaagagccgccgcccaccuggagugcaucuucagauucgagcugagagagcuggaccccgaggcccacaccuacauccugcugaacaagcugggccccgugcccuucgagggccuggaggagagccccaacggccccaagaugggccugcugaugaugauccugggccagaucuuccugaacggcaaccaggccaaggaggccgagaucugggagaugcuguggagaaugggcgugcagagagagagaagacugagcaucuucggcaaccccaagagacugcugagcguggaguucguguggcagagauaccuggacuacagacccgugaccgacugcaagcccguggaguacgaguucuucuggggccccagaagccaccuggagaccaccaagaugaagauccugaaguucauggccaagaucuacaacaaggaccccauggacuggcccgagaaguacaacgaggcccuggaggaggacgccgccagagccuucgccgagggcuggcaggcccugccccacuucagaagacccuucuucgaggaggccgccgccgaggugcccagccccgacagcgaggugagcagcuacagcagcaaguacgccccccacagcuggcccgagagcagacuggagagcaaggccagaaagcuggugcagcuguuccugcugauggacagcaccaagcugcccauccccaagaagggcauccuguacuacaucggcagagagugcagcaagguguuccccgaccugcugaacagagccgccagaacccugaaccacguguacggcaccgagcugguggugcuggaccccagaaaccacagcuacacccuguacaacagaagagagauggaggagaccgaggagaucguggacagccccaacagacccggcaacaacuuccugaugcaggugcugagcuucaucuucaucaugggcaaccacgccagagagagcgccgugugggccuuccugagaggccugggcgugcaggccggcagaaagcacgugaucaccugcagauaccugagccagagauacaucgacagccugagagugcccgacagcgaccccgugcaguacgaguucguguggggccccagagccagacuggagaccagcaagaugaaggcccugagauacguggccagaauccacagaaaggagccccaggacuggccccagcaguacagagaggccauggaggacgaggccaacagagccgacgugggccacagacagaucuucgugcacaacuucagauga

SEQ ID NO: 2399 - RNA, 2874 nt, Artificial Sequence
  derived and/or modified sequence opt5 from MAGE-E1_(MAGE1)__Homo_sapiens__AAM08354
augagccuggugucccagaacucuagacggcgcagacggcgcgucgccaaggcuaccgcccacaauagcuccuggggcgagaugcaagcgcccaacgcuccugggcucccggccgacguucccggaucugaugugccucagggccccagcgacucccagauccugcaggggcuuugcgccucugaaggaccuagcacauccgugcugcccacgagcgcugagggcccuucuaccuucgucccgcccacaauuuccgaagccagcucugcuuccgggcaaccuaccaucagcgagggacccggcacaucugugcucccuacccccuccgaaggccugagcacauccgggccgccuaccauuucuaaaggacuuuguacgagcguuacccuggccgcguccgagggcagaaauacaagccggcccccuaccucuuccgaggaacccagcacaucugugcccccuaccgccagcgaggucccguccacgucucugcccccuacacccggggaaggaaccagcacauccgugccucccaccgcuuacgagggcccgagcaccucuguugugccuacacccgaugaggggccuuccacgagcguccuccccaccccuggagaaggccccggcacaucugugccgcuggccgcuaccgaggggcucuccacaagcgugcaggccaccccugacgaaggacccuccacgucugugcccccuacagcgaccgagggccugagcaccccgguucccccuacacgcgaugaagggcccuccaccucugugccugccacacccggagagggcccuagcacguccgugcuucccgcugccagcgacgggcagucuaucucccuggucccgaccagaggaaagggcagcucuacauccgugccucccaccgcuacagagggccucagcaccucuguucagccuacggccggggaaggaagcuccaccagcgugcccccgacaccuggcgggggacugucuaccuccgugcccccuacagccaccgaggaacuuagcacguccgucccucccacacccggcgaggggccgucuaccagcguucugcccauuccuggcgaaggacucuccacaucugugcccccuaccgcuagcgauggcuccgacaccucugugcccccuacaccgggggagggagcgagcacgcugguccaacccaccgccccugauggccccggguccagcguccugccuaaccccggagagggcccgucuacacucuuuuccagcucugcuuccguggaccggaauccuagcaaaugcucucugguucuucccagcccccgcgugaccaaggccuccgucgauuccgacagcgaagggccuaaaggcgccgagggacccaucgaguucgaagugcugagagauugugaaucuccuaacagcaucuccauuaugggccucaauacaucucggguugcuaucacccugaagccgcaggaccccauggagcagaacguggccgagcuucugcaguuucuccuggucaaggaccaaagcaaauauccuauucgcgaauccgagaugagagaauacaucgugaaggaguaucggaaucaguuccccgagauucugcgcagagcggcugcccaucucgaaugcaucuuucgguucgagcugagagaacuugauccugaggcccacacguacauucugcucaacaaacuggggcccgugccguuugaaggacuugaggagucuccuaauggccccaagauggggcugcucaugaugauccugggacagaucuuccugaacggcaaucaagcuaaagaagccgagauuugggaaaugcucuggcgcauggggguucagcgggagagacgccugagcaucuuuggcaacccuaagcggcuucuguccgucgaguucguguggcagagauaucucgacuaccgccccgugacagauuguaagccugucgaauaugaguuuuucuggggaccccggucucaucuggaaaccaccaaaaugaagauucugaaauuuauggcuaagaucuacaauaaagacccgauggauuggccugagaaguacaacgaagcccuugaggaagacgcggccagagcuuucgccgagggcuggcaggcucucccccacuuccgccggcccuuuuucgaggaagccgcggccgaggugccuagcccggauuccgaaguuagcucuuauuccagcaaauacgcuccccauucuuggccugaguccagacuggagagcaaggcccgcaagcuggugcaacucuuucugcuuauggacuccacaaaacugcccauuccuaagaaagggauccucuauuacaucggacgggaaugcucuaaggucuuccccgaucugcugaacagagcugcccggacccuuaaucacguguauggcacagagcucguugugcuggacccucgcaaccacagcuacacgcuguauaauagacgggaaauggaggaaaccgaggagauugucgauuccccgaacagacccgggaauaacuuucucaugcagguccugagcuucaucuuuauuaugggaaaucaugcccgcgaaucugcuguuugggcguuccuucggggccugggggugcaggccggcagaaaacacgucaucacaugucgcuaccucucccagagauacauugacagccugcgggugccugacucugaucccgugcaauaugaguuugucuggggaccucgcgcuagacuggaaaccagcaagaugaaggcccuucgguacguugcccgcauccauagaaaagagccccaggacuggccgcagcaguaucgggaagcuauggaggaugaggccaaccgcgcggacgugggccacagacaaaucuucgugcacaauuuucgguga

SEQ ID NO: 2400 - protein, 523 aa, Artificial Sequence
  MAGE-E2__Homo_sapiens__Q8TD90
MSLVSQNARHCSAEITADYGDGRGEIQATNASGSPTSMLVVDAPQCPQAPINSQCVNTSQAVQDPNDLEVLIDEQSRRLGALRVHDPLEDRSIALVNFMRMKSQTEGSIQQSEMLEFLREYSDQFPEILRRASAHLDQVFGLNLRVIDPQADTYNLVSKRGFQITDRIAESLDMPKASLLALVLGHILLNGNRAREASIWDLLLKVDMWDKPQRINNLFGNTRNLLTTDFVCMRFLEYWPVYGTNPLEFEFLWGSRAHREITKMEALKFVSDAHDEEPWSWPEEYNKALEGDKTKERSLTAGLEFWSEDTMNDKANDLVQLAISVTEEMLPIHQDELLAHTGKEFEDVFPNILNRATLILDMFYGLSLIEVDTSEHIYLLVQQPESEEEQVMLESLGRPTQEYVMPILGLIFLMGNRVKEANVWNLLRRFSVDVGRKHSITRKLMRQRYLECRPLSYSNPVEYELLWGPRAHHETIKMKVLEYMARLYRKRPQNWPEQYREAVEDEEARAKSEATIMFFLDPT

SEQ ID NO: 2401 - RNA, 1572 nt, Artificial Sequence
  MAGE-E2__Homo_sapiens__AAH93964
augucucugguaagccagaaugcacgccacuguagcgcagagaucacugcagauuacggcgacggcagaggugaaauacaagcuacuaacgccuccgggucccccaccuccaugcuagucguugaugccccccagugcccucaggcgccaaucaacucucagugugucaacacuucccaggccguucaggacccgaaugaccuggagguccugaucgacgagcaguccagacguuugggggcgcucaggguccaugacccucuagaagacaggucgauugcuuuggugaauuucaugagaaugaaaagccagacggaggggucuauccagcaguccgagaugcuggaguuucucagagaguacucagaucaguucccugagauccucagacgagccucagcucaccuggaccaggucuuuggguugaaccugagaguuauugauccucaggcugacaccuacaauuuagucagcaaacgggguuuccagaucaccgauaggauagcggagucccuggacaugccaaaagcaagucuccuggcccuaguccuaggccacauccucuugaaugggaaccgagcaagagaggccuccauuugggacuugcugcuaaaaguugauaugugggauaagccucagaggaucaacaaccucuuugggaacacaaggaaccuccucacuacugacuuugugugcaugcgauucuuggaguacuggccgguguauggcacuaauccccuugaguuugaguucuuguggggcucuagagcccacagggaaaucacaaagauggaagcccugaaguuugugucagaugcccaugaugaagaacccuggagcuggccagaagaauauaauaaggcccuggaaggugacaaaaccaaagaaagaagccugacugcuggcuuagaguucuggucggaggacacuaugaaugauaaggcaaaugauuugguccaguuggcuauuagugucacugaggagaugcugccuauacaucaggaugagcuauuggcucacacuggcaaagaauuugaggauguguucccaaauauccucaauagagcuacucuaauucuugauauguucuauggguugucucugauugagguugauaccagugagcacaucuaccuccuuguccagcaaccagaaucagaggaagagcaagugaugcuagagagccuggggagacccacucaagaauauguaaugccaauccuagguuugaucuuccugaugggcaaccgugucaaagaggccaaugucuggaacuugcuucgaagauuuaguguggauguagggagaaagcauuccaucacccguaagcuuaugagacagcgcuaucuggaaugcaggccacuguccuacucuaauccaguugaauaugagcuucuaugggguccucgagcucaccaugaaaccaucaaaaugaaagucuuggaguacauggccaggcucuacagaaagcgaccacagaacuggccagaacaauauagggaggcuguggaagaugaggaggccagagccaaaucugaggcaacuaucauguuuuuccuugaccccacguga

SEQ ID NO: 2402 - RNA, 1572 nt, Artificial Sequence
  derived and/or modified sequence opt1 from MAGE-E2__Homo_sapiens__AAH93964
augagccuggugucccagaacgcccgccacugcagcgccgagaucaccgcggacuacggcgacgggcggggcgagauccaggccaccaacgccuccgggagccccacguccaugcucgucguggacgccccgcagugcccccaggcccccaucaacagccagugcgugaacaccucccaggcgguccaggaccccaacgaccuggaggugcugaucgacgagcagagccgccggcucggcgcccugcgcgugcacgacccgcuggaggaccgguccaucgcccucgucaacuucaugcgcaugaagucccagaccgaggggagcauccagcagagcgagaugcuggaguuccugcgggaguacuccgaccaguuccccgagauccuccgccgggccagcgcgcaccuggaccagguguucggccugaaccuccgcgugaucgacccccaggccgacaccuacaaccuggucuccaagcggggcuuccagaucacggaccgcaucgccgagagccuggacaugcccaaggccucccuccuggcccuggugcucgggcacauccugcugaacggcaaccgggcgcgcgaggccagcaucugggaccuccugcugaagguggacaugugggacaagccgcagcggaucaacaaccucuucgggaacacccgcaaccugcugaccaccgacuucgucugcaugcgguuccucgaguacuggcccguguacggcacgaacccccuggaguucgaguuccugugggggucccgcgcccaccgggagaucaccaagauggaggcccucaaguucgugagcgacgcccacgacgaggagcccuggagcuggccggaggaguacaacaaggcgcuggagggcgacaagaccaaggagcgcucccugaccgccggccucgaguucuggagcgaggacacgaugaacgacaaggccaacgaccugguccagcuggccaucuccgugaccgaggagaugcuccccauccaccaggacgagcugcuggcccacaccgggaaggaguucgaggacguguuccccaacauccucaaccgggcgacccugauccuggacauguucuacggccucagccugaucgaggucgacacguccgagcacaucuaccugcucgugcagcagcccgagagcgaggaggagcaggucaugcuggagucccuggggcgcccgacccaggaguacgugaugcccauccucggccugaucuuccugaugggcaaccgcgugaaggaggccaacguguggaaccugcuccggcgcuucagcgucgacguggggcggaagcacuccaucacccgcaagcugaugcggcagcgcuaccuggagugccggccccucagcuacuccaaccccgucgaguacgagcugcuguggggcccgcgcgcccaccacgagaccaucaagaugaaggugcucgaguacauggcccggcuguaccgcaagcggccccagaacuggcccgagcaguaccgcgaggccguggaggacgaggaggcgcgggccaagagcgaggccacgaucauguucuuccuggaccccaccuga

SEQ ID NO: 2403 - RNA, 1572 nt, Artificial Sequence
  derived and/or modified sequence opt2 from MAGE-E2__Homo_sapiens__AAH93964
augucccucgucucccagaacgcccgccacugcuccgccgagaucaccgccgacuacggcgacggccgcggcgagauccaggccaccaacgccuccggcucccccaccuccaugcucgucgucgacgccccccagugcccccaggcccccaucaacucccagugcgucaacaccucccaggccguccaggaccccaacgaccucgagguccucaucgacgagcagucccgccgccucggcgcccuccgcguccacgacccccucgaggaccgcuccaucgcccucgucaacuucaugcgcaugaagucccagaccgagggcuccauccagcaguccgagaugcucgaguuccuccgcgaguacuccgaccaguuccccgagauccuccgccgcgccuccgcccaccucgaccaggucuucggccucaaccuccgcgucaucgacccccaggccgacaccuacaaccucgucuccaagcgcggcuuccagaucaccgaccgcaucgccgagucccucgacaugcccaaggccucccuccucgcccucguccucggccacauccuccucaacggcaaccgcgcccgcgaggccuccaucugggaccuccuccucaaggucgacaugugggacaagccccagcgcaucaacaaccucuucggcaacacccgcaaccuccucaccaccgacuucgucugcaugcgcuuccucgaguacuggcccgucuacggcaccaacccccucgaguucgaguuccucuggggcucccgcgcccaccgcgagaucaccaagauggaggcccucaaguucgucuccgacgcccacgacgaggagcccugguccuggcccgaggaguacaacaaggcccucgagggcgacaagaccaaggagcgcucccucaccgccggccucgaguucugguccgaggacaccaugaacgacaaggccaacgaccucguccagcucgccaucuccgucaccgaggagaugcuccccauccaccaggacgagcuccucgcccacaccggcaaggaguucgaggacgucuuccccaacauccucaaccgcgccacccucauccucgacauguucuacggccucucccucaucgaggucgacaccuccgagcacaucuaccuccucguccagcagcccgaguccgaggaggagcaggucaugcucgagucccucggccgccccacccaggaguacgucaugcccauccucggccucaucuuccucaugggcaaccgcgucaaggaggccaacgucuggaaccuccuccgccgcuucuccgucgacgucggccgcaagcacuccaucacccgcaagcucaugcgccagcgcuaccucgagugccgcccccucuccuacuccaaccccgucgaguacgagcuccucuggggcccccgcgcccaccacgagaccaucaagaugaagguccucgaguacauggcccgccucuaccgcaagcgcccccagaacuggcccgagcaguaccgcgaggccgucgaggacgaggaggcccgcgccaaguccgaggccaccaucauguucuuccucgaccccaccuga

SEQ ID NO: 2404 - RNA, 1572 nt, Artificial Sequence
  derived and/or modified sequence opt3 from MAGE-E2__Homo_sapiens__AAH93964
augagccuggugucccagaacgccagacacugcucugcugagaucaccgcagacuacggcgaugggaggggagaaauucaagccacaaaugcgucagguagucccacuagcaugcucgucguugacgcuccucaguguccacaggccccgauaaacucccagugcgugaauacgucucaagcaguacaggaucccaacgaccuugaggugcugaucgaugaacagucgcggcgcuugggcgccuuacgaguccaugacccucuggaggaucguucaauugcucuagugaauuucaugagaaugaaaagccagaccgaagggaguauccaacaguccgagaugcucgaguuucugagggaauauucugaccaguucccagagauucuucggcgcgcaagcgcccaccuggaucagguuuuuggauugaaccucagagugaucgacccccaagcugauacauacaaucuggucuccaagaggggcuuccagauaacugaccggaucgccgaaucacuggauaugccuaaggcgagucucuuagcacuggugcuuggucauauuuugcugaacgggaaucgcgcccgagaggcuagcaucugggaccuacuccugaaaguagacaugugggauaagccacagagaauuaacaaucuuuuuggaaacaccaggaaucuguugacaaccgacuucguuuguaugcgguuucucgaguauuggcccguguacggcacuaacccucuggaguucgaguuuuuauggggcucucgugcccaccgcgaaaucacaaaaauggaggcacugaaguucgucuccgaugcucaugacgaagaaccauggucauggccggaggaauauaauaaggcccucgagggggauaaaaccaaggaaagaagccuuacggcgggacuggaguuuuggagugaagacacuaugaacgauaaagccaacgacuuggugcaacuagcaauaucugugaccgaggagaugcugcccauucaccaggaugaacuccuggcucacacagguaaggaguucgaagacgucuuuccuaauauccuuaacagggccacucugauuuuggauauguucuacggccucucccugaucgagguugacaccagcgaacauaucuauuuacuggugcagcagccagagucggaggaggaacaaguaaugcuagaaucucucgggcggcccacacaggaguacgugaugccuauucugggacuuauauucuugaugggcaaucgagucaaagaggcuaacguguggaaucugcuccgcagauuuuccguugacguggguaggaagcacucaaucacccggaagcugaugcgccagagauaccuugaaugcaggccacugaguuauagcaaccccgucgaguacgaauugcucugggggccgcgugcccaucacgagacgauuaaaaugaaggugcuggaauauauggcacgguuauaccgaaaaagaccucagaauuggcccgagcaauauagggaggccguagaagaugaggaagcucgcgcgaaguccgaggcaacuaucauguucuuucuggacccaacauga

SEQ ID NO: 2405 - RNA, 1572 nt, Artificial Sequence
  derived and/or modified sequence opt4 from MAGE-E2__Homo_sapiens__AAH93964
augagccuggugagccagaacgccagacacugcagcgccgagaucaccgccgacuacggcgacggcagaggcgagauccaggccaccaacgccagcggcagccccaccagcaugcuggugguggacgccccccagugcccccaggcccccaucaacagccagugcgugaacaccagccaggccgugcaggaccccaacgaccuggaggugcugaucgacgagcagagcagaagacugggcgcccugagagugcacgacccccuggaggacagaagcaucgcccuggugaacuucaugagaaugaagagccagaccgagggcagcauccagcagagcgagaugcuggaguuccugagagaguacagcgaccaguuccccgagauccugagaagagccagcgcccaccuggaccagguguucggccugaaccugagagugaucgacccccaggccgacaccuacaaccuggugagcaagagaggcuuccagaucaccgacagaaucgccgagagccuggacaugcccaaggccagccugcuggcccuggugcugggccacauccugcugaacggcaacagagccagagaggccagcaucugggaccugcugcugaagguggacaugugggacaagccccagagaaucaacaaccuguucggcaacaccagaaaccugcugaccaccgacuucgugugcaugagauuccuggaguacuggcccguguacggcaccaacccccuggaguucgaguuccuguggggcagcagagcccacagagagaucaccaagauggaggcccugaaguucgugagcgacgcccacgacgaggagcccuggagcuggcccgaggaguacaacaaggcccuggagggcgacaagaccaaggagagaagccugaccgccggccuggaguucuggagcgaggacaccaugaacgacaaggccaacgaccuggugcagcuggccaucagcgugaccgaggagaugcugcccauccaccaggacgagcugcuggcccacaccggcaaggaguucgaggacguguuccccaacauccugaacagagccacccugauccuggacauguucuacggccugagccugaucgagguggacaccagcgagcacaucuaccugcuggugcagcagcccgagagcgaggaggagcaggugaugcuggagagccugggcagacccacccaggaguacgugaugcccauccugggccugaucuuccugaugggcaacagagugaaggaggccaacguguggaaccugcugagaagauucagcguggacgugggcagaaagcacagcaucaccagaaagcugaugagacagagauaccuggagugcagaccccugagcuacagcaaccccguggaguacgagcugcuguggggccccagagcccaccacgagaccaucaagaugaaggugcuggaguacauggccagacuguacagaaagagaccccagaacuggcccgagcaguacagagaggccguggaggacgaggaggccagagccaagagcgaggccaccaucauguucuuccuggaccccaccuga

SEQ ID NO: 2406 - RNA, 1572 nt, Artificial Sequence
  derived and/or modified sequence opt5 from MAGE-E2__Homo_sapiens__AAH93964
augagccuggugucccagaacgccagacacugcucugcugagaucaccgccgacuacggcgaugggcggggagaaauucaagcgacaaaugcuagcggcucccccacgucuaugcucgucguugacgccccucaguguccgcaggcccccaucaacagccagugcgugaauaccucccaagcugugcaggauccuaacgaccuggagguccuuauugaugaacagucucgcagacugggggcccuccgggugcaugacccccuggaggaucgcagcaucgcucuuguuaauuucaugagaaugaagucccagacagaaggaagcauucaacagucugagaugcuggaguuucuccgggaauauuccgaccaguucccugagauccugcgcagagccagcgcgcaccuggaucagguguuuggccucaaccugcgggucaucgacccccaagccgauaccuacaaucuugugucuaaacgcggguuccagauuacagacagaaucgcugaaucccuggauaugccuaaggccagccuccuggcucuuguucugggacauauucuccugaacggcaaucgggcccgcgaggcgucuaucugggaccugcuccugaaaguggacaugugggauaagccgcagagaauuaacaaucuuuuuggcaacacccggaaucugcucacaaccgacuucgucuguaugcgcuuucuggaguauuggcccguguacgggacgaacccucuugaguucgaguuucuguggggauccagagcccaccgggaaaucaccaaaauggaggcucucaaguucgugagcgaugcccaugacgaagaacccugguccuggccugaggaauauaauaaggcucuggagggcgauaaaacaaaggaaagaucucugaccgccgggcucgaguuuuggagcgaagacacaaugaacgauaaagccaacgaccugguccaacuugcuauuuccguuaccgaggagaugcugcccauccaccaggaugaacuccuggcgcacacgggaaaggaguucgaagacguguuuccgaauauccuuaaccgcgccacacugauucucgauauguucuacggccugagccugaucgagguggacaccucugaacauauuuaucuccugguccagcagccugaguccgaggaggaacaagugaugcuugaaagccuggggcggcccacacaggaguacguuaugccuauccucggacugauuuuccugaugggcaauagagugaaagaggcuaacgucuggaaucuucuccgccgguuuucuguggacguuggcagaaagcacagcaucacccgcaagcugaugcggcagagauaccuggaaugccgcccccucuccuauucuaaccccguggaguacgaacugcuuugggggccucgggcccaucacgagaccaucaaaaugaagguccuggaauauauggccagacucuaccgcaaacggccgcagaauuggcccgagcaauauagagaggcuguggaagaugaggaagcccgggcuaagagcgaggcgacaauuauguucuuucuggacccuacguga

SEQ ID NO: 2407 - protein, 307 aa, Artificial Sequence
  MAGE-F1__Homo_sapiens__Q9HAY2
MLQTPESRGLPVPQAEGEKDGGHDGETRAPTASQERPKEELGAGREEGAAEPALTRKGARALAAKALARRRAYRRLNRTVAELVQFLLVKDKKKSPITRSEMVKYVIGDLKILFPDIIARAAEHLRYVFGFELKQFDRKHHTYILINKLKPLEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 2408 - RNA, 924 nt, Artificial Sequence
  MAGE-F1__Homo_sapiens__CCDS3269.1
auguugcagacaccagagagcagggggcucccggucccgcaggccgagggggagaaggauggcggccaugauggugagacccgggccccgaccgccucgcaggagcgccccaaggaggagcuuggcgccgggagggaggagggggcugcggagcccgcccucacccggaaaggcgcgagggccuuggcggccaaagccuuggcaaggcgcagggccuaccgccggcugaaucggacgguggcggaguuggugcaguuccuccuggugaaagacaagaagaagagucccaucacacgcucggagauggugaaauacguuauuggagacuugaagauucuguucccggacaucaucgcaagggccgcagagcaucugcgguaugucuuugguuuugagcugaaacaguuugaccgcaagcaccacacuuacauccugaucaacaaacuaaaaccucuggaggaggaggaggaggaggaucugggaggagauggccccagauugggucuguuaaugaugauccugggccuuaucuauaugagagguaauagcgccagggaggcccaggucugggagaugcugcgucgguugggggugcaacccucaaaguaucauuuccucuuuggguauccgaagaggcuuauuauggaagauuuugugcagcagcgauaucucaguuacaggcgggugccucacaccaauccaccagaauaugaauucucuugggguccccgaagcaaccuggaaaucagcaagauggaaguccugggguucguggccaaacugcauaagaaggaaccgcagcacuggccagugcaguaccgugaggcccuagcagacgaggccgacagggccagagccaaggccagagcugaagccaguaugagggccagggccagugcuagggccggcauccaccucugguga

SEQ ID NO: 2409 - RNA, 924 nt, Artificial Sequence
  derived and/or modified sequence opt1 from MAGE-F1__Homo_sapiens__CCDS3269.1
augcugcagacccccgagagccgcggccucccggugccccaggccgagggggagaaggacggcgggcacgacggcgagacccgggcccccacggcgucccaggagcgccccaaggaggagcugggggccggccgggaggagggcgccgccgagccggcccugacccgcaagggggcgcgggcccucgccgccaaggcgcuggcccgccggcgcgccuaccggcgccugaaccggaccgucgccgagcucgugcaguuccugcuggugaaggacaagaagaagucccccaucacccgcagcgagauggucaaguacgugaucggcgaccucaagauccuguuccccgacaucaucgcccgggcggccgagcaccuccgcuacguguucggguucgagcugaagcaguucgaccggaagcaccacacguacauccugaucaacaagcugaagccccucgaggaggaggaggaggaggaccugggcggggacggcccgcgccugggccuccugaugaugauccuggggcucaucuacaugcggggcaacagcgcccgcgaggcccaggucugggagaugcugcggcgccugggggugcagcccuccaaguaccacuuccucuucggcuaccccaagcggcugaucauggaggacuucgugcagcagcgcuaccugagcuaccgccgggucccccacaccaacccgcccgaguacgaguucuccuggggcccccgcagcaaccucgagaucuccaagauggaggugcugggguucguggccaagcugcacaagaaggagccccagcacuggccgguccaguaccgggaggcgcucgccgacgaggccgaccgcgcccgggccaaggcgcgcgccgaggccagcaugcgggcccgcgccuccgcgcgggccggcauccaccugugguga

SEQ ID NO: 2410 - RNA, 924 nt, Artificial Sequence
  derived and/or modified sequence opt2 from MAGE-F1__Homo_sapiens__CCDS3269.1
augcuccagacccccgagucccgcggccuccccgucccccaggccgagggcgagaaggacggcggccacgacggcgagacccgcgcccccaccgccucccaggagcgccccaaggaggagcucggcgccggccgcgaggagggcgccgccgagcccgcccucacccgcaagggcgcccgcgcccucgccgccaaggcccucgcccgccgccgcgccuaccgccgccucaaccgcaccgucgccgagcucguccaguuccuccucgucaaggacaagaagaagucccccaucacccgcuccgagauggucaaguacgucaucggcgaccucaagauccucuuccccgacaucaucgcccgcgccgccgagcaccuccgcuacgucuucggcuucgagcucaagcaguucgaccgcaagcaccacaccuacauccucaucaacaagcucaagccccucgaggaggaggaggaggaggaccucggcggcgacggcccccgccucggccuccucaugaugauccucggccucaucuacaugcgcggcaacuccgcccgcgaggcccaggucugggagaugcuccgccgccucggcguccagcccuccaaguaccacuuccucuucggcuaccccaagcgccucaucauggaggacuucguccagcagcgcuaccucuccuaccgccgcgucccccacaccaacccccccgaguacgaguucuccuggggcccccgcuccaaccucgagaucuccaagauggagguccucggcuucgucgccaagcuccacaagaaggagccccagcacuggcccguccaguaccgcgaggcccucgccgacgaggccgaccgcgcccgcgccaaggcccgcgccgaggccuccaugcgcgcccgcgccuccgcccgcgccggcauccaccucugguga

SEQ ID NO: 2411 - RNA, 924 nt, Artificial Sequence
  derived and/or modified sequence opt3 from MAGE-F1__Homo_sapiens__CCDS3269.1
augcugcagacccccgagagcagaggccucccugugccacaagccgaaggggagaaggacggaggucacgauggcgaaacaagggcuccgacugcaucccaggagcggcccaaagaagaacuuggggccggacgcgaggaaggcgcggcugagccugcccugacgcgaaagggugcacgugccuuggcugcaaaagccuuagcuagaaggcgggccuaccgcagacugaacaggaccgucgcggagcuaguucaguuccuccuggugaaggacaaaaagaagucuccaaucacacggucagagaugguaaaauaugugauuggggaucuuaagauacuguuucccgacaucauugcacgcgccgcugagcauuugcgauacgucuucggauuugaacucaaacaguucgauagaaagcaccauacuuauauccugauuaauaaacugaagccucucgaggaagaggaagaggaggacuuaggcggcgaugggccaaggcugggacuuuugaugaugauccugggucuaauauacaugcggggcaacagugcccgugaagcacaagugugggagaugcuccgcagacuggggguucagcccagcaaguaucacuuucuuuucggauacccuaaaaggcugaucauggaagacuuugugcagcagcgguauuuguccuaccgacgcgucccacauaccaauccgcccgaguacgaguucucuuggggcccuagaucgaaccucgaaauuucaaagauggaggugcuggguuuuguagcuaaauuacacaagaaagaaccacaacacuggcccguucaguauagggaggcccuggcggaugaagccgaccgggcacgcgcuaaggccagagcugaggccagcaugagggcacgugccagugcucgggcggggauccaucucugguga

(The sequence listing continues in the following parts.)

The invention claimed is:

1. A method for treating a subject having cancer comprising administering (a) a composition comprising non-coding immunostimulating RNA (isRNA) of 5 to 1,000 bases in length to the subject by intratumoral injection, wherein the immunostimulating RNA is complexed with one or more cationic or polycationic compounds, and (b) an immune checkpoint modulator selected from a PD-1 inhibitor and a PD-L1 inhibitor.

2. The method of claim 1, wherein the immunostimulating RNA comprises a sequence at least 90% identical to SEQ ID NO: 5, 394 or 10072.

3. The method of claim 1, wherein the one or more cationic or polycationic compounds comprise polymers, peptides, polysaccharides, and/or lipids.

4. The method of claim 1, wherein the cationic or polycationic compound is a polymeric carrier.

5. The method of claim 4, wherein the polymeric carrier comprises disulfide-crosslinked cationic peptides.

6. The method of claim 4, wherein the polymeric carrier comprises a cationic peptide $CR_{12}C$ and/or $CR_{12}$.

7. The method of claim 1, wherein the immunostimulating RNA comprises a sequence at least 90% identical to SEQ ID NO: 5 and the polymeric carrier comprises a cationic peptides comprising the sequence $CR_{12}C$, said cationic peptides comprising crosslinks by C-C disulfide bonds.

8. The method of claim 1, wherein the composition further comprises a mRNA encoding a cytokine.

9. The method of claim 8, wherein the mRNA encoding a cytokine comprises a 5'-UTR element, a 3'-UTR element, a histone stem-loop, a 5'-CAP structure, a poly(A) sequence, and/or a poly(C) sequence.

10. The method of claim 1, further comprising administering a cytokine.

11. The method of claim 10, wherein the cytokine comprises IL-12.

12. The method of claim 10, wherein the cytokine comprises a mRNA encoding IL-12.

13. The method of claim 12, wherein the mRNA encoding IL-12 is administered via intratumoral injection.

14. The method of claim 1, wherein the immune checkpoint modulator is a PD-L1 inhibitor.

15. The method of claim 1, further comprising administering CD40L or an mRNA encoding CD40L to the subject.

16. The method of claim 14, wherein the immune checkpoint modulator is an antibody directed against PD-L1.

* * * * *